(12) United States Patent
Lee et al.

(10) Patent No.: US 10,900,036 B2
(45) Date of Patent: Jan. 26, 2021

(54) RNA INTERACTOME OF POLYCOMB REPRESSIVE COMPLEX 1 (PRC1)

(71) Applicant: The General Hospital Corporation, Boston, MA (US)

(72) Inventors: Jeannie T. Lee, Boston, MA (US); Michael Rosenberg, Brookline, MA (US); Barry Kesner, Charlestown, MA (US)

(73) Assignee: The General Hospital Corporation, Boston, MA (US)

( * ) Notice: Subject to any disclaimer, the term of this patent is extended or adjusted under 35 U.S.C. 154(b) by 0 days.

(21) Appl. No.: 15/558,974

(22) PCT Filed: Mar. 17, 2016

(86) PCT No.: PCT/US2016/022778
§ 371 (c)(1),
(2) Date: Sep. 15, 2017

(87) PCT Pub. No.: WO2016/149455
PCT Pub. Date: Sep. 22, 2016

(65) Prior Publication Data
US 2018/0320175 A1 Nov. 8, 2018

Related U.S. Application Data

(60) Provisional application No. 62/134,361, filed on Mar. 17, 2015.

(51) Int. Cl.
*C07H 21/04* (2006.01)
*C12N 15/113* (2010.01)
*C12Q 1/6883* (2018.01)
*C12Q 1/6806* (2018.01)
*C12Q 1/6886* (2018.01)

(52) U.S. Cl.
CPC .......... *C12N 15/113* (2013.01); *C12Q 1/6806* (2013.01); *C12Q 1/6883* (2013.01); *C12Q 1/6886* (2013.01); *C12N 2310/113* (2013.01); *C12N 2310/3231* (2013.01); *C12Q 2600/158* (2013.01); *C12Q 2600/178* (2013.01)

(58) Field of Classification Search
CPC .................................................... C12N 15/111
See application file for complete search history.

(56) References Cited

U.S. PATENT DOCUMENTS

| | | |
|---|---|---|
| 5,491,133 A | 2/1996 | Walder et al. |
| 5,576,208 A | 11/1996 | Monia et al. |
| 5,623,065 A | 4/1997 | Cook et al. |
| 5,652,355 A | 7/1997 | Metelev et al. |
| 5,661,134 A | 8/1997 | Cook et al. |
| 5,914,396 A | 6/1999 | Cook et al. |
| 5,919,619 A | 7/1999 | Tullis |
| 5,965,722 A | 10/1999 | Ecker et al. |
| 5,976,879 A | 11/1999 | Kole et al. |
| 6,015,710 A | 1/2000 | Shay et al. |
| 6,040,142 A | 3/2000 | Melki et al. |
| 6,046,307 A | 4/2000 | Shay et al. |
| 6,063,400 A | 5/2000 | Geho et al. |
| 6,080,577 A | 6/2000 | Melki et al. |
| 6,107,094 A | 8/2000 | Crooke |
| 6,143,881 A | 11/2000 | Metelev et al. |
| 6,146,829 A | 11/2000 | Cook et al. |
| 6,197,944 B1 | 3/2001 | Walder et al. |
| 6,210,892 B1 | 4/2001 | Bennett et al. |
| 6,277,573 B1 | 8/2001 | Koester |
| 6,284,458 B1 | 9/2001 | Anderson et al. |
| 6,294,650 B1 | 9/2001 | Shay et al. |
| 6,326,199 B1 | 12/2001 | Cook et al. |
| 6,346,614 B1 | 2/2002 | Metelev et al. |
| 6,359,124 B1 | 3/2002 | Ecker et al. |
| 6,451,991 B1 | 9/2002 | Martin et al. |
| 6,531,584 B1 | 3/2003 | Cook et al. |
| 6,608,035 B1 | 8/2003 | Agrawal et al. |
| 6,653,466 B2 | 11/2003 | Matsuo |
| 6,653,467 B1 | 11/2003 | Matsuo et al. |
| 6,677,445 B1 | 1/2004 | Innis et al. |
| 6,727,355 B2 | 4/2004 | Matsuo et al. |
| 6,753,423 B1 | 6/2004 | Cook et al. |
| 6,831,166 B2 | 12/2004 | Manoharan et al. |
| 6,919,439 B2 | 7/2005 | Manoharan et al. |
| 7,015,315 B1 | 3/2006 | Cook et al. |
| 7,033,752 B1 | 4/2006 | Melki et al. |
| 7,041,816 B2 | 5/2006 | Ravikumar et al. |
| 7,045,609 B2 | 5/2006 | Metelev et al. |
| 7,341,835 B2 | 3/2008 | Blume et al. |
| 7,683,036 B2 | 3/2010 | Esau et al. |
| 7,687,617 B2 | 3/2010 | Thrue et al. |
| 7,709,456 B2 | 5/2010 | Corey et al. |
| 7,838,657 B2 | 11/2010 | Singh et al. |
| 7,858,592 B2 | 12/2010 | Shames et al. |
| 7,879,992 B2 | 2/2011 | Vickers et al. |
| 7,888,012 B2 | 2/2011 | Iversen et al. |
| 7,960,541 B2 | 6/2011 | Wilton et al. |
| 8,067,569 B2 | 11/2011 | Iversen et al. |
| 8,092,992 B2 | 1/2012 | Kuwabara et al. |
| 8,110,560 B2 | 2/2012 | Singh et al. |
| 8,129,515 B2 | 3/2012 | Esau et al. |
| 8,153,365 B2 | 4/2012 | Wengel et al. |

(Continued)

FOREIGN PATENT DOCUMENTS

| | | |
|---|---|---|
| CA | 2805791 | 1/2012 |
| CN | 101619312 | 1/2010 |

(Continued)

OTHER PUBLICATIONS

Turner et al., Cell Stem Cell, 12 (2) (Feb. 7, 2013), pp. 145-146.*

(Continued)

*Primary Examiner* — Kimberly Chong
(74) *Attorney, Agent, or Firm* — Fish & Richardson P.C.

(57) ABSTRACT

This invention relates to polycomb-associated RNAs, libraries and fragments of those RNAs, inhibitory nucleic acids and methods and compositions for targeting RNAs, and methods of use thereof.

12 Claims, 10 Drawing Sheets
Specification includes a Sequence Listing.

(56) References Cited

U.S. PATENT DOCUMENTS

| | | |
|---|---|---|
| 8,153,602 B1 | 4/2012 | Bennett et al. |
| 8,153,606 B2 | 4/2012 | Collard et al. |
| 8,222,221 B2 | 7/2012 | Corey et al. |
| 8,232,384 B2 | 7/2012 | Wilton et al. |
| 8,288,354 B2 | 10/2012 | Wahlestedt |
| 8,288,356 B2 | 10/2012 | Obad et al. |
| 8,318,690 B2 | 11/2012 | Collard et al. |
| 8,361,977 B2 | 1/2013 | Baker et al. |
| 8,361,980 B2 | 1/2013 | Kauppinen et al. |
| 8,404,659 B2 | 3/2013 | Kauppinen et al. |
| 8,415,313 B2 | 4/2013 | Mourich et al. |
| 2002/0160379 A1 | 10/2002 | Cook et al. |
| 2004/0002153 A1 | 1/2004 | Monia et al. |
| 2004/0005666 A1 | 1/2004 | Hayden et al. |
| 2004/0038274 A1 | 2/2004 | Cook et al. |
| 2005/0226848 A1 | 10/2005 | Kuwabara et al. |
| 2005/0246794 A1 | 11/2005 | Khvorova et al. |
| 2005/0261218 A1 | 11/2005 | Esau et al. |
| 2006/0089490 A1 | 4/2006 | Melki et al. |
| 2006/0128646 A1 | 6/2006 | Christensen et al. |
| 2006/0270624 A1 | 11/2006 | Cook et al. |
| 2007/0032446 A1 | 2/2007 | Cook et al. |
| 2007/0111963 A1 | 5/2007 | Corey et al. |
| 2007/0166737 A1 | 7/2007 | Melki et al. |
| 2007/0191294 A1 | 8/2007 | Elmen et al. |
| 2007/0292408 A1 | 12/2007 | Singh et al. |
| 2008/0015162 A1 | 1/2008 | Bhanot et al. |
| 2008/0125583 A1 | 5/2008 | Rigoutsos et al. |
| 2008/0139472 A1 | 6/2008 | Lauterborn et al. |
| 2008/0176793 A1 | 7/2008 | Simons et al. |
| 2008/0242629 A1 | 10/2008 | Crooke et al. |
| 2008/0249039 A1 | 10/2008 | Elmen et al. |
| 2009/0082297 A1 | 3/2009 | Lioy et al. |
| 2009/0092988 A1 | 4/2009 | Schwartz et al. |
| 2009/0099109 A1 | 4/2009 | Shames et al. |
| 2009/0123467 A1 | 5/2009 | Bedi et al. |
| 2009/0143326 A1 | 6/2009 | Obad et al. |
| 2009/0181914 A1 | 7/2009 | Rosenbohm et al. |
| 2009/0221685 A1 | 9/2009 | Esau et al. |
| 2009/0258925 A1 | 10/2009 | Wahlestedt |
| 2009/0326051 A1 | 12/2009 | Corey et al. |
| 2010/0021914 A1 | 1/2010 | Moeller et al. |
| 2010/0087511 A1 | 4/2010 | Singh et al. |
| 2010/0105760 A1 | 4/2010 | Collard et al. |
| 2010/0124547 A1 | 5/2010 | Bramlage et al. |
| 2010/0197762 A1 | 8/2010 | Swayze et al. |
| 2010/0210707 A1 | 8/2010 | Li et al. |
| 2010/0210712 A1 | 8/2010 | Hansen et al. |
| 2010/0216238 A1 | 8/2010 | Baker et al. |
| 2010/0256223 A1 | 10/2010 | Moeller et al. |
| 2010/0273863 A1 | 10/2010 | Corey et al. |
| 2010/0280100 A1 | 11/2010 | Collard et al. |
| 2010/0286141 A1 | 11/2010 | Durden et al. |
| 2010/0286234 A1 | 11/2010 | Elmen et al. |
| 2010/0317606 A1 | 12/2010 | Chan et al. |
| 2011/0039910 A1 | 2/2011 | Crooke et al. |
| 2011/0077286 A1 | 3/2011 | Damha et al. |
| 2011/0086833 A1 | 4/2011 | Paushkin et al. |
| 2011/0130557 A1 | 6/2011 | Pedersen et al. |
| 2011/0150868 A1 | 6/2011 | Yu et al. |
| 2011/0159587 A1 | 6/2011 | Krainer et al. |
| 2011/0172292 A1 | 7/2011 | Hansen et al. |
| 2011/0207217 A1 | 8/2011 | Corey et al. |
| 2011/0237606 A1 | 9/2011 | Chai et al. |
| 2011/0237649 A1 | 9/2011 | Collard et al. |
| 2011/0237650 A1 | 9/2011 | Collard et al. |
| 2011/0237651 A1 | 9/2011 | Collard et al. |
| 2011/0251261 A1 | 10/2011 | Burnett et al. |
| 2011/0263687 A1 | 10/2011 | Mattick et al. |
| 2011/0269820 A1 | 11/2011 | Singh et al. |
| 2011/0294226 A1 | 12/2011 | Melki et al. |
| 2011/0294870 A1 | 12/2011 | Collard et al. |
| 2011/0319317 A1 | 12/2011 | Collard et al. |
| 2011/0319475 A1 | 12/2011 | Collard et al. |
| 2011/0319476 A1 | 12/2011 | Collard et al. |
| 2012/0004184 A1 | 1/2012 | Collard et al. |
| 2012/0004278 A1 | 1/2012 | Chang et al. |
| 2012/0010156 A1 | 1/2012 | Collard et al. |
| 2012/0046236 A1 | 2/2012 | Collard et al. |
| 2012/0046344 A1 | 2/2012 | Collard et al. |
| 2012/0046345 A1 | 2/2012 | Collard et al. |
| 2012/0064048 A1 | 3/2012 | Collard et al. |
| 2012/0083596 A1 | 4/2012 | Elmen et al. |
| 2012/0088817 A1 | 4/2012 | Collard et al. |
| 2012/0094934 A1 | 4/2012 | Collard et al. |
| 2012/0095079 A1 | 4/2012 | Collard et al. |
| 2012/0095081 A1 | 4/2012 | Collard et al. |
| 2012/0129917 A1 | 5/2012 | Collard et al. |
| 2012/0135941 A1 | 5/2012 | Collard et al. |
| 2012/0142610 A1 | 6/2012 | Collard et al. |
| 2012/0142758 A1 | 6/2012 | Collard et al. |
| 2012/0149756 A1 | 6/2012 | Schumperli et al. |
| 2012/0149757 A1 | 6/2012 | Krainer et al. |
| 2012/0149759 A1 | 6/2012 | Collard et al. |
| 2012/0157333 A1 | 6/2012 | Kauppinen et al. |
| 2012/0165394 A1 | 6/2012 | Singh et al. |
| 2012/0171170 A1 | 7/2012 | Collard et al. |
| 2012/0190728 A1 | 7/2012 | Bennett et al. |
| 2012/0252869 A1 | 10/2012 | Collard et al. |
| 2012/0264812 A1 | 10/2012 | Collard et al. |
| 2012/0277290 A1 | 11/2012 | Collard et al. |
| 2012/0288869 A1 | 11/2012 | Schwartz et al. |
| 2012/0289581 A1 | 11/2012 | Chang et al. |
| 2012/0289583 A1 | 11/2012 | Collard et al. |
| 2012/0295952 A1 | 11/2012 | Collard et al. |
| 2012/0295953 A1 | 11/2012 | Colalrd et al. |
| 2012/0295954 A1 | 11/2012 | Collard et al. |
| 2012/0295959 A1 | 11/2012 | Collard et al. |
| 2012/0309814 A1 | 12/2012 | Collard et al. |
| 2012/0322851 A1 | 12/2012 | Hardee et al. |
| 2012/0322853 A1 | 12/2012 | Collard et al. |
| 2012/0329727 A1 | 12/2012 | Collard et al. |
| 2012/0329855 A1 | 12/2012 | Collar et al. |
| 2013/0035372 A1 | 2/2013 | Collard et al. |
| 2013/0035373 A1 | 2/2013 | Collard et al. |
| 2013/0053428 A1 | 2/2013 | Wahlestedt |
| 2013/0065947 A1 | 3/2013 | Collard et al. |
| 2013/0072421 A1 | 3/2013 | Collard et al. |
| 2013/0072546 A1 | 3/2013 | Collard et al. |
| 2013/0079505 A1 | 3/2013 | Moeller et al. |
| 2013/0085112 A1 | 4/2013 | Collard et al. |
| 2013/0096183 A1 | 4/2013 | Collard et al. |
| 2013/0116300 A1 | 5/2013 | Collard et al. |
| 2013/0137751 A1 | 5/2013 | Collard et al. |
| 2013/0143946 A1 | 6/2013 | Collard et al. |
| 2013/0164846 A1 | 6/2013 | Saestrom |
| 2013/0184325 A9 | 7/2013 | Collard et al. |
| 2013/0210893 A1 | 8/2013 | Collard et al. |
| 2013/0245095 A1 | 9/2013 | Collard et al. |
| 2013/0245099 A1 | 9/2013 | Collard et al. |
| 2013/0253036 A1 | 9/2013 | Collard et al. |
| 2013/0261065 A1 | 10/2013 | Collard et al. |
| 2014/0142160 A1 | 5/2014 | Lee et al. |
| 2014/0227271 A1 | 8/2014 | Yan et al. |

FOREIGN PATENT DOCUMENTS

| | | |
|---|---|---|
| EP | 0 999 270 | 5/2000 |
| EP | 1 044 987 | 10/2000 |
| EP | 1 752 536 | 5/2005 |
| EP | 1 695 979 | 8/2006 |
| EP | 2 021 472 | 6/2011 |
| EP | 2 023 940 | 6/2011 |
| EP | 2 431 467 | 3/2012 |
| EP | 2 548 560 | 1/2013 |
| KR | 10-2011-0050134 | 5/2011 |
| WO | WO 1989/005358 | 6/1989 |
| WO | WO 1992/000386 | 1/1992 |
| WO | WO 1993/013121 | 7/1993 |
| WO | WO 1994/002499 | 2/1994 |
| WO | WO 1994/017093 | 8/1994 |
| WO | WO 1995/033852 | 12/1995 |
| WO | WO 2001/036627 | 5/2001 |
| WO | WO 2001/066129 | 9/2001 |

(56) References Cited

FOREIGN PATENT DOCUMENTS

| | | |
|---|---|---|
| WO | WO 2002/038738 | 5/2002 |
| WO | WO 2002/103015 | 12/2002 |
| WO | WO 2004/113867 | 12/2004 |
| WO | WO 2005/013901 | 2/2005 |
| WO | WO 2005/042018 | 5/2005 |
| WO | WO 2005/044981 | 5/2005 |
| WO | WO 2005/089169 | 9/2005 |
| WO | WO 2006/063356 | 6/2006 |
| WO | WO 2006/069584 | 7/2006 |
| WO | WO 2006/130201 | 12/2006 |
| WO | WO 2007/002390 | 1/2007 |
| WO | WO 2007/004977 | 1/2007 |
| WO | WO 2007/047913 | 4/2007 |
| WO | 2007/078599 | 7/2007 |
| WO | WO 2007/076328 | 7/2007 |
| WO | WO 2007/086990 | 8/2007 |
| WO | WO 2007/112753 | 10/2007 |
| WO | WO 2007/112754 | 10/2007 |
| WO | WO 2007/115578 | 10/2007 |
| WO | WO 2007/133812 | 11/2007 |
| WO | WO 2008/025069 | 3/2008 |
| WO | WO 2008/029619 | 3/2008 |
| WO | WO 2008/061537 | 5/2008 |
| WO | WO 2008/103761 | 8/2008 |
| WO | WO 2008/103763 | 8/2008 |
| WO | WO 2008/113832 | 9/2008 |
| WO | WO 2008/132234 | 11/2008 |
| WO | WO 2008/138904 | 11/2008 |
| WO | WO 2008/151639 | 12/2008 |
| WO | WO 2009/043353 | 4/2009 |
| WO | WO 2009/046397 | 4/2009 |
| WO | WO 2009/061851 | 5/2009 |
| WO | WO 2009/064920 | 5/2009 |
| WO | WO 2009/124341 | 10/2009 |
| WO | WO 2009/127680 | 10/2009 |
| WO | WO 2009/134710 | 11/2009 |
| WO | WO 2009/149182 | 12/2009 |
| WO | WO 2009/151546 | 12/2009 |
| WO | WO 2010/000665 | 1/2010 |
| WO | WO 2010/007522 | 1/2010 |
| WO | WO 2010/014592 | 2/2010 |
| WO | WO 2010/065662 | 6/2010 |
| WO | WO 2010/065671 | 6/2010 |
| WO | WO 2010/065787 | 6/2010 |
| WO | WO 2010/065792 | 6/2010 |
| WO | WO 2010/076248 | 7/2010 |
| WO | WO 2010/093860 | 8/2010 |
| WO | WO 2010/093904 | 8/2010 |
| WO | WO 2010/093906 | 8/2010 |
| WO | WO 2010/102058 | 9/2010 |
| WO | WO 2010/107733 | 9/2010 |
| WO | WO 2010/107740 | 9/2010 |
| WO | WO 2010/115993 | 10/2010 |
| WO | WO 2010/120820 | 10/2010 |
| WO | WO 2010/122538 | 10/2010 |
| WO | WO 2010/127195 | 11/2010 |
| WO | WO 2010/129746 | 11/2010 |
| WO | WO 2010/129799 | 11/2010 |
| WO | WO 2010/129861 | 11/2010 |
| WO | WO 2010/135329 | 11/2010 |
| WO | WO 2010/135695 | 11/2010 |
| WO | WO 2010/138806 | 12/2010 |
| WO | WO 2010/148050 | 12/2010 |
| WO | WO 2010/148065 | 12/2010 |
| WO | WO 2010/148249 | 12/2010 |
| WO | WO 2010/151671 | 12/2010 |
| WO | WO 2010/151674 | 12/2010 |
| WO | WO 2011/017516 | 2/2011 |
| WO | WO 2011/019815 | 2/2011 |
| WO | WO 2011/022606 | 2/2011 |
| WO | WO 2011/025862 | 3/2011 |
| WO | WO 2011/031482 | 3/2011 |
| WO | WO 2011/032109 | 3/2011 |
| WO | WO 2011/038205 | 3/2011 |
| WO | WO 2011/038210 | 3/2011 |
| WO | WO 2011/048125 | 4/2011 |
| WO | WO 2011/055880 | 5/2011 |
| WO | WO 2011/079261 | 6/2011 |
| WO | WO 2011/079263 | 6/2011 |
| WO | WO 2011/082409 | 7/2011 |
| WO | WO 2011/084455 | 7/2011 |
| WO | WO 2011/085066 | 7/2011 |
| WO | WO 2011/085347 | 7/2011 |
| WO | WO 2011/090740 | 7/2011 |
| WO | WO 2011/090741 | 7/2011 |
| WO | WO 2011/091390 | 7/2011 |
| WO | WO 2011/097388 | 8/2011 |
| WO | WO 2011/097582 | 8/2011 |
| WO | WO 2011/097641 | 8/2011 |
| WO | WO 2011/103528 | 8/2011 |
| WO | WO 2011/123745 | 10/2011 |
| WO | WO 2011/127337 | 10/2011 |
| WO | WO 2011/139387 | 11/2011 |
| WO | WO 2011/143640 | 11/2011 |
| WO | WO 2011/146674 | 11/2011 |
| WO | WO 2011/146675 | 11/2011 |
| WO | WO 2011/150005 | 12/2011 |
| WO | WO 2011/150007 | 12/2011 |
| WO | WO 2011/159836 | 12/2011 |
| WO | WO 2011/163499 | 12/2011 |
| WO | WO 2012/009347 | 1/2012 |
| WO | WO 2012/009402 | 1/2012 |
| WO | WO 2012/012467 | 1/2012 |
| WO | WO 2012/018881 | 2/2012 |
| WO | WO 2012/024478 | 2/2012 |
| WO | WO 2012/027033 | 3/2012 |
| WO | WO 2012/036433 | 3/2012 |
| WO | WO 2012/047956 | 4/2012 |
| WO | WO 2012/054723 | 4/2012 |
| WO | WO 2012/058268 | 5/2012 |
| WO | WO 2012/065143 | 5/2012 |
| WO | WO 2012/068340 | 5/2012 |
| WO | WO 2012/069059 | 5/2012 |
| WO | WO 2012/071238 | 5/2012 |
| WO | WO 2012/087983 | 6/2012 |
| WO | WO 2012/109476 | 8/2012 |
| WO | WO 2012/138487 | 10/2012 |
| WO | WO 2012/144220 | 10/2012 |
| WO | WO 2012/170771 | 12/2012 |
| WO | WO 2012/178122 | 12/2012 |
| WO | WO 2013/006619 | 1/2013 |
| WO | WO 2013/036403 | 3/2013 |
| WO | WO 2013/138374 | 9/2013 |
| WO | WO 2013/041385 | 11/2013 |
| WO | WO 2013/173598 | 11/2013 |
| WO | WO 2013/173599 | 11/2013 |
| WO | WO 2013/173601 | 11/2013 |
| WO | WO 2013/173605 | 11/2013 |
| WO | WO 2013/173608 | 11/2013 |
| WO | WO 2013/173635 | 11/2013 |
| WO | WO 2013/173637 | 11/2013 |
| WO | WO 2013/173638 | 11/2013 |
| WO | WO 2013/173645 | 11/2013 |
| WO | WO 2013/173647 | 11/2013 |
| WO | WO 2013/173652 | 11/2013 |
| WO | WO 2014/025887 | 2/2014 |
| WO | WO 2017/075030 | 5/2017 |

OTHER PUBLICATIONS

Alm and Lee, "Retinoic acid accelerates downregulation of the Xist repressor, Oct4, and increases the likelihood of Xist activation when Tsix is deficient," BMC Develop Biol., 2010, 10:90, 14 pages.

Ali Faghihi et al., "Expression of a noncoding RNA is elevated in Alzheimer's disease and drives rapid fee- forward regulation of [beta]-secretase," Nature Medicine, 14(7):723-730 (Jul. 2008).

Astuti et al., "Epigenetic alteration at the DLK1-GTL2 imprinted domain in human neoplasia: analysis of neuroblastoma, phaeochromocytoma and Wilms' tumour," British Journal of Cancer, 92(8):1574-1580 (2005).

Axelson, "The Notch signaling cascade in neuroblastoma: role of the basic helix-loop-helix proteins HASH-1 and HES-1," Cancer Lett., 2004, 204:171-178.

(56) References Cited

OTHER PUBLICATIONS

Bauman et al., "Therapeutic potential of splice-switching oligonucleotides," Oligonucleotides, Mar. 2009, 19(1):1-13.
Baumann and De La Fuente, "ATRX marks the inactive X chromosome (Xi) in somatic cells and during imprinted X chromosome inactivation in trophoblast stem cells," Chromosoma, Apr. 2009, 118: 209-222.
Behlke et al, "Designing Antisense Oligonucleotides," Integrated DNA Technologies, 2005, pp. 1-17.
Beletskii et al., "PNA interference mapping demonstrates functional domains in the noncoding RNA Xist," Proc Natl Acad Sci U S A, 2001, 98(16):9215-9220.
Beltran et al, "The interaction of PRC2 with RNA or chromatin is mutually antagonistic," Genome Research, 2016, 26: 896-907.
Bernardi and Pandolfi, "Structure, dynamics and functions of promyelocytic leukaemia nuclear bodies," Nat Rev Mol Cell Biol., 2007, 8:1006-1016.
Bernstein and Allis, "RNA meets chromatin," Genes Dev., 2005, 19:1635-1655.
Bernstein et al., "A bivalent chromatin structure marks key developmental genes in embryonic stem cells," Cell, 2006, 125:315-326.
Bernstein et al., "Mouse polycomb proteins bind differentially to methylated histone H3 and RNA 15 and are enriched in facultative heterochromatin," Mol Cell Biol., 2006, 26:2560-2569.
Boyer et al., "Polycomb complexes repress developmental regulators in murine embryonic stem cells," Nature, 2006, 441:349-353.
Brockdorff et al., "The product of the mouse Xist gene is a 15 kb inactive X-specific transcript containing no conserved ORF and located in the nucleus," Cell, 1992, 71(3):515-526.
Brown et al., "The human XIST gene: analysis of a 17 kb inactive X-specific RNA that contains conserved repeats and is highly localized within the nucleus," Cell, 1992, 71(3):527-542.
Brown et al., "A gene from the region of the human X inactivation centre is expressed exclusively from the inactive X chromosome," Nature, 349:38-44 (Jan. 3, 1991).
Cardoso et al., "Specific interaction between the XNP/ATR-X gene product and the SET domain of the human EZH2 protein," Human Molecular Genetics, 1998, 7: 679-684.
Carninci, et al., "The transcriptional landscape of the mammalian genome," Science, Sep. 2, 2005, 309(5740):1559-1563.
Carthew and Sontheimer, "Origins and Mechanisms of miRNAs and siRNAs. Cell," Feb. 20, 2009, 136(4):642-55.
Catalogue of Parent of Origin Effects, Imprinted Genes and Related Effects, Parental Origins of de novo Mutations, downloaded at http://igc.otago.ac.nz/home.html on May 22, 2015, 2 pgs.
Chadwick and Willard, "Multiple spatially distinct types of facultative heterochromatin on the human inactive X chromosome," PNAS, 2004, 101: 17450-17455.
Chahrour et al., "MeCP2, a key contributor to neurological disease, activates and represses transcription," Science, May 30, 2008, 320(5880):1224-9 (Author Manuscript).
Cifuentes-Rojas et al., "Regulatory Interactions between RNA and Polycomb Repressive Complex 2," Molecular Cell, Jul. 2014, 55: 171-185.
Clark et al., "The Reality of Pervasive Transcription," PLOS Bio., Jul. 2011, 9(7):e1000625. 6 pages.
Clemson et al., "XIST RNA paints the inactive X chromosome at interphase: evidence for a novel RNA involved in nuclear/chromosome structure," J Cell Biol., 1996, 132(3):259-275.
Cloonan et al., "Stem cell transcriptome profiling via massive-scale mRNA sequencing," Nat Methods, 2008, 5:613-619.
Clynes et al., "The chromatin remodeler ATRX: a repeat offender in human disease," Trends in Biomedical Sciences 38(9): 461-466 (2013).
Coombes et al., "Epigenetic properties and identification of an imprint mark in the Nesp-Gnasxl domain of the mouse Gnas imprinted locus," Mol Cell Biol., 2003, 23:5475-5488.
Core et al., "Nascent RNA sequencing reveals widespread pausing and divergent initiation at human promoters," Science, 2008, 322:1845-1848 (Author Manuscript).

Costa et al., "Non-coding RNAs: New players in eukaryotic biology," Gene, 357(2):83-94 (2005).
Costanzi and Pehrson, "Histone macroH2A1 is concentrated in the inactive X chromosome of female mammals," Nature, 1998, 393: 599-601.
Curran, et al., "Computer aided manual validation of mass spectrometry-based proteomic data," Methods, 2013, 61: 219-226.
Cushman et al, Synthesis of the Covalent Hydrate of the Incorrectly Assumed Structure of Aurintricarboxylic Acid (ATA), 1990, Tetrahedron, vol. 46, 5: 1491-1498.
da Rocha et al., "Jarid2 Is Implicated in the Initial Xist-Induced Targeting of PRC2 to the Inactive X Chromosome," Molecular Cell, 2014, 53: 301-316.
Darnell, "HITS-CLIP: panoramic views of protein-RNA regulation in living cells," Wiley Interdiscip Rev RNA, Sep.-Oct. 2010, 1(2): 266-286.
Davidovich et al, "Toward a Consensus on the Binding Specificity and Promiscuity of PRC2 for RNA," Molecular Cell, Jan. 2015, 57: 552-558.
Davidovich, "The recruitment of chromatin modifiers by long noncoding RNAs: lessons from PRC2," RNA, 2015, 21: 2007-2022.
Davidovich, et al., "Promiscuous RNA binding by Polycomb repressive complex 2," Nature Structural & Molecular Biology, Nov. 2013, 20: 1250-1257.
Davidson et al., "Singles engage the RNA interference pathway," Cell, Aug. 31, 2012, 150(5):873-5.
Denisenko et al., "Point mutations in the WD40 domain of Eed block its interaction with Ezh2," Mol Cell Biol., 1998, 18:5634-5642.
Dhayalan et al., "The ATRX-ADD domain binds to H3 tail peptides and reads the combined.methylation state of K4 and K9," Human Molecular Genetics, 2011, 20: 2195-2203.
Di Certo et al., "The artificial gene Jazz, a transcriptional regulator of utrophin, corrects the dystrophic pathology in mdx mice," Hum Mol Genet., Mar. 1, 2010, 19(5):752-60.
Dinger et al., "NRED: a database of long noncoding RNA expression," Nucleic Acids Res., 2009, 37(suppl 1):D122-D126.
Dominski and Kole, "Identification and characterization by antisense oligonucleotides of exon and intron sequences required for splicing," Mol Cell Biol., Nov. 1994, 14(11):7445-7454.
Dominski and Kole, "Restoration of correct splicing in thalassemic pre-mRNA by antisense oligonucleotides," Proc Natl Acad Sci U S A, Sep. 15, 1993, 90(18):8673-7.
Du and Gatti, "Progress toward therapy with antisense-mediated splicing modulation," Curr Opin Mol Ther., Apr. 2009, 11(2):116-23 (Author Manuscript).
Dupont and Gribnau. "Different flavors of X-chromosome inactivation in mammals," Current Opinion in Cell Biology, 2013, 25, 314-321.
Duszczyk et al, "The XIST RNA A-repeat comprises a novel AUCG tetraloop fold and a platform for multimerization," RNA, 2011, 17: 1973-1982.
Duthie et al., "XIST RNA exhibits a banded localization on the inactive X chromosome and is excluded from autosomal material in cis," Hum Mol Genet., 1999, 8(2):195-204.
Edwards and Ferguson-Smith, "Mechanisms regulating imprinted genes in clusters," Curr Opin Cell Biol., 2007, 19:281-289.
Edwards et al., "The evolution of the DLK1-DIO3 imprinted domain in mammals," PLoS Biol., 2008, 6:e135, 14 pages.
Engstrom et al., "Complex Loci in Human and Mouse Genomes," PLoS Genet., 2006, 2:e47, 14 pages.
European Search Report issued in EP11852141.8 dated Jan. 7, 2015 (7 pages).
Eustermann et al, "Combinatorial readout of histone H3 modifications specifies localization of ATRX to heterochromatin," Nature Structural & Molecular Biology, 2011, 18: 777-782.
Extended European Search Report in Application No. 17000579.7, dated Oct. 2, 2017, 9 pages.
Extended European Search Report issued in EP11840099.3 dated Oct. 7, 2014 (7 pages).
Francis et al., "Reconstitution of a functional core polycomb repressive complex," Mol Cell, 2001, 8:545-556.

(56) References Cited

OTHER PUBLICATIONS

Frieden et al., "Expanding the design horizon of antisense oligonucleotides with alpha-L-LNA," Nucleic Acids Res., Nov. 1, 2003, 31(21):6365-72.
Froberg et al., "Guided by RNAs: X-inactivation as a model for lncRNA function," J Mol Biol., 425(19):3698-706 (Oct. 9, 2013) doi: 10.1016/j.jmb.2013.06.031. Epub Jun. 28, 2013. Review. 15 pages.
Garrick et al., "Loss of Atrx affects trophoblast development and the pattern of X-inactivation in extraembryonic tissues," PLoS Genetics, 2006, 2: e58.
GenBank AC092371.3 Homo sapiens chromosome 16 clone RP11-525J10, complete sequence [online] Sep. 29, 2001 [retrieved Jan. 21, 2016]. Available on the internet: <http://www.ncbi.nlm.nih.gov/nuccore/AC092371>. 1 page.
GenBank AC239669.1 Homo sapiens chromosome 18 clone COR2A-DD0002SOMNU_J21, Working Draft Sequence, 2 unordered pieces [online] Jan. 22, 2010 [retrieved Jan. 21, 2016]. Available on the internet: <http://www.ncbi.nlm.nih.gov/nuccore/AC239669>. 1 page.
Genbank Submission; NIH/NCBI, Accession No. AA106140. Marra et al., Feb. 4, 1997. 1 page.
Genbank Submission; NIH/NCBI, Accession No. AL137002. Holt, Dec. 13, 2012. 29 pages.
Genbank Submission; NIH/NCBI, Accession No. BX383579. Li et al., Dec. 23, 2010. 1 page.
Genbank Submission; NIH/NCBI, Accession No. NM_001079668. Young et al., Jan. 18, 2014. 4 pages.
Genbank Submission; NIH/NCBI, Accession No. NM_003317. Young et al., Jan. 18, 2014. 4 pages.
Genbank Submission; NIH/NCBI, Accession No. NM_028475. Diez-Roux et al., Feb. 3, 2014. 6 pages.
Geneimprint: About Geneimprint, downloaded from the internet at http://www.geneimprint.com/site/about-this-site on May 22, 2015.
Gibbons et al., "Mutations in the chromatin-associated protein ATRX," Human Mutation, 2008, 29: 796-802.
Gogliotti et al., "The DcpS inhibitor RG3039 improves survival, function and motor unit pathologies in two SMA mouse models," Hum Mol Genet., Jun. 4, 2013, 55 pages.
Goldberg et al., "Distinct factors control histone variant H3.3 localization at specific genomic regions," Cell, 2010, 140, 678-691.
Gontan et al., "Long Noncoding RNAs and X Chromosome Inactivation," Prog Mol Subcell Biol., 51:43-64 (2011) doi: 10.1007/978-3-642-16502-3_3.
Guo et al., "High resolution genome wide binding event finding and motif discovery reveals transcription factor spatial binding constraints," PLoS Comput Biol., 2012, 8(8):e1002638.
Gupta et al., "Long non-coding RNA HOTAIR reprograms chromatin state to promote cancer metastasis," Nature, Apr. 15, 2010, 464(7291):1071-6 (Author Manuscript).
Guttman and Rinn, "Modular regulatory principles of large non-coding RNAs," Nature, Feb. 15, 2012, 482(7385):339-46.
Guttman et al., "Chromatin signature reveals over a thousand highly conserved large non-coding RNAs in mammals," Nature, Mar. 12, 2009, 458(7235):223-7 (Author Manuscript).
Helin and Dhanak, "Chromatin proteins and modifications as drug targets," Nature, 2013, 502: 480-488.
Hernandez et al., "Determinants for association and guide RNA-directed endonuclease cleavage by purified RNA editing complexes from Trypanosoma brucei," 2008, Journal of Molecular Biology, 2008, 381: 35-48.
Hoki et al., "A proximal conserved repeat in the Xist gene is essential as a genomic element for X-inactivation in mouse," Development, 2009, 136: 139-146.
Hua et al., "Antisense Masking of an hnRNP A1/A2 Intronic Splicing Silencer Corrects SMN2 Splicing in Transgenic Mice," Am J Hum Genet., Apr. 11, 2008, 82(4):834-48.
Hua et al., "Antisense correction of SMN2 splicing in the CNS rescues necrosis in a type III SMA mouse model," Genes Dev., Aug. 1, 2010, 24(15):1634-44.
Hua et al., "Enhancement of SMN2 Exon 7 Inclusion by Antisense Oligonucleotides Targeting the Exon," PLoS Biol., Apr. 2007, 5(4):e73.
Hua et al., "Peripheral SMN restoration is essential for long-term rescue of a severe spinal muscular atrophy mouse model," Nature, Oct. 5, 2011, 478(7367):123-6 (Author Manuscript).
Huppertz et al., "iCLIP: protein-RNA interactions at nucleotide resolution," Methods, Feb. 2014, 65(3): 274-287.
Ilik et al., "Tandem stem-loops in roX RNAs act together to mediate X chromosome dosage compensation in Drosophila," Molecular Cell, 2013, 51: 156-173.
Imprinted Gene, Mosby's Dictionary of Medicine, Nursing & Health Professions, 8th Edition, p. 949 (2009).
Inesi et al., "Studies of Ca2+ ATPase (SERCA) inhibition," J Bioenerg Biomembr., Dec. 2005, 37(6):365-8.
Inouye, "Antisense RNA: its functions and applications in gene regulation—a review," Gene, Dec. 10, 1988, 72(1-2):25-34.
International Preliminary Report on Patentability in International Application No. PCT/US2011/060493, dated May 14, 2013, 10 pages.
International Preliminary Report on Patentability in International Application No. PCT/US2011/065939, dated Jun. 25, 2013, 11 pages.
International Preliminary Report on Patentability in International Application No. PCT/US2015/058338, dated May 2, 2017.
International Search Report and Written Opinion for Application No. PCT/US2011/060493 dated Apr. 18, 2012, 17 pages.
International Search Report and Written Opinion for Application No. PCT/US2013/041440 dated Jul. 29, 2013, 17 pages.
International Search Report and Written Opinion for Application No. PCT/US2013/041452 dated Jul. 29, 2013, 15 pages.
International Search Report and Written Opinion for Application No. PCT/US2013/041381 dated Jul. 29, 2013, 18 pages.
International Search Report and Written Opinion for Application No. PCT/US2013/041455 dated Aug. 29, 2013, 14 pages.
International Search Report and Written Opinion for Application No. PCT/US2013/041389 dated Jul. 29, 2013, 14 pages.
International Search Report and Written Opinion for Application No. PCT/US2013/041385 dated Aug. 21, 2013, 12 pages.
International Search Report and Written Opinion for Application No. PCT/US2013/041394 dated Aug. 21, 2013, 13 pages.
International Search Report and Written Opinion for Application No. PCT/US2011/065939 dated Apr. 20, 2012, 16 pages.
Iwase et al., "ATRX ADD domain links an atypical histone methylation recognition mechanism to human mental-retardation syndrome," Nature Structural & Molecular Biology, 2011, 18: 769-776.
Jeon and Lee, "YY1 tethers Xist RNA to the inactive X nucleation center," Cell, Jul. 8, 2011, 146(1):119-33.
Jepsen et al., "Locked nucleic acid: a potent nucleic acid analog in therapeutics and biotechnology," Oligonucleotides, 2004, 14, 130-146.
Jia et al., "Genome-wide computational identification and manual annotation of human long noncoding RNA genes," RNA, 2010, 16(8):1478-1487.
Johansson et al., "Target-specific arrest of mRNA translation by antisense 2'-O-alkyloligoribonucleotides," Nucleic Acids Res., Nov. 11, 1994, 22(22):4591-8.
Johnson, et al., (2012). Molecular characterization of EGFR and EGFRvIII signaling networks in human glioblastoma tumor xenografts, Molecular & Cellular Proteomics, 2012, 11: 1724-1740.
Johnson, "Long non-coding RNAs in Huntington's disease neurodegeneration," Neurobiol Dis., 2012, 46:245-54.
Kaneko et al., "Interactions between JARID2 and noncoding RNAs regulate PRC2 recruitment to chromatin," Molecular Cell, 2014, 53: 290-300.
Kanhere et al., "Short RNAs are transcribed from repressed polycomb target genes and interact with polycomb repressive complex-2," Mol Cell., Jun. 11, 2010, 38(5):675-88.
Kanhere et al., "Short RNAs Are Transcribed from Repressed Polycomb Target Genes and Interact with Polycomb Repressive Complex-2," Molecular Cell, 2010, 38: 675-688.
Kapranov et al., "Genome-wide transcription and the implications for genomic organization," Nat Rev Genet., 2007, 8(6):413-423.

(56) References Cited

OTHER PUBLICATIONS

Kapranov et al., "RNA maps reveal new RNA classes and a possible function for pervasive transcription," Science, 2007, 316:1484-1488.
Kent et al., "Evolution's cauldron: duplication, deletion, and rearrangement in the mouse and human genomes," PNAS, Sep. 2003, 100(20) 11484-11489.
Khalil et al., "Many human large intergenic noncoding RNAs associate with chromatin-modifying complexes and affect gene expression," Proc Natl Acad Sci U S A, Jul. 14, 2009, 106(28):11667-72.
Kharchenko et al., "Design and analysis of ChIP-seq experiments for DNA-binding proteins," Nature Biotechnology, 2008, 26: 1351-1359.
Kim et al., "Widespread transcription at neuronal activity-regulated enhancers," Nature, 2010, 465(7295):182-187 (Author Manuscript).
Klein et al., "Homeostatic regulation of MeCP2 expression by a CREB-induced microRNA," Nat Neurosci., Dec. 2007, 10(12):1513-4.
Krutzfeldt et al., "Silencing of microRNAs in vivo with 'antagomirs'," Nature, 2005, 438(7068):685-689.
Ku et al., "Genomewide analysis of PRC1 and PRC2 occupancy identifies two classes of bivalent domains," PLoS Genet., 2008, 4:e1000242, 14 pages.
Law et al., "ATR-X syndrome protein targets tandem repeats and influences allele-specific expression in a size-dependent manner," Cell, 2010, 143: 367-378.
Lee and Bartolomei, X-inactivation, imprinting, and long noncoding RNAs in health and disease, Cell, Mar. 2013, 152: 1308-1323.
Lee and Lu, "Targeted mutagenesis of Tsix leads to nonrandom X inactivation," Cell, 1999, 99:47-57.
Lee et al., "Control of developmental regulators by Polycomb in human embryonic stem cells," Cell, 2006, 125:301-313.
Lee et al., "Genetic analysis of the mouse X inactivation center defines an 80-kb multifunction domain," Proc. Natl. Acad. Sci., Mar. 1999, 96: 3836-3841.
Lee et al., "Tsix, a gene antisense to Xist at the X-inactivation centre," Nature Genetics, 1999, 21: 400-404.
Lee, "Epigenetic regulation by long noncoding RNAs," Science, Dec. 14, 2012, 338(6113):1435-9.
Lee, "Lessons from X-chromosome inactivation: long ncRNA as guides and tethers to the epigenome," Genes Dev., 2009, 23:1831-1842.
Lee, "The X as model for RNA's niche in epigenomic regulation," Cold Spring Harb Perspect Biol., 2010, 2:a003749, 12 pages.
Lewis et al., "Daxx is an H3.3-specific histone chaperone and cooperates with ATRX in replication-independent chromatin assembly at telomeres," PNAS, 2010, 107: 14075-14080.
Li et al., "Jarid2 and PRC2, partners in regulating gene expression," Genes Dev., 2010, 24:368-380.
Lim and Hertel, "Modulation of survival motor neuron pre-mRNA splicing by inhibition of alternative 3' splice site pairing," J Biol Chem., Nov. 30, 2001, 276(48):45476-83.
Lima et al., "Single-stranded siRNAs activate RNAi in animals," Cell, Aug. 31, 2012, 150(5):883-94.
Lin et al., "An in-depth map of polyadenylation sites in cancer," Nucleic Acids Res., Sep. 1, 2012, 40(17):8460-71.
Lin et al., "Asymmetric regulation of imprinting on the maternal and paternal chromosomes at the Dlk1-Gtl2 imprinted cluster on mouse chromosome 12," Nat Genet., 2003, 35:97-102.
Lipovich et al., "MacroRNA underdogs in a microRNA world: Evolutionary, regulatory, and biomedical significance of mammalian long non-protein-coding RNA" Biochimica et Biophysica Acta, Sep. 2010, 1799(9):597-615.
Maenner et al., "2-D structure of the A region of Xist RNA and its implication for PRC2 association," PLoS Biology, 2010, 8: e1000276.
Maenner et al., "ATP-dependent roX RNA remodeling by the helicase maleless enables specific association of MSL proteins," Molecular Cell, 2013, 51: 174-184.

Margueron and Reinberg, "The Polycomb complex PRC2 and its mark in life," Nature, Jan. 20, 2011, 469(7330):343-9 (Author Manuscript).
Mariner et al., "Human Alu RNA Is a Modular Transacting Repressor of mRNA Transcription during Heat Shock," Feb. 2008, 29: 499-509.
Mercer et al., "Long non-coding RNAs: insights into functions," Nat Rev Genet., Mar. 2009, 10(3):155-9.
Mercer et al., "Structure and function of long noncoding RNAs in epigenetic regulation," Mar. 5, 2013, 20:300-7.
Merienne and Trottier, "SCA8 CAG/CTG expansions, a tale of two TOXICities: a unique or common case?" PLoS Genet., Aug. 2009, 5(8):e1000593.
Mikkelsen et al., "Genome-wide maps of chromatin state in pluripotent and lineage-committed cells," Nature, 2007, 448:553-560 (Author Manuscript).
Miremadi et al., "Cancer genetics of epigenetic genes," Hum Mol Genet., 2007, 16(Spec No. 1):R28-49.
Mitson et al., "Functional significance of mutations in the Snf2 domain of ATRX," Human Molecular Genetics, 2011, 20: 2603-2610.
Miura and Jasmin, "Utrophin upregulation for treating Duchenne or Becker muscular dystrophy: how close are we?" Trends Mol Med., Mar. 2006, 12(3):122-9.
Miyajima et al., "Identification of a cis-acting element for the regulation of SMN exon 7 splicing," J Biol Chem., Jun. 28, 2002, 277(26):23271-7.
Miyaso et al., "An intronic splicing enhancer element in survival motor neuron (SMN) pre-mRNA," J Biol Chem., May 2, 2003, 278(18):15825-31.
Modarresi et al., "Inhibition of natural antisense transcripts in vivo results in gene-specific transcriptional upregulation," Nat Biotechnol, 30(5):453-9 (Mar. 25, 2012) doi: 10.1038/nbt.2158. 21 pages.
Montgomery et al., "The murine polycomb group protein Eed is required for global histone H3 lysine-27 methylation," Curr Biol., 2005, 15:942-947.
Morris et al., "Small interfering RNA-induced transcriptional gene silencing in human cells," Science, Aug. 27, 2004, 305(5688):1289-92.
Morris, "RNA-mediated transcriptional gene silencing in human cells," Curr Top Microbiol Immunol., 2008, 320:211-224.
Mortazavi et al. "Mapping and quantifying mammalian transcriptomes by RNA-Seq," Nat Methods, 2008, 5:621-628.
Muller and Verrijzer, "Biochemical mechanisms of gene regulation by polycomb group protein complexes," Current Opinion in Genetics & Development, 2009, 19: 150-158.
Munroe et al., "Antisense RNA inhibits splicing of pre-mRNA in vitro," EMBO J., Aug. 1988, 7(8):2523-2532.
Nagano et al., "The Air noncoding RNA epigenetically silences transcription by targeting G9a to chromatin," Science, Dec. 12, 2008, 322(5908):1717-20.
Nie et al., "Long non-coding RNAs: versatile master regulators of gene expression and crucial players in cancer," Am J Transl Res., 2012, 4(2):127-50.
Numata et al., "Comparative analysis of cis-encoded antisense RNAs in eukaryotes," Gene, 2007, 392(1-2):134-141.
Numata et al., "Identification of novel endogenous antisense transcripts by DNA microarray analysis targeting complementary strand of annotated genes," BMC Genomics, 2009, 10:392, 12 pages.
Nusinow et al., "Poly(ADP-ribose) polymerase 1 is inhibited by a histone H2A variant, MacroH2A, and contributes to silencing of the inactive X chromosome," The Journal of Biological Chemistry, 2007, 282: 12851-12859.
Office Action in Canadian Application No. 2761633, dated Sep. 26, 2017, 3 pages.
Office Action in EP 11852141.8, dated Mar. 28, 2017, 7 pages.
Office Action in Israeli Application No. 252267, dated Oct. 3, 2017.
Office Action in Japanese Application No. 2013-538959, dated Oct. 6, 2017.
Office Action in Japanese Application No. 2013-538959, dated Oct. 19, 2016, 15 pages (with English translation).
Office Action in U.S. Appl. No. 13/921,738, dated Apr. 12, 2017, 37 pages.

(56) References Cited

OTHER PUBLICATIONS

Office Action in U.S. Appl. No. 15/050,273, dated Aug. 16, 2017.
Office Action in U.S. Appl. No. 15/050,273, dated Feb. 8, 2017, 40 pages.
Office Action in U.S. Appl. No. 15/171,860, dated Apr. 12, 2017, 38 pages.
Office Action in U.S. Appl. No. 15/171,883, dated May 23, 2017.
Office Action in U.S. Appl. No. 15/265,104, dated Apr. 26, 2017.
Office Action issued in AU2011325956 dated May 27, 2016 (4 pages).
Office Action issued in AU2011325956 dated Sep. 23, 2014 (3 pages).
Office Action issued in AU2011349464 dated Sep. 23, 2014 (3 pages).
Office Action issued in EP 11852141.8 dated Apr. 18, 2016, 17 pages.
Office Action issued in EP11840099.3 dated Oct. 5, 2015 (7 pages).
Office Action issued in IL226302 dated Jun. 14, 2016, 14 pages.
Office Action issued in JP 2013538959 dated Nov. 5, 2015, 7 pages.
Office Action issued in U.S. Appl. No. 15/171,706 dated Dec. 9, 2016, 38 pages.
Ogawa et al., "Intersection of the RNA interference and X-inactivation pathways," Science, Jun. 2008, 320: 1336-1341.
Okada et al., "Comparative expression analysis uncovers novel features of endogenous antisense transcription," Hum Mol Genet., 2008, 17(11):1631-40.
Orom et al., "LNA-modified oligonucleotides mediate specific inhibition of microRNA function," Gene, 2006, 372:137-141.
Ozsolak et al., "Comprehensive polyadenylation site maps in yeast and human reveal pervasive alternative polyadenylation," Cell, Dec. 10, 2010, 143(6):1018-29.
Pandey et al., "Kcnq1ot1 antisense noncoding RNA mediates lineage-specific transcriptional silencing through chromatin level regulation," Mol Cell, Oct. 24, 2008, 32(2):232-46.
Paro and Lee, "Extending the frontiers of epigenetic regulation," Curr Opin Genet Dev., Apr. 2010, 20(2):107-9.
Pasini et al., "Suz12 is essential for mouse development and for EZH2 histone methyltransferase activity," EMBO J., 2004, 23:4061-4071.
Pasmant et al., "Characterization of a germ-line deletion, including the entire INK4/ARF locus, in a melanoma-neural system tumor family: identification of ANRIL, an antisense noncoding RNA whose expression coclusters with ARF," Cancer Res, Apr. 2007, 67: 3963-3969.
Pedersen et al., "Identification and classification of conserved RNA secondary structures in the human genome," PLoS Comput Biol., Apr. 2006, 2(4):e33.
Peng et al., "Jarid2/Jumonji Coordinates Control of PRC2 Enzymatic Activity and Target Gene Occupancy in Pluripotent Cells," Cell, 2009, 139:1290-1302.
Penny et al., "Requirement for Xist in X chromosome inactivation," Nature, 1996, 379(6561):131-137.
Pereira et al., "Ezh2, the histone methyltransferase of PRC2, regulates the balance between self-renewal and differentiation in the cerebral cortex," Proc Natl Acad Sci U S A., Sep. 7, 2010, 107(36):15957-62.
Petersen and Wengel, "LNA: a versatile tool for therapeutics and genomics," Trends Biotechnol., 2003, 21(2):74-81.
Pietersen and van Lohuizen, "Stem cell regulation by polycomb repressors: postponing commitment," Curr Opin Cell Biol., 2008, 20:201-207.
Pinter et al., "Spreading of X chromosome inactivation via a hierarchy of defined Polycomb stations," Genome Research, 2012, 22: 1864-1876.
Ponting et al., "Evolution and functions of long noncoding RNAs," Cell, 2009, 136(4):629-641.
Prasnath et al., "Regulating Gene Expression through RNA Nuclear Retention," Cell, Oct. 2005, 123: 249-263.
Qi et al., "Repurposing CRISPR as an RNA-guided platform for sequence-specific control of gene expression," Cell, Feb. 28, 2013, 152(5):1173-83.
Rajasekhar and Begemann, "Concise review: roles of polycomb group proteins in development and disease: a stem cell perspective," Stem Cells, 2007, 25:2498-2510.
Ratnakumar and Bernstein, "ATRX: the case of a peculiar chromatin remodeler," Epigenetics, 2013, 8: 3-9.
Rigo et al., "Antisense-based therapy for the treatment of spinal muscular atrophy," J Cell Biol., Oct. 1, 2012, 199(1):21-5.
Ringrose and Paro, "Epigenetic regulation of cellular memory by the Polycomb and Trithorax group proteins," Annu Rev Genet., 2004, 38:413-443.
Rinn and Chang, "Genome Regulation by Long Noncoding RNAs," Annu Rev Biochem., 2012, 81:145-66 (Author Manuscript).
Rinn et al., "Functional demarcation of active and silent chromatin domains in human HOX loci by noncoding RNAs," Cell, 2007, 129:1311-1323.
Røsok and Sioud, "Systematic identification of sense-antisense transcripts in mammalian cells," Nat Biotechnol., 2004, 22(1):104-8.
Sarma et al., "ATRX directs binding of PRC2 to Xist RNA and Polycomb targets," Cell 6 159(4): 869-883 (2014).
Sarma et al., "Locked nucleic acids (LNAs) reveal sequence requirements and kinetics of Xist RNA localization to the X chromosome," Proc Natl Acad Sci U S A, Dec. 21, 2010, 107(51):22196-22201.
Saxena et al., "Long non-coding RNA modifies chromatin," Bioessays, 2011, 33:830-9.
Schoeftner et al., "Recruitment of PRC1 function at the initiation of X inactivation independent of PRC2 and silencing," Embo J., 2006, 25:3110-3122.
Schuettengruber et al., "Genome regulation by polycomb and trithorax proteins," Cell, 2007, 128:735-745.
Schultz et al., "Enhancers compete with a long non-coding RNA for regulation of the Kcnq1 domain," Nucleic Acids Research, 2015, vol. 43, No. 2 745-759 (2014).
Schwartz and Pirrotta, "Polycomb complexes and epigenetic states," Curr Opin Cell Biol., 2008, 20:266-273.
Schwartz et al., "Genome-wide analysis of Polycomb targets in *Drosophila melanogaster*," Nat Genet., 2006, 38:700-705.
Sciabola et al., "Improved nucleic acid descriptors for siRNA efficacy prediction," Nucleic Acids Research, 2012, 1-12.
Seila et al., "Divergent transcription from active promoters," Science, Dec. 19, 2008, 322(5909):1849-51 (Author Manuscript).
Seong et al., "Huntingtin facilitates polycomb repressive complex 2," Hum Mol Genet., Feb. 14, 2010, 19(4):573-83.
Shamovsky et al., "RNA-mediated response to heat shock in mammalian cells," Mar. 2006, 440: 556-60.
Shaver et al., "Origin of the polycomb repressive complex 2 and gene silencing by an E(z) homolog in the unicellular alga *Chlamydomonas*," Epigenetics, May 16, 2010, 5(4):301-12.
Shen et al., "EZH1 mediates methylation on histone H3 lysine 27 and complements EZH2 in maintaining stem cell identity and executing pluripotency," Mol Cell, 2008, 32:491-502.
Shen et al., "Jumonji Modulates Polycomb Activity and Self-Renewal versus Differentiation of Stem Cells," Cell, 2009, 139:1303-1314.
Shore et al., "Pregnancy-induced noncoding RNA (PINC) associates with polycomb repressive complex 2 and regulates mammary epithelial differentiation," PLoS Genet., 2012, 8(7):e1002840.
Simon and Kingston, "Occupying chromatin: Polycomb mechanisms for getting to genomic targets, stopping transcriptional traffic, and staying put," Molecular Cell, Mar. 2013, 49: 808-824.
Simon and Lange, "Roles of the EZH2 histone methyltransferase in cancer epigenetics," Mutat Res., 2008, 647:21-29.
Simon et al., "High-resolution Xist binding maps reveal two-step spreading during X-chromosome inactivation" Nature, 504(7480):465-9 (Dec. 19, 2013) doi: 10.1038/nature12719. Epub Oct. 27, 2013.
Sing et al., "A vertebrate Polycomb response element governs segmentation of the posterior hindbrain," Cell, 2009, 138:885-897.
Singh et al., "Splicing of a Critical Exon of Human Survival Motor Neuron Is Regulated by a Unique Silencer Element Located in the Last Intron," Mol Cell Biol., Feb. 2006, 26(4):1333-46.

(56) References Cited

OTHER PUBLICATIONS

Singh et al., "The regulation and regulatory activities of alternative splicing of the SMN gene," Crit Rev Eukaryot Gene Expr., 2004, 14(4):271-85.
Slides for Discussion During Examiner Interview, U.S. Appl. No. 13/884,670, dated Nov. 4, 2014.
Sparmann and van Lohuizen, "Polycomb silencers control cell fate, development and cancer," Nat Rev Cancer, 2006, 6:846-856.
Stanley T. Crooke, Antisense Drug Technology, Second Edition, 2007, 120-123.
Starmer and Magnuson, "A new model for random X chromosome inactivation," Development, Jan. 2009, 136: 1-10.
Sunwoo et al., "Distal-less homeobox transcription factors regulate development and maturation of natural killer cells," PNAS, Aug. 2008, 105: 10877-82.
Taft et al., "Non-coding RNAs: regulators of disease," The Journal of Pathology, 220(2):126-139 (2009).
Taft et al., "Tiny RNAs associated with transcription start sites in animals," Nat Genet., 2009, 41:572-578.
Takagi et al., "Role of Sp1 in transcription of human ATP2A2 gene in keratinocytes," J Invest Dermatol., Jan. 2008, 128(1):96-103.
Takahashi et al., "Deletion of Gtl2, imprinted non-coding RNA, with its differentially methylated region induces lethal parent-origin-dependent defects in mice," Hum Mol Genet., 2009, 18:1879-1888.
Tang et al., "A novel transcription regulatory complex containing death domain-associated protein and the ATR-X syndrome protein," The Journal of Biological Chemistry, 2004, 279: 20369-20377.
Tano et al., "MALAT-1 enhances cell motility of lung adenocarcinoma cells by influencing the expression of motility-related genes," FEBS Letters, 584(22):4575-4580 (2010).
Thorvaldsen and Bartolomei, "SnapShot: imprinted gene clusters," Cell, 2007, 130:958.
Tian et al., "The long noncoding RNA, Jpx, is a molecular switch for X chromosome inactivation," Cell, 143(3):390-403 (Oct. 29, 2010) doi: 10.1016/j.cell.2010.09.049. 21 pages.
Torarinsson et al., "Thousands of corresponding human and mouse genomic regions unalignable in primary sequence contain common RNA structure," Genome Res., 2006, 16:885-889.
Tsai et al., "Higher order chromatin structure at the X-inactivation center via looping DNA," Dev Biol, 319(2):416-25 (Jul. 15, 2008) doi: 10.1016/j.ydbio.2008.04.010. Epub Apr. 18, 2008. 22 pages.
Tsai et al., "Long noncoding RNA as modular scaffold of histone modification complexes," Science, Aug. 6, 2010, 329(5992):689-93(Author Manuscript).
Ule et al., "CLIP: a method for identifying protein-RNA interaction sites in living cells," Methods, 2005, 37:376-386.
Vickers et al., "Fully modified 2' MOE oligonucleotides redirect polyadenylation," Nucleic Acids Res., Mar. 15, 2001, 29(6):1293-9.
Wahlestedt, "Natural antisense and noncoding RNA transcripts as potential drug targets," Drug Discov Today, Jun. 2006, 11(11-12):503-8.
Wahlestedt, "Targeting long non-coding RNA to therapeutically upregulate gene expression," Nature Rev Drug Disc., Jun. 2013, 12:433-46.
Wan and Bartolomei, "Regulation of imprinting in clusters: noncoding RNAs versus insulators," Adv Genet., 2008, 61:207-223.
Wang and Change, "Molecular mechanisms of long noncoding RNAs," Cell Press, Sep. 16, 2011, 43(6):904-14.
Wang et al., "Long non-coding RNA UCA1a(CUDR) promotes proliferation and tumorigenesis of bladder cancer," Int J Oncol., Jul. 2012, 41(1):276-84.
Washietl et al., "Fast and reliable prediction of noncoding RNAs," Proc. Natl. Acad. Sci., 2005, 102:2454-2459.
Wilker et al., "14-3-3sigma controls mitotic translation to facilitate cytokinesis," Nature, 2007, 446, 329-332.
Williams et al., "Oligonucleotide-mediated survival of motor neuron protein expression in CNS improves phenotype in a mouse model of spinal muscular atrophy," J Neurosci., Jun. 17, 2009, 29(24):7633-8.

Williamson et al., "Identification of an imprinting control region affecting the expression of all transcripts in 10 the Gnas cluster," Nat Genet., 2006, 38:350-355.
Wilusz et al., "A triple helix stabilizes the 3' ends of long noncoding RNAs that lack poly(A) tails," Genes Dev., Nov. 1, 2012, 26(21):2392-407.
Woo et al., "Gene activation of SMN by selective disruption of lncRNA-mediated recruitment of PRC2 for the treatment of spinal muscular atrophy," PNAS, Feb. 2017, E1509-E1518.
Woo et al., "A region of the human HOXD cluster that confers Polycomb-group responsiveness," Cell, 2010, 140:99-110.
Wutz et al., "Chromosomal silencing and localization are mediated by different domains of Xist RNA," Nat Genet., 2002, 30(2):167-174.
Wutz, "Gene silencing in X-chromosome inactivation: advances in understanding facultative heterochromatin formation," Nat Rev Genet, 2011, 12: 542-553.
Xue et al., "The ATRX syndrome protein forms a chromatin-remodeling complex with Daxx and localizes in promyelocytic leukemia nuclear bodies," PNAS, 2003, 100: 10635-10640.
Yakali et al, Supramolecular chirality-sensing DNA-mimicry of a norbornane derivative decorated with isoxazoline and methylpyrolidine-2,5-dione ring, 2013, Journal of Molecular Structure, 1041: 164-174.
Yang et al., "Global survey of escape from X inactivation by RNA-sequencing in mouse," Genome Research, 2010, 20: 614-622.
Yang et al., "Long noncoding RNAs: fresh perspectives into the RNA world," Trends Biochem Sci.,39(1):35-43 (Jan. 2014) doi: 10.1016/j.tibs.2013.10.002. Epub Nov. 27, 2013. Review.
Yap et al., "Molecular interplay of the noncoding RNA ANRIL and methylated histone H3 lysine 27 by polycomb CBX7 in transcriptional silencing of INK4a," Mol Cell, 2010, 38:662-674.
Yu et al., "Single-stranded RNAs use RNAi to potently and allele-selectively inhibit mutant huntingtin expression," Cell, Aug. 31, 2012, 150(5):895-908 (Author Manuscript).
Zhang et al., "NATsDB: Natural Antisense Transcripts DataBase," Nucl. Acids Res., 2006, 35(suppl 1): D156-D161.
Zhao et al., "Genome-wide identification of polycomb-associated RNAs by RIP-seq," Mol Cell., Dec. 22, 2010, 40(6):939-53.
Zhao et al., "Polycomb proteins targeted by a short repeat RNA to the mouse X-chromosome," Science, 2008, 322(5902):750-756 (Author Manuscript).
U.S. Appl. No. 61/365,775, filed Jul. 19, 2010, Bennett.
Aartsma-Rus et al., "Comparative analysis of antisense oligonucleotide analogs for targeted DMD exon 46 skipping in muscle cells," gene Therapy, 2004, 11: 1391-1398.
Agrelo and Wutz, "ConteXt of change-X inactivation and disease," EMBO Molecular Medicine, 2009, 2: 6-15.
Bhatnagar et al., Genetic and pharmacological reactivation of the mammalian inactive X chromosome, PNAS, Aug. 2014, 111: 12591-12598.
Braasch and Corey, "Locked nucleic acid (LNA): fine-tuning the recognition of DNA and RNA," Chemistry & Biology, 2001, 8: 1-7.
Cerritelli and Crouch, "Ribonuclease H: the enzymes in eukaryotes," 2009, FEBS J., 276(6): 1494-1505.
Chu et al., "Systematic Discovery of Xist RNA Binding Proteins," Cell, Apr. 2015, 161: 404-416.
Crooke et al., "Kinetic characteristics of *Escherichia coli* RNase Hi: cleavage of various antisense oligonucleotideRNA duplexes," Biochem J, 1995, 312:599-608.
European Search Report in Application No. 15854720.8, dated Jul. 5, 2018, 15 pages.
Hoffman et al., "Restoring Dystrophin Expression in Duchenne Muscular Dystrophy Muscle," The American Journal of Pathology, Jul. 2011, 179: 12-22.
Hung and Chung, "Long coding RNA in genome regulation," RNA Biology, Oct. 2010, 7: 582-585.
Knauert et al., "Triplex forming oligonucleotides: sequence-specific tools for gene targeting," Human Molecular Genetics, Oct. 2001, 10: 2243-2251.
Kung et al., "Locus-Specific Targeting to the X Chromosome Revealed by the RNA Interactome of CTCF," Molecular Cell, Jan. 2015, 57: 361-375.

(56) References Cited

OTHER PUBLICATIONS

Kung et al., "Supplemental Information: Locus-Specific Targeting to the X Chromosome Revealed by the RNA Interactome of CTCF," Molecular Cell, Jan. 2015, 32 pages.
Lebedeva and Stein, "Phosphothioate oligodeoxynucleotides as inhibitors of gene expression: antisense and non-antisense effects," Applications of Antisense Therapies to Restenosis, 1999, p. 101.
McHugh et al., "The Xi st lncRNA interacts directly with SHARP to silence transcription through HDAC3," Nature, Apr. 2015, 521: 232-236.
Mitev et al., "Inhibition of Intracellular Growth of *Salmonella enterica* Serovar Typhimurium in Tissue Culture by Antisense Peptide-Phosphorodiamidate Morpholino Oligomer," Antimicrobial Agents and Chemotherapy, 2009 53(9):3700-3704.
Notice of European Opposition to the European patent in European Application No. 11840099.3, dated Feb. 28, 2018, 5 pages.
Office Action in Canadian Application No. 2,817,256, dated Sep. 26, 2018, 5 pages.
Office Action in European Application No. 17000579.7, dated Sep. 27, 2018, 5 pages.
Office Action in U.S. Appl. No. 15/050,273, dated May 11, 2018, 10 pages.
Office Action in U.S. Appl. No. 15/171,706, dated May 4, 2017, 13 pages.
Office Action in U.S. Appl. No. 15/171,883, dated Apr. 12, 2018, 9 pages.
Office Action in U.S. Appl. No. 15/265,104, dated Apr. 3, 2018, 19 pages.
Office Action in U.S. Appl. No. 15/265,104, dated Nov. 28, 2016, 33 pages.
Opposition to EP-B-2638163 by Roche Innovation Center Copenhagen A/S, Feb. 13, 2018, 55 pages.
Pantal Supplementary Search Report in Application No. 16765719.6, dated Oct. 25, 2018, 14 pages.
Partial European Search Report in Application No. 15854720.8, dated Mar. 28, 2018, 18 pages.
Popescu, "Antisense- and RNA interference-based therapeutic strategies in allergy," J. Cell. Mol. Med, 2005, 9(4):840-853.
Summerton, "Morpholino antisense oligomers: the case for an RNase H-independent structural type," Biochimica et Biophysica Acta, 1999, 1489: 141-158.
Summerton, "Morpholino, siRNA, and S-DNA Compared: Impact of Structure and Mechanism of Action on Off-Target Effects and Sequence Specificity," Current Topics in Medicinal Chemistry, 2007, 7:651-660.
Swayze and Bhat, Antisense Drug Technology, Chapter 6: The medicinal chemistry of oligonucleotides, Second Edition, 2008, 143-182.
Talebizadeh, "Brief Report: Non-Random X Chromosome Inactivation in Females with Autism," Journal of Autism and Developmental Disorders, Oct. 2005, 35: 675-681.
Torres et al.,"Potent and sustained cellular inhibition of miR-122 by lysine-derivatized peptide nucleic acids (PNA) and phosphorothioate locked nucleic acid (LNA)/2'-0-methyl (OMe) mixmer antimiRs in the absence of transfection agents," Artificial DNA: PNA & XNA, Sep. 2011, 2: 71-78.
Tu et al., "The PRC2-binding long non-coding RNAs in human and mouse genomes are associated with predictive sequence features," Sci Rep, 2017, 7:41669.
Wan et al., "Long non-coding RNA ANRIL (CDKN2B-AS) is induced by the ATM-E2F1 signaling pathway," Cellular Signalling, May 2013, 25: 1086-1095.
Wang et al , "Cyclohexene Nucleic Acids (CeNA): Serum Stable Oligonucleotides that Activate RNase H and Increase Duplex Stability with Complementary RNA," J. Am. Chem. Soc., 2000, 122: 8595-8602.
Wolff et al., "Molecular determination of X inactivation pattern correlates with phenotype in women with a structurally abnormal X chromosome," Genetics in Medicine, Mar./Apr. 2000, 2: 136-141.
Written Submission in European Application No. 11840099.3, dated Jul. 11, 2016, 11 pages.
www.biosyn.com' [online] "What are Oligomimetics or oligonucleotide mimetics?," Jun. 20, 2016 [retrieved on Oct. 3, 2018]. Retrieved from the Internet: URL <https://www.biosyn.com/faq/what-are-oligomimetics-or-oligo-nucleotide-mimetics.aspx>. 1 page.
www.exiqon.com [online]. "Antisense LNA TM GapmeRs," dated Apr. 11, 2013 [Retrieved on Feb. 1, 2018]. Retrieved from the Internet: www.exiqon.com/gapmers. 1 page.
www.exiqon.com [online]. "LNA™ Oligo Tools and Design Guidelines," dated Aug. 2011 [retrieved on Feb. 1, 2018], retrieved from the Internet: <http://www.exiqon.com :80/oligo-tools>. 1 page.
www.exiqon.com [online]. "Order Custom LNATM Oligonucleotides," dated Nov. 2011 [retrieved on Feb. 1, 2018], retrieved from the Internet: http://www.exiqon.com :80/order-lna-oligos. 1 page.
International Search Report and Written Opinion dated Sep. 2, 2016 in international application No. PCT/US2016/022778, 25 pgs.
Liyanage, VRB et al., "DNA Modifications: Function and Applications in Normal and Disease States," Biology 3: 670-723 (2014).
Jacob, CO et al., "Identification of IRAK1 as a risk gene with critical role in the pathogenesis of systemic lupus erythematosus," Proceedings of the National Academy of Sciences. 106 (15): 6256-6261 (2009).
Office Action in Canadian Application No. 2,822,462, dated Nov. 9, 2018, 13 pages.
Office Action in European Application No. 15854720.8, dated Mar. 22, 2019, 5 pages.
Office Action in Japanese Application No. 2018-024522, dated Apr. 11, 2019, 6 pages (with English translation).
Obad et al, "Silencing of microRNA families by seed targeting tiny LNAs," Nature Genetics, 43(4):371-380.
Summons to Attend Oral Proceedings in European Appln. 170005797.7, dated Jul. 5, 2019, 6 pages.
Turner and Bracken, "A "Complex" Issue: Deciphering the Role of Variant PRC1 in ESCs," Cell Stem Cell, Feb. 2013, 12(2): 145-146.
Wutz and Jaenisch, A Shift Reversible to Irreversible X Inactivation is Triggered duering ES Cell Differentiation, Molecular Cell, Apr. 2000, 5: 695-705.
Agrelo et al., "SATB1 defines the developmental context for gene silencing by Xist in lymphoma and embryonic cells," Apr. 2009, 16(4):507-516.
Alahari et al., "Inhibition of expression of the multidrug resistance-associated P-glycoprotein of by phosphorothioate and 5' cholesterol-conjugated phosphorothioate antisense oligonucleotides," Mol. Pharmacol., Oct. 1996, 50(4):808-819.
Arun et al., "Differentiation of mammary tumors and reduction in metastasis upon Malat1 lncRNA loss," Genes & Development, Jan. 2016, 30(1):34-51.
Dravidovich & Cech., "The recruitment of chromatin modifiers by long noncoding RNAs: lessons from PRC2," RNA, Dec. 2015, 21(12):2007-2022.
EP Decision of Technical Board of Appeal 3.3.2, dated Sep. 30, 1996, in Case No. T 958/94, 10 pages.
EP Decision Revoking the European Patent in European Appln. 11840099.3, dated Nov. 11, 2019, 51 pages.
EP Office Action in European Appln. 16765719, dated Apr. 7, 2020, 4 pages.
Faghihi & Wahlestedt., "Regulatory roles of natural antisense transcripts," Nat. Rev. Mol. Cell. Biol., Sep. 2009, 10(9):637-643.
Freier and Watt., Basic Principles of Antisense Drug Discovery, Chapter 5, pp. 120-122 of Antisense Drug Technology: Principles, Strategies, and Applications, Second Edition, Jul. 25, 2007 by CRC Press.
Gutschner et al., "The noncoding RNA MALAT1 is a critical regulator of the metastasis phenotype of lung cancer cells," Cancer Research, Feb. 2013, 73(3):1180-1189.
Ishida and Gudrun., "The role of imprinted genes in humans," Molecular Aspects of Medicine, Jul. 2013, 34(4):826-840.
Matveeva et al., "Thermodynamic criteria for high hit rate antisense oligonucleotide design," Nucleic Acids Res., Sep. 2003, 31(17):4989-4994.
Migeon, Barbara R., Females Are Mosaics, New York: Oxford University Press, 2007. Print. Glossary: pp. 233 & 236.

(56) References Cited

OTHER PUBLICATIONS

Miraglia et al., "Inhibition of interleukin-1 type I receptor expression in human cell-lines by an antisense phosphorothioate oligodeoxynucleotide," International journal of immunopharmacology, Apr. 1996, 18(4):227-240.

Nagano & Fraser., "Emerging similarities in epigenetic gene silencing by long noncoding RNAs," Mamm Genome, Sep.-Oct. 2009, (9-10):557-562.

Osato et al., "Transcriptional interferences in cis natural antisense transcripts of humans and mice," Genetics, Jun. 2007, 176(2):1299-1306.

Sirchia et al., "Misbehaviour of XIST RNA in breast cancer cells," PloS one, May 2009, 4(5):e5559, 13 pages.

Tano et al., "Identification of minimal p53 promoter region regulated by MALAT1 in human lung adenocarcinoma cells," Frontiers in Genetics, Mar. 2018, 8:208, 10 pages.

Weksberg et al., "Beckwith-Wiedemann syndrome," American Journal of Medical Genetics Part C (Semin. Med.Genet.), 137C(1):12-23.

\* cited by examiner

RNA INTERACTOME OF POLYCOMB REPRESSIVE COMPLEX 1 (PRC1)

CLAIM OF PRIORITY

This application is a U.S. National Phase Application under 35 U.S.C. § 371 of International Patent Application No. PCT/US2016/022778, filed on Mar. 17, 2016, which claims the benefit of U.S. Provisional Patent Application Ser. No. 62/134,361, filed on Mar. 17, 2015. The entire contents of the foregoing are hereby incorporated by reference.

FEDERALLY SPONSORED RESEARCH OR DEVELOPMENT

This invention was made with Government support under Grant No. RO1-DA36895 awarded by the National Institutes of Health. The Government has certain rights in the invention.

TECHNICAL FIELD

This invention relates to the RNA interactome of Polycomb Repressive Complex 1 (PRC1) and methods of using inhibitory nucleic acids that bind RNAs and inhibit the PRC1-RNA interaction to modulate gene expression.

BACKGROUND

Transcriptome analyses have suggested that, although only 1-2% of the mammalian genome is protein-coding, 70-90% is transcriptionally active (Carninci et al., 2005; Kapranov et al., 2007; Mercer et al., 2009). Ranging from 100 nt to >100 kb, these transcripts are largely unknown in function, may originate within or between genes, and may be conserved and developmentally regulated (Kapranov et al., 2007; Guttman et al., 2009). Recent discoveries argue that a subset of these transcripts play crucial roles in epigenetic regulation.

RNA-mediated recruitment is especially attractive for Polycomb proteins. First identified in *Drosophila* as homeotic regulators, Polycomb proteins are conserved from flies to mammals and control many aspects of development (Ringrose and Paro, 2004; Boyer et al., 2006; Lee et al., 2006; Schuettengruber et al., 2007; Pietersen and van Lohuizen, 2008; Schwartz and Pirrotta, 2008).

Polycomb Repressive Complex 1 (PRC1) is the enzymatic complex that ubiquitylates histone H2A at lysine 119 (H2AK119Ub). In mammals, it is composed of multiple variable subunits, including (1) the catalytic subunit, Ring1b or Ring1a, (2) Bmi1 (which can be PCGF1, PCGF2, PCGF3, PCGF5, or PCGF6); (3) PH1 (or PH2, PH3); and (4) CBX2, 4, 6, 7, or 8. Action of PRC1 on chromatin results in chromatin compaction and transcriptional repression. The classical PRC1 complex exists in two forms in which either CBX and MPH or RYBP subunits associate with the catalytic core subunits RING1A/B and PCGF2/4. The PRC1 interacting protein, SCMLH1/2/3, is only weakly associated/substoichiometric and is considered an accessory factor, rather than a core component. The RanBP-ZF domain present in RYBP/YAF2 has an RNA binding function in some related proteins but apparently not in RYBP/YAF2. See, e.g., Brockdorff, RNA 19:429-442 (2013); Yap et al., Mol Cell. 38(5):662-74 (2010).

Although PRC1 binds thousands of sites in the mammalian genome, how PRC1 is targeted to chromatin has remained a mystery. YY1 and the H3K27me3 chromatin mark may recruit PRC1 in some contexts, but they are unlikely to be the general or only mechanisms. RNA-mediated targeting is another potential mechanism. PRC1 is known to interact with at least one RNA, ANRIL, likely via the chromodomain (CD) of the CBX7 protein (Yap et al., Mol Cell. 38(5):662-74 (2010)). ANRIL is an antisense non-coding RNA (ncRNA) at the INK4b/ARF/INK4a locus (Pasmant et al., Cancer Res 67: 3963-3969 (2007)). How many RNAs interact with PRC1 and whether they are a general recruiting tool for PRC1 has not previously been determined.

SUMMARY

A new 'denaturing' CLIP-seq method was developed using the biotin-avidin method, which enables washes in high salt and urea (i.e., protein denaturing conditions). Because the exemplified system includes two protein tags, FLAG and biotin, purification can be performed with either tag or conducted as a tandem affinity purification (e.g., FLAG purification first, followed by biotin pulldown). For the denaturing method, the biotin tag is preferably used. During CLIP, because the interacting RNAs are UV-cross-linked to RNA-binding proteins in a covalent fashion, the RNA-protein interactions survive the wash conditions, whereas nonspecific, low-affinity interactions are not preserved. These methods were used to identify genome-wide pools of polycomb repressive complex 1 (PRC1)-interacting RNAs (referred to herein as the "PRC1 transcriptome" or "PRC1 RNA interactome") in several cell types, including embryonic stem cells and human fibroblast cells.

The results of the studies described herein demonstrated that PRC1 binds both noncoding RNA and coding RNA. The transcriptome includes antisense, intergenic, and promoter-associated transcripts, as well as many unannotated RNAs. A large number of transcripts occur within imprinted regions, oncogene and tumor suppressor loci, and stem-cell-related bivalent domains. Further evidence is provided that inhibitory oligonucleotides that specifically bind to these PRC1-interacting RNAs can successfully modulate gene expression in a variety of separate and independent examples, presumably by inhibiting PRC1-associated effects. PRC1 binding sites can be classified into several groups, including (i) 3' untranslated region [3' UTR], (ii) promoter-associated, (iii) gene body, (iv) antisense, and (v) intergenic. Inhibiting the PRC1-RNA interactions can lead to either activation or repression, depending on context.

Also provided herein are methods for isolating RNA sequences that interact with a selected protein, e.g., with chromatin complexes, in a cell; the methods include providing a cell expressing (i) a biotin ligase, e.g., BirA, and (ii) the protein of interest comprising a biotinylation sequence; exposing the cells to UV-crosslinking; lysing the cells, isolating protein-RNA complexes from the lysed cells, e.g., using avidin purification, e.g., streptavidin beads; washing the complxes in protein-denaturing conditions, e.g., high salt and detergent, e.g., using 8 M urea+0.1% SDS; and isolating the protein-RNA complexes.

In one aspect, described herein are methods for isolating RNA sequences that interact with a selected protein, e.g., with chromatin complexes. The methods include providing a cell expressing (i) a biotin ligase, e.g., BirA, and (ii) the protein of interest comprising a biotinylation sequence; exposing the cells to UV-crosslinking to crosslink the proteins to RNA, to create protein-RNA complexes; lysing the cells to obtain a sample comprising the protein-RNA complexes; isolating protein-RNA complexes from the lysed cells, e.g., using avidin purification, e.g., streptavidin beads; washing the complxes in protein-denaturing conditions, e.g., high salt and detergent, e.g., using 8 M urea+0.1% SDS; and isolating the protein-RNA complexes.

In some embodiments, the methods include optionally preparing a plurality of validated cDNAs complementary to the pool of ribonucleic acids (RNAs) that bind to the protein of interest; these methods include synthesizing DNA complementary to the RNAs to provide an initial population of cDNAs; PCR-amplifying, if necessary, using strand-specific primers; purifying the initial population of cDNAs to obtain a purified population of cDNAs that are at least about 20 nucleotides (nt) in length, e.g., at least 25, 50, 75, 100, 150, 200, or 250 nt in length; sequencing at least part or substantially all of the purified population of cDNAs; aligning reads to a reference genome and retaining only those that are aligned; selecting high-confidence cDNA sequences, optionally, based on criteria that (1) the candidate transcript has a minimum read density in reads per kilobase per million reads (RPKM) terms (e.g., above a desired threshold); and/or (2) the candidate transcript is enriched in the wildtype library versus a suitable control library (such as an IgG pulldown library or a protein-null pulldown library); thereby preparing the plurality of cDNAs. In some embodiments, the cDNAs are synthesized using strand-specific adaptors.

In some embodiments, the method is used to prepare a library representing a transcriptome associated with the protein of interest.

In some embodiments, the methods further include sequencing substantially all of the cDNAs.

In another aspect the invention features an inhibitory nucleic acid that specifically binds to, or is complementary to a region of an RNA that is known to bind to Polycomb repressive complex 1 (PRC1), wherein the sequence of the region is selected from the group consisting of SEQ ID NOs:1 to 5893 (human), 5894 to 17415 (human), and 17416 to 36368 (mouse) as set forth in Tables 1-3. Without being bound by a theory of invention, these inhibitory nucleic acids are able to interfere with the binding of and function of PRC1, by preventing recruitment of PRC1 to a specific chromosomal locus. For example, data herein shows that a single administration of inhibitory nucleic acids designed to specifically bind a RNA can alter expression of a gene associated with the RNA. Data provided herein also indicate that putative ncRNA binding sites for PRC1 show no conserved primary sequence motif, making it possible to design specific inhibitory nucleic acids that will interfere with PRC1 interaction with a single ncRNA, without generally disrupting PRC1 interactions with other ncRNAs. Further, data provided herein support that RNA can recruit PRC1 in a cis fashion, repressing gene expression at or near the specific chromosomal locus from which the RNA was transcribed, thus making it possible to design inhibitory nucleic acids that inhibit the function of PRC1 and increase the expression of a specific target gene.

In some embodiments, the inhibitory nucleic acid is provided for use in a method of modulating expression of a "gene targeted by the PRC1-binding RNA" (e.g., an intersecting or nearby gene, as set forth in Tables 1-3 below), meaning a gene whose expression is regulated by the PRC1-binding RNA. The term "PRC1-binding RNA" or "RNA that binds PRC1" is used interchangeably with "PRC1-associated RNA" and "PRC1-interacting RNA", and refers to an RNA transcript or a region thereof (e.g., a Peak as described below) that binds the PRC1 complex, directly or indirectly. Such binding may be determined by dCLIP-SEQ techniques described herein using a component of the PRC1 complex, e.g., PRC1 itself. SEQ ID NOs: 1 to 5893 represent human RNA sequences containing portions that have been experimentally determined to bind PRC1 using the dCLIP-seq method described herein; SEQ ID NOs: 17416 to 36368 represent murine RNA sequences containing portions that have been experimentally determined to bind PRC1 using the dCLIP-seq method described herein; and SEQ ID NOs: 5894 to 17415 represent or human RNA sequences corresponding to the murine RNA sequences.

Such methods of modulating gene expression may be carried out in vitro, ex vivo, or in vivo. Tables 1-3 display genes targeted by the PRC1-binding RNA; the SEQ ID NOS: of the PRC1-associated RNA are set forth in the same row as the gene name. In some embodiments, the inhibitory nucleic acid is provided for use in a method of treating disease, e.g. a disease category as described herein. The treatment may involve modulating expression (either up or down) of a gene targeted by the PRC1-binding RNA, preferably upregulating gene expression. The inhibitory nucleic acid may be formulated as a sterile composition for parenteral administration. It is understood that any reference to uses of compounds throughout the description contemplates use of the compound in preparation of a pharmaceutical composition or medicament for use in the treatment of a disease. Thus, as one nonlimiting example, this aspect of the invention includes use of such inhibitory nucleic acids in the preparation of a medicament for use in the treatment of disease, wherein the treatment involves upregulating expression of a gene targeted by the PRC1-binding RNA.

Diseases, disorders or conditions that may be treated according to the invention include cardiovascular, metabolic, inflammatory, bone, neurological or neurodegenerative, pulmonary, hepatic, kidney, urogenital, bone, cancer, and/or protein deficiency disorders.

In a related aspect, the invention features a process of preparing an inhibitory nucleic acid that modulates gene expression, the process comprising the step of synthesizing an inhibitory nucleic acid of between 5 and 40 bases in length, or about 8 to 40, or about 5 to 50 bases in length, optionally single stranded, that specifically binds, or is complementary to, an RNA sequence that has been identified as binding to PRC1, optionally an RNA of any of Tables 1-3 or any one of SEQ ID NOs: 1 to 5893, or 5894 to 17415, or 17416 to 36368. This aspect of the invention may further comprise the step of identifying the RNA sequence as binding to PRC1, optionally through the dCLIP-seq method described herein.

In a further aspect of the present invention a process of preparing an inhibitory nucleic acid that specifically binds to an RNA that binds to Polycomb repressive complex 1 (PRC1) is provided, the process comprising the step of designing and/or synthesizing an inhibitory nucleic acid of between 5 and 40 bases in length, or about 8 to 40, or about 5 to 50 bases in length, optionally single stranded, that specifically binds to an RNA sequence that binds to PRC1, optionally an RNA of any of Tables 1-3 or any one of SEQ ID NOs: 1 to 5893, or 5894 to 17415, or 17416 to 36368.

In some embodiments prior to synthesizing the inhibitory nucleic acid the process further comprises identifying an RNA that binds to PRC1.

In some embodiments the RNA has been identified by a method involving identifying an RNA that binds to PRC1.

In some embodiments the inhibitory nucleic acid is at least 80% complementary to a contiguous sequence of between 5 and 40 bases, or about 8 to 40, or about 5 to 50 bases in said RNA sequence that binds to PRC1. In some embodiments the sequence of the designed and/or synthesized inhibitory nucleic acid is based on a said RNA sequence that binds to PRC1, or a portion thereof, said portion having a length of from 5 to 40 contiguous base pairs, or about 8 to 40 bases, or about 5 to 50 bases.

In some embodiments the sequence of the designed and/or synthesized inhibitory nucleic acid is based on a nucleic acid sequence that is complementary to said RNA sequence that binds to PRC1, or is complementary to a portion thereof, said portion having a length of from 5 to 40 contiguous base pairs, or about 8 to 40 base pairs, or about 5 to 50 base pairs.

The designed and/or synthesized inhibitory nucleic acid may be at least 80% complementary to (optionally one of at least 90%, 95%, 96%, 97%, 98%, 99% or 100% complementary to) the portion of the RNA sequence to which it binds or targets, or is intended to bind or target. In some embodiments it may contain 1, 2 or 3 base mismatches compared to the portion of the target RNA sequence or its complement respectively. In some embodiments it may have up to 3 mismatches over 15 bases, or up to 2 mismatches over 10 bases.

The inhibitory nucleic acid or portion of RNA sequence that binds to PRC1 may have a length of one of at least 8 to 40, or 10 to 50, or 5 to 50, or 5 to 40 bases, e.g., 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 bases. Where the inhibitory nucleic acid is based on an RNA sequence that binds to PRC1, a nucleic acid sequence that is complementary to said RNA sequence that binds to PRC1 or a portion of such a sequence, it may be based on information about that sequence, e.g. sequence information available in written or electronic form, which may include sequence information contained in publicly available scientific publications or sequence databases.

In some embodiments, the isolated single stranded oligonucleotide is of 5 to 40 nucleotides in length and has a region of complementarity that is complementary with at least 5 contiguous nucleotides of the PRC1-binding RNA that inhibits expression of the target gene, wherein the oligonucleotide is complementary to and binds specifically within a PRC1-binding region of the PRC1-binding RNA and interferes with binding of PRC1 to the PRC1-binding region without inducing degradation of the PRC1-binding RNA (e.g., wherein the PRC1-binding region has a nucleotide sequence identified using a denaturing cross-linking immunoprecipitation procedure using an a biotin-tagged PRC1 as described herein), and without interfering with binding of PRC2 to a PRC2-binding region of the RNA (as described in WO 2012/087983 or WO 2012/065143, wherein the PRC2-binding region has a nucleotide sequence protected from nucleases during an RNA immunoprecipitation procedure using an antibody directed against PRC2), optionally wherein the PRC1-binding RNA is transcribed from a sequence of the chromosomal locus of the target gene, and optionally wherein a decrease in recruitment of PRC1 to the target gene in the cell following delivery of the single stranded oligonucleotide to the cell, compared with an appropriate control cell to which the single stranded oligonucleotide has not been delivered, indicates effectiveness of the single stranded oligonucleotide.

Where the design and/or synthesis involves design and/or synthesis of a sequence that is complementary to a nucleic acid described by such sequence information the skilled person is readily able to determine the complementary sequence, e.g. through understanding of Watson-Crick base pairing rules which form part of the common general knowledge in the field.

In the methods described above the RNA that binds to PRC1 may be, or have been, identified, or obtained, by a method that involves identifying RNA that binds to PRC1.

Such methods may involve the following steps: providing a sample containing nuclear ribonucleic acids, contacting the sample with an agent that binds specifically to PRC1 or a subunit thereof, allowing complexes to form between the agent and protein in the sample, partitioning the complexes, synthesizing nucleic acid that is complementary to nucleic acid present in the complexes.

If necessary, the method may further comprise the steps of amplifying the synthesized nucleic acid, and/or purifying the nucleic acid (or amplified nucleic acid), and/or sequencing the nucleic acids so obtained, and/or filtering/analysing the nucleic acids so obtained to identify high-probability PRC1 (or subunit thereof)-interacting transcripts.

In one embodiment the method involves the dCLIP-Seq method described herein.

In accordance with the above, in some embodiments the RNA that binds to PRC1 may be one that is known to bind PRC1, e.g. information about the sequence of the RNA and/or its ability to bind PRC1 is available to the public in written or electronic form allowing the design and/or synthesis of the inhibitory nucleic acid to be based on that information. As such, an RNA that binds to PRC1 may be selected from known sequence information and used to inform the design and/or synthesis of the inhibitory nucleic acid.

In other embodiments the RNA that binds to PRC1 may be identified as one that binds PRC1 as part of the method of design and/or synthesis.

In preferred embodiments design and/or synthesis of an inhibitory nucleic acid involves manufacture of a nucleic acid from starting materials by techniques known to those of skill in the art, where the synthesis may be based on a sequence of an RNA (or portion thereof) that has been selected as known to bind to Polycomb repressive complex 2.

Methods of design and/or synthesis of an inhibitory nucleic acid may involve one or more of the steps of:

Identifying and/or selecting a portion of an RNA sequence that binds to PRC1 (e.g., as shown in Tables 1-3);

Designing a nucleic acid sequence having a desired degree of sequence identity or complementarity to an RNA sequence that binds to PRC1 or a portion thereof;

Synthesizing a nucleic acid to the designed sequence;

Mixing the synthesized nucleic acid with at least one pharmaceutically acceptable diluent, carrier or excipient to form a pharmaceutical composition or medicament.

Inhibitory nucleic acids so designed and/or synthesized may be useful in method of modulating gene expression as described herein.

As such, the process of preparing an inhibitory nucleic acid may be a process that is for use in the manufacture of a pharmaceutical composition or medicament for use in the treatment of disease, optionally wherein the treatment involves modulating expression of a gene targeted by the RNA binds to PRC1.

Thus, provided herein are methods for isolating RNA sequences that interact with a selected protein, e.g., with chromatin complexes, in a cell. The methods include providing a cell expressing (i) a biotin ligase, e.g., BirA, and (ii) the protein of interest comprising a biotinylation sequence; exposing the cells to UV-crosslinking; lysing the cells, isolating protein-RNA complexes from the lysed cells, e.g., using avidin purification, e.g., streptavidin beads; washing the complexes in protein-denaturing conditions, e.g., high salt and detergent, e.g., using 8 M urea+0.1% SDS; and isolating the protein-RNA complexes. In some embodiments, the methods include labelling the RNA in the RNA-protein complexes, e.g., by phosphorylation using $^{32}$P-ATP. In some embodiments, the methods include purifying the RNA-protein complexes, preparing cDNA from the RNA, and deep sequencing the cDNA to identify the RNA sequences bound to the protein.

Also provided are kits for use in the methods described herein; these kits include an expression vector comprising a sequence encoding a biotin ligase, and an expression vector comprising a sequence encoding a biotinylation sequence, and optionally one or more buffers. In some embodiments, the the buffers include one or more of a high stringency denaturing buffer, e.g., comprising 8 M urea (range: 5-10 M, 6-10M, 7-10M, 7-9M, or 7.5-8.5M) plus 0.1% SDS (range: 0.0-2.0%); a wash buffer (e.g., PBS+2% SDS; and a high salt wash buffer (e.g., PBS+750 mM NaCl+1% NP40+0.5% NaDeoxycholate+0.1% SDS).

In yet another aspect, the invention provides isolated nucleic acids comprising a sequence referred to in any of Tables 1-3, or a fragment comprising at least 20 nt thereof. In some or any embodiments, the invention provides an isolated nucleic acid comprising (a) an RNA sequence as set forth in Tables 1-3 that targets a proto-oncogene or oncogene as set forth in Tables 1-3, or (b) a fragment of (a) that is at least 20 bases in length that retains PRC1-binding activity, or (c) a derivative of (a) or (b) that is at least about 90%, 91%, 92%, 93%, 94%, 95%, 96%, 97%, 98%, 99%, or 100% homologous thereto, or (d) a nucleic acid of (a), (b), or (c) in which one or more bases has been replaced with a base of similar base-pairing capacity, such as replacing U with T. In preferred embodiments, the isolated nucleic acid of (a), (b) or (c) is for use in a method of decreasing expression of an oncogene. In some embodiments, the isolated nucleic acid is synthetic. In some embodiments, the isolated RNA comprises a SEQ ID NO. associated with Pvt1 in Tables 1-3. Pvt1 is known in the art to be disrupted in some cases of Burkitt's lymphoma as well as in plasmacytomas (e.g., by translocations from another chromosome). Therefore, Pvt1 is likely to act by targeting PRC1 to c-Myc in order to repress its expression. Accordingly, exogenous administration of any of the RNA sequences associated with Pvt1 in Tables 1-3, or inhibitory nucleic acids complementary thereto, could rescue Pvt1 loss-of-function phenotypes contributing to various cancers.

In a further aspect, the invention provides methods for decreasing expression of an oncogene in a cell. In some embodiments, the methods include contacting the cell with a PRC1-binding fragment described in any of Tables 1-3, or a nucleic acid sequence that is at least about 90%, 91%, 92%, 93%, 94%, 95%, 96%, 97%, 98%, 99%, or 100% homologous to a PRC1-binding fragment as referred to in any of Tables 1-3. In exemplary methods, the RNA a nucleic acid in which one or more bases has been replaced with a base of similar base-pairing capacity, such as replacing U with T. PRC1-binding fragments of murine or orthologous ncRNAs, including human ncRNA, which retain the ncRNA's ability to bind PRC1, are contemplated.

In yet another aspect, the invention features methods for increasing expression of a tumor suppressor in a mammal, e.g. human, in need thereof. The methods include administering to said mammal an inhibitory nucleic acid that specifically binds, or is complementary, to a human PRC1-interacting RNA corresponding to a tumor suppressor locus of any of Tables 1-3 or a human RNA corresponding to an imprinted gene of any of Tables 1-3, or a related naturally occurring RNA that is othologous or at least 90%, (e.g., 91%, 92%, 93%, 94%, 95%, 96%, 97%, 98%%, or 100%) identical over at least 15 (e.g., at least 20, 21, 25, 30, 100) nucoleobases thereof, in an amount effective to increase expression of the tumor suppressor or growth suppressing gene. It is understood that one method of determining human orthologous RNA that corresponds to murine RNA is to identify a corresponding human sequence at least 90% identical (e.g., 91%, 92%, 93%, 94%, 95%, 96%, 97%, 98%, 99%, or 100% identical) to at least 15 nucleobases of the murine sequence (or at least 20, 21, 25, 30, 40, 50, 60, 70, 80, 90 or 100 nucleobases).

In an additional aspect, the invention provides methods for inhibiting or suppressing tumor growth in a mammal, e.g. human, with cancer, comprising administering to said mammal an inhibitory nucleic acid that specifically binds, or is complementary, to a human PRC1-interacting RNA corresponding to a tumor suppressor locus of any of Tables 1-3, or a human RNA corresponding to an imprinted gene of any of Tables 1-3, or a related naturally-occurring RNA that is orthologous or at least 90%, (e.g., 91%, 92%, 93%, 94%, 95%, 96%, 97%, 98%, 99% or 100%) identical over at least 15 (e.g., at least 20, 21, 25, 30, 50, 70, 100) nucleobases thereof, in an amount effective to suppress or inhibit tumor growth.

In another aspect, the invention features methods for treating a mammal, e.g., a human, with cancer comprising administering to said mammal an inhibitory nucleic acid that specifically binds, or is complementary, to a human RNA corresponding to a tumor suppressor locus of any of Tables 1-3, or a human RNA corresponding to an imprinted gene of Tables 1-3, or a related naturally occurring RNA that is orthologous or at least 90% (e.g., 91%, 92%, 93%, 94%, 95%, 96%, 97%, 98%, 99%, or 100%) identical over at least 15 (e.g., at least 20, 21, 25, 30, 50, 70, 100) nucleobases thereof, in a therapeutically effective amount.

Also provided herein are inhibitory nucleic acids that specifically bind, or are complementary to, a region of an RNA that is known to bind to Polycomb repressive complex 1 (PRC1), wherein the sequence of the region is selected from the group consisting of SEQ ID NOs:1 to 5893 (human), 5894 to 17415 (human), and 17416 to 36368 (mouse) as set forth in Tables 1-3, for use in the treatment of disease, wherein the treatment involves modulating expression of a gene targeted by the RNA, wherein the inhibitory nucleic acid is between 5 and 40 bases in length, and wherein the inhibitory nucleic acid is formulated as a sterile composition.

Further described herein are processs for preparing an inhibitory nucleic acid that specifically binds, or is complementary to, an RNA that is known to bind to Polycomb repressive complex 1 (PRC1), selected from the group consisting of SEQ ID NOs:1 to 5893 (human), 5894 to 17415 (human), and 17416 to 36368 (mouse) as set forth in Tables 1-3; the processes include the step of designing and/or synthesizing an inhibitory nucleic acid of between 5 and 40 bases in length, optionally single stranded, that specifically binds to a region of the RNA that binds PRC1.

In some embodiments, the sequence of the designed and/or synthesized inhibitory nucleic acid is a nucleic acid sequence that is complementary to said RNA sequence that binds to PRC1, or is complementary to a portion thereof, said portion having a length of from 5 to 40 contiguous base pairs.

In some embodiments, the inhibitory nucleic acid is for use in the manufacture of a pharmaceutical composition or medicament for use in the treatment of disease, optionally wherein the treatment involves modulating expression of a gene targeted by the RNA binds to PRC1.

In some embodiments, the modulation is increasing expression of a gene and the region of the RNA that binds PRC1 can be in intergenic space mapping to a noncoding RNA, antisense to the coding gene, or in the promoter, 3'UTR, 5'UTR, exons, and introns of a coding gene.

In some embodiments, the modulation is decreasing expression of a gene and the region of the RNA that binds PRC1 can be in intergenic space mapping to a noncoding RNA, antisense to the coding gene, or in the promoter, 3'UTR, 5'UTR, exons, and introns of a coding gene.

In some embodiments, the modulation is to influence gene expression by altering splicing of a gene and the region of the RNA that binds PRC1 can be in intergenic space mapping to a noncoding RNA, antisense to the coding gene, or in the promoter, 3'UTR, 5'UTR, exons, and introns of a coding gene.

Also provided herein are sterile compositions comprising an inhibitory nucleic acid that specifically binds, or is complementary to, an RNA sequence of any one of SEQ ID NOs:1 to 5893 (human), 5894 to 17415 (human), and 17416 to 36368 (mouse) and is capable of modulating expression of a gene targeted by the RNA as set forth in Tables 1-3. In some embodiments, the composition is for parenteral administration. In some embodiments, the RNA sequence is in the 3'UTR of a gene, and the inhibitory nucleic acid is capable of upregulating or downregulating expression of a gene targeted by the RNA.

Also provided herein is an inhibitory nucleic acid for use in the treatment of disease, wherein said inhibitory nucleic acid specifically binds, or is complementary to, an RNA sequence of any one of SEQ ID NOs:1 to 5893 (human) or 5894 to 17415 (human), and wherein the treatment involves modulating expression of a gene targeted by the RNA according to Tables 1-3.

The present disclosure also provides methods for modulating gene expression in a cell or a mammal comprising administering to the cell or the mammal an inhibitory nucleic acid that specifically binds, or is complementary to, an RNA sequence of any one of SEQ ID NOs:1 to 5893 (human) or 5894 to 17415 (human) or 17416 to 36368 (mouse), in an amount effective for modulating expression of a gene targeted by the RNA according to Table 1-3.

In addition, provided herein are inhibitory nucleic acids of about 5 to 50 bases in length that specifically bind, or are complementary to, a fragment of at least five consecutive bases within any of SEQ ID NOs:1 to 5893 (human) or 5894 to 17415 (human) or 17416 to 36368 (mouse), optionally for use in the treatment of disease, wherein the treatment involves modulating expression of a gene targeted by the RNA.

In addition, provided are methods for modulating expression of a gene comprising administering to a mammal an inhibitory nucleic acid as described herein in an amount effective for modulating expression of a gene targeted by the RNA as set forth in Tables 1-3.

In some embodiments, the modulation is upregulating or downregulating gene expression, optionally wherein the gene targeted by the RNA is selected from the group set forth in Tables 1-3, and wherein the RNA sequence is listed in the same row as the gene.

In some embodiments, the inhibitory nucleic acid is 5 to 40 bases in length (optionally 12-30, 12-28, or 12-25 bases in length).

In some embodiments, the inhibitory nucleic acid is 10 to 50 bases in length.

In some embodiments, the inhibitory nucleic acid comprises a base sequence at least 90% complementary to at least 10 bases of the RNA sequence.

In some embodiments, the inhibitory nucleic acid comprises a sequence of bases at least 80% or 90% complementary to, e.g., at least 5-30, 10-30, 15-30, 20-30, 25-30 or 5-40, 10-40, 15-40, 20-40, 25-40, or 30-40 bases of the RNA sequence.

In some embodiments, the inhibitory nucleic acid comprises a sequence of bases with up to 3 mismatches (e.g., up to 1, or up to 2 mismatches) in complementary base pairing over 10, 15, 20, 25 or 30 bases of the RNA sequence.

In some embodiments, the inhibitory nucleic acid comprises a sequence of bases at least 80% complementary to at least 10 bases of the RNA sequence.

In some embodiments, the inhibitory nucleic acid comprises a sequence of bases with up to 3 mismatches over 15 bases of the RNA sequence.

In some embodiments, the inhibitory nucleic acid is single stranded.

In some embodiments, the inhibitory nucleic acid is double stranded.

In some embodiments, the inhibitory nucleic acid comprises one or more modifications comprising: a modified sugar moiety, a modified internucleoside linkage, a modified nucleotide and/or combinations thereof.

In some embodiments, the inhibitory nucleic acid is an antisense oligonucleotide, LNA molecule, PNA molecule, ribozyme or siRNA.

In some embodiments, the inhibitory nucleic acid is double stranded and comprises an overhang (optionally 2-6 bases in length) at one or both termini.

In some embodiments, the inhibitory nucleic acid is selected from the group consisting of antisense oligonucleotides, ribozymes, external guide sequence (EGS) oligonucleotides, siRNA compounds, micro RNAs (miRNAs); small, temporal RNAs (stRNA), and single- or double-stranded RNA interference (RNAi) compounds.

In some embodiments, the RNAi compound is selected from the group consisting of short interfering RNA (siRNA); or a short, hairpin RNA (shRNA); small RNA-induced gene activation (RNAa); and small activating RNAs (saRNAs).

In some embodiments, the antisense oligonucleotide is selected from the group consisting of antisense RNAs, antisense DNAs, and chimeric antisense oligonucleotides.

In some embodiments, the modified internucleoside linkage comprises at least one of: alkylphosphonate, phosphorothioate, phosphorodithioate, alkylphosphonothioate, phosphoramidate, carbamate, carbonate, phosphate triester, acetamidate, carboxymethyl ester, or combinations thereof.

In some embodiments, the modified sugar moiety comprises a 2'-O-methoxyethyl modified sugar moiety, a 2'-methoxy modified sugar moiety, a 2'-O-alkyl modified sugar moiety, or a bicyclic sugar moiety. In some embodiments, the inhibitory nucleic acids include 2'-OMe, 2'-F, LNA, PNA, FANA, ENA or morpholino modifications.

Further provided are sterile compositions comprising an isolated nucleic acid that is a mouse RNA sequence of any one of any one of SEQ ID NOs:1 to 5893 (human) or 5894 to 17415 (human) or 17416 to 36368 (mouse), or a fragment thereof at least 20 bases in length that retains PRC1-binding activity.

Also provided are isolated nucleic acids for use in a method of decreasing expression of an oncogene, comprising an RNA sequence as set forth in Tables 1-3 that targets a proto-oncogene or oncogene as set forth in Tables 1-3, or a fragment thereof at least 20 bases in length that retains PRC1-binding activity.

In addition, provided are methods for decreasing expression of an oncogene in a cell, the method comprising contacting the cell with an RNA sequence as set forth in Tables 1-3 that targets an oncogene as set forth in Tables 1-3, or a fragment thereof at least 20 bases in length that retains PRC1-binding activity.

Further, provided herein are methods of inducing expression of a target gene in a cell, the method comprising delivering to the cell a single stranded oligonucleotide of 5 to 40 nucleotides in length having a region of complementarity that is complementary with at least 5 contiguous nucleotides of a PRC1-binding RNA that inhibits expression of the target gene, wherein the oligonucleotide is complementary to and binds specifically to the PRC1-binding RNA, and wherein the PRC1-binding RNA is transcribed from a sequence of the chromosomal locus of the target gene.

In some embodiments, the RNA is a non-coding RNA.

In some embodiments, the methods include detecting expression of the PRC1-binding RNA in the cell, wherein expression of the PRC1-binding RNA in the cell indicates that the single stranded oligonucleotide is suitable for increasing expression of the target gene in the cell.

In some embodiments, the methods include detecting a change in expression of the target gene following delivery of the single stranded oligonucleotide to the cell, wherein an increase in expression of the target gene compared with an appropriate control cell indicates effectiveness of the single stranded oligonucleotide.

In some embodiments, the methods include detecting a change in recruitment of PRC1 to the target gene in the cell following delivery of the single stranded oligonucleotide to the cell, wherein a decrease in recruitment compared with an appropriate control cell indicates effectiveness of the single stranded oligonucleotide.

In some embodiments, the cell is in vitro.

In some embodiments, the cell is in vivo.

In some embodiments, at least one nucleotide of the oligonucleotide is a modified nucleotide.

In some embodiments, the PRC1-binding RNA is transcribed from the same strand as the target gene in a genomic region containing the target gene.

In some embodiments, the oligonucleotide has complementarity to a region of the PRC1-binding RNA transcribed from a portion of the target gene corresponding to an exon.

In some embodiments, the oligonucleotide has complementarity to a region of the PRC1-binding RNA transcribed from the same strand as the target gene within a chromosomal region within −2.0 kb to +0.001 kb of the transcription start site of the target gene.

In some embodiments, the oligonucleotide has complementarity to a region of the PRC1-binding RNA transcribed from the opposite strand of the target gene within a chromosomal region within −0.5 to +0.1 kb of the transcription start site of the target gene.

In some embodiments, the oligonucleotide has complementarity to the PRC1-binding RNA in a region of the PRC1-binding RNA that forms a stem-loop structure.

In some embodiments, at least one nucleotide of the oligonucleotide is an RNA or DNA nucleotide.

In some embodiments, at least one nucleotide of the oligonucleotide is a ribonucleic acid analogue comprising a ribose ring having a bridge between its 2'-oxygen and 4'-carbon.

In some embodiments, the ribonucleic acid analogue comprises a methylene bridge between the 2'-oxygen and the 4'-carbon.

In some embodiments, at least one nucleotide of the oligonucleotide comprises a modified sugar moiety.

In some embodiments, the modified sugar moiety comprises a 2'-O-methoxyethyl modified sugar moiety, a 2'-methoxy modified sugar moiety, a 2'-O-alkyl modified sugar moiety, or a bicyclic sugar moiety.

In some embodiments, the oligonucleotide comprises at least one modified internucleoside linkage.

In some embodiments, the at least one modified internucleoside linkage is selected from phosphorothioate, phosphorodithioate, alkylphosphonothioate, phosphoramidate, carbamate, carbonate, phosphate triester, acetamidate, carboxymethyl ester, and combinations thereof.

In some embodiments, the oligonucleotide is configured such that hybridization of the single stranded oligonucleotide to the PRC1-binding RNA does not activate an RNAse H pathway in the cell.

In some embodiments, the oligonucleotide is configured such that hybridization of the single stranded oligonucleotide to the PRC1-binding RNA does not induce substantial cleavage or degradation of the PRC1-binding RNA in the cell.

In some embodiments, the oligonucleotide is configured such that hybridization of the single stranded oligonucleotide to the PRC1-binding RNA interferes with interaction of the RNA with PRC1 in the cell.

In some embodiments, the target gene is a protein-coding gene.

In some embodiments, the chromosomal locus of the target gene is an endogenous gene of an autosomal chromosome.

In some embodiments, the cell is a cell of a male subject.

In some embodiments, the oligonucleotide has complementarity to a region of the PRC1-binding RNA transcribed from a portion of the target gene corresponding to an intron-exon junction or an intron.

In some embodiments, the oligonucleotide has complementarity to a region of the PRC1-binding RNA transcribed from a portion of the target gene corresponding to a translation initiation region or a translation termination region.

In some embodiments, the oligonucleotide has complementarity to a region of the PRC1-binding RNA transcribed from a portion of the target gene corresponding to a promoter.

In some embodiments, the oligonucleotide has complementarity to a region of the PRC1-binding RNA transcribed from a portion of the target gene corresponding to a 5'-UTR.

In some embodiments, the oligonucleotide has complementarity to a region of the PRC1-binding RNA transcribed from a portion of the target gene corresponding to a 3'-UTR.

In some or any embodiments, the inhibitory nucleic acid is an oligomeric base compound or oligonucleotide mimetic that hybridizes to at least a portion of the target nucleic acid and modulates its function. In some or any embodiments, the inhibitory nucleic acid is single stranded or double stranded. A variety of exemplary inhibitory nucleic acids are known and described in the art. In some examples, the inhibitory nucleic acid is an antisense oligonucleotide, locked nucleic acid (LNA) molecule, peptide nucleic acid (PNA) molecule, ribozyme, siRNA, antagomirs, external guide sequence (EGS) oligonucleotide, microRNA (miRNA), small, temporal RNA (stRNA), or single- or double-stranded RNA interference (RNAi) compounds. It is understood that the term "LNA molecule" refers to a molecule that comprises at least one LNA modification; thus LNA molecules may have one or more locked nucleotides (conformationally constrained) and one or more non-locked nucleotides. It is also understood that the term "LNA" includes a nucleotide that comprises any constrained sugar that retains the desired properties of high affinity binding to complementary RNA, nuclease resistance, lack of immune stimulation, and rapid kinetics. Exemplary constrained sugars include those listed below. Similarly, it is understood that the term "PNA molecule" refers to a molecule that comprises at least one PNA modification and that such molecules may include unmodified nucleotides or internucleoside linkages.

In some or any embodiments, the inhibitory nucleic acid comprises at least one nucleotide and/or nucleoside modification (e.g., modified bases or with modified sugar moieties), modified internucleoside linkages, and/or combinations thereof. Thus, inhibitory nucleic acids can comprise natural as well as modified nucleosides and linkages. Examples of such chimeric inhibitory nucleic acids, including hybrids or gapmers, are described below.

In some embodiments, the inhibitory nucleic acid comprises one or more modifications comprising: a modified sugar moiety, and/or a modified internucleoside linkage, and/or a modified nucleotide and/or combinations thereof. In some embodiments, the modified internucleoside linkage comprises at least one of: alkylphosphonate, phosphorothioate, phosphorodithioate, alkylphosphonothioate, phosphoramidate, carbamate, carbonate, phosphate triester, acetamidate, carboxymethyl ester, or combinations thereof. In some embodiments, the modified sugar moiety comprises a 2'-O-methoxyethyl modified sugar moiety, a 2'-methoxy modified sugar moiety, a 2'-O-alkyl modified sugar moiety, or a bicyclic sugar moiety. Other examples of modifications include locked nucleic acid (LNA), peptide nucleic acid (PNA), arabinonucleic acid (ANA), optionally with 2'-F modification, 2'-fluoro-D-Arabinonucleic acid (FANA), phosphorodiamidate morpholino oligomer (PMO), ethylene-bridged nucleic acid (ENA), optionally with 2'-O,4'-C-ethylene bridge, and bicyclic nucleic acid (BNA). Yet other examples are described below and/or are known in the art.

In some embodiments, the inhibitory nucleic acid is 5-40 bases in length (e.g., 12-30, 12-28, 12-25). The inhibitory nucleic acid may also be 10-50, or 5-50 bases length. For example, the inhibitory nucleic acid may be one of any of 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 bases in length. In some embodiments, the inhibitory nucleic acid is double stranded and comprises an overhang (optionally 2-6 bases in length) at one or both termini. In other embodiments, the inhibitory nucleic acid is double stranded and blunt-ended. In some embodiments, the inhibitory nucleic acid comprises or consists of a sequence of bases at least 80% or 90% complementary to, e.g., at least 5, 10, 15, 20, 25 or 30 bases of, or up to 30 or 40 bases of, the target RNA, or comprises a sequence of bases with up to 3 mismatches (e.g., up to 1, or up to 2 mismatches) over 10, 15, 20, 25 or 30 bases of the target RNA.

Thus, the inhibitory nucleic acid can comprise or consist of a sequence of bases at least 80% complementary to at least 10 contiguous bases of the target RNA, or at least 80% complementary to at least 15, or 15-30, or 15-40 contiguous bases of the target RNA, or at least 80% complementary to at least 20, or 20-30, or 20-40 contiguous bases of the target RNA, or at least 80% complementary to at least 25, or 25-30, or 25-40 contiguous bases of the target RNA, or at least 80% complementary to at least 30, or 30-40 contiguous bases of the target RNA, or at least 80% complementary to at least 40 contiguous bases of the target RNA. Moreover, the inhibitory nucleic acid can comprise or consist of a sequence of bases at least 90% complementary to at least 10 contiguous bases of the target RNA, or at least 90% complementary to at least 15, or 15-30, or 15-40 contiguous bases of the target RNA, or at least 90% complementary to at least 20, or 20-30, or 20-40 contiguous bases of the target RNA, or at least 90% complementary to at least 25, or 25-30, or 25-40 contiguous bases of the target RNA, or at least 90% complementary to at least 30, or 30-40 contiguous bases of the target RNA, or at least 90% complementary to at least 40 contiguous bases of the target RNA. Similarly, the inhibitory nucleic acid can comprise or consist of a sequence of bases fully complementary to at least 5, 10, or 15 contiguous bases of the target RNA.

Complementarity can also be referenced in terms of the number of mismatches in complementary base pairing, as noted above. Thus, the inhibitory nucleic acid can comprise or consist of a sequence of bases with up to 3 mismatches over 10 contiguous bases of the target RNA, or up to 3 mismatches over 15 contiguous bases of the target RNA, or up to 3 mismatches over 20 contiguous bases of the target RNA, or up to 3 mismatches over 25 contiguous bases of the target RNA, or up to 3 mismatches over 30 contiguous bases of the target RNA. Similarly, the inhibitory nucleic acid can comprise or consist of a sequence of bases with up to 2 mismatches over 10 contiguous bases of the target RNA, or up to 2 mismatches over 15 contiguous bases of the target RNA, or up to 2 mismatches over 20 contiguous bases of the target RNA, or up to 2 mismatches over 25 contiguous bases of the target RNA, or up to 2 mismatches over 30 contiguous bases of the target RNA. Similarly, the the inhibitory nucleic acid can comprise or consist of a sequence of bases with one mismatch over 10, 15, 20, 25 or 30 contiguous bases of the target RNA.

As such, in some embodiments the inhibitory nucleic acid comprises or consists of a sequence of bases about 5 to 40, or 8 to 40, or 10 to 50, or 5 to 50 bases in length, comprising a base sequence at least 80% complementary to (optionally one of at least 90%, 95%, 96%, 97%, 98%, 99% or 100% complementary to) a contiguous sequence of at least 5 to 40 bases, or 8 to 40, or 10 to 50, or 5 to 50 bases (optionally one of at least 10, 15, 20, 25 or 30 bases, or one of 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 bases) of the target RNA. Thus, in some embodiments the inhibitory nucleic acid may comprise or consist of a sequence of at least 5 to 40, or 8 to 40, or 5 to 50, or 10 to 50, bases (optionally one of at least 10, 15, 20, 25 or 30 bases, or one of 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 bases) having at least 80% identity to (optionally one of at least 90%, 95%, 96%, 97%, 98%, 99% or 100% identity to) a contiguous sequence of bases of the same length of an antisense nucleic acid that is completely complementary in sequence to the target RNA. In some embodiments the sequence of the inhibitory nucleic acid may contain 1, 2 or 3 mismatches in complementary base pairing compared to the target ncRNA sequence, over 10, 15, 20, 25 or 30 bases (optionally one of 10, 11, 12, 13, 14, 15, 16, 17, 18, 19, 20, 21, 22, 23, 24, 25, 26, 27, 28, 29 or 30 bases) of the target RNA.

In some or any embodiments, the inhibitory nucleic acid is 5 to 40, or 8 to 40, or 10 to 50 bases in length (e.g., 12-30, 12-28, 12-25, 5-25, or 10-25, bases in length), and comprises a sequence of bases with up to 3 mismatches in complementary base pairing over 15 bases of, or up to 2 mismatches over 10 bases.

In some embodiments, gene expression is modulated in a cell. In some embodiments, the cell is a cancer cell, e.g., a tumor cell, in vitro or in vivo, e.g., in a subject. In other embodiments, the cell is a stem cell that is contacted with the inhibitory nucleic acid, PRC1-binding ncRNA, or fragment thereof, ex vivo, for example to enhance pluripotency, enhance differentiation, or induce the stem cell to differentiate to a particular cell type, e.g. nerve, neuron, dopaminergic neuron, muscle, skin, heart, kidney, liver, lung, neuroendocrine, retinal, retinal pigment epithelium, pancreatic alpha or beta cells, hematopoietic, chondrocyte, bone cells and/or blood cells (e.g., T-cells, B-cells, macrophages, erythrocytes, platelets, and the like).

In an additional aspect, the invention provides methods for enhancing pluripotency of a stem cell. The methods include contacting the cell with an inhibitory nucleic acid that specifically binds, or is complementary, to a nucleic acid sequence that is at least about 90%, 91%, 92%, 93%, 94%, 95%, 96%, 97%, 98% or 99% homologous to a PRC1-binding fragment thereof, as referred to in Tables 1-3. PRC1-binding fragments of murine or orthologous RNAs, including human RNAs, are contemplated in the aforementioned method.

In a further aspect, the invention features methods for enhancing differentiation of a stem cell, the method comprising contacting the cell with an inhibitory nucleic acid that specifically binds, or is complementary, to a PRC1-binding RNA sequence as set forth in SEQ ID NOS. 17416 to 36368 [mouse Peaks] or 1 to 5893 [human Peaks] or 5894 to 17416 [human Peaks identified by LiftOver].

In some embodiments, the stem cell is an embryonic stem cell. In some embodiments, the stem cell is an iPS cell or an adult stem cell.

In an additional aspect, the invention provides sterile compositions including an inhibitory nucleic acid that specifically binds to or is at least 90% complementary to (e.g., at least 5, 10, 15, 20, 25 or 30 bases of, or up to 30 or 40 bases of) a sequence listed in any of Tables 1-3, or any one of SEQ ID NOs: 17416 to 36368 [mouse Peaks] or 1 to 5893 [human Peaks] or 5894 to 17416 [human Peaks identified by LiftOver], or a related naturally occurring RNA at least 90%, 91%, 92%, 93%, 94%, 95%, 96%, 97%, 98%, 99%, or 100% identical to at least 15 (e.g., at least 20, 21, 25, 30, 100) nucleobases of an ncRNA of any of Tables 1-3 or any one of SEQ ID NOs: 17416 to 36368 [mouse Peaks] or 1 to 5893 [human Peaks] or 5894 to 17416 [human Peaks identified by LiftOver], for parenteral administration. In some embodiments, the inhibitory nucleic acid is selected from the group consisting of antisense oligonucleotides, ribozymes, external guide sequence (EGS) oligonucleotides, siRNA compounds, micro RNAs (miRNAs); small, temporal RNAs (stRNA), and single- or double-stranded RNA interference (RNAi) compounds. In some embodiments, the RNAi compound is selected from the group consisting of short interfering RNA (siRNA); or a short, hairpin RNA (shRNA); small RNA-induced gene activation (RNAa); and small activating RNAs (saRNAs).

In some embodiments, the antisense oligonucleotide is selected from the group consisting of antisense RNAs, antisense DNAs, chimeric antisense oligonucleotides, and antisense oligonucleotides.

In some embodiments, the inhibitory nucleic acid comprises one or more modifications comprising: a modified sugar moiety, a modified internucleoside linkage, a modified nucleotide and/or combinations thereof. In some embodiments, the modified internucleoside linkage comprises at least one of: alkylphosphonate, phosphorothioate, phosphorodithioate, alkylphosphonothioate, phosphoramidate, carbamate, carbonate, phosphate triester, acetamidate, carboxymethyl ester, or combinations thereof. In some embodiments, the modified sugar moiety comprises a 2'-O-methoxyethyl modified sugar moiety, a 2'-methoxy modified sugar moiety, a 2'-O-alkyl modified sugar moiety, or a bicyclic sugar moiety. Other examples of modifications include locked nucleic acid (LNA), peptide nucleic acid (PNA), arabinonucleic acid (ANA), optionally with 2'-F modification, 2'-fluoro-D-Arabinonucleic acid (FANA), phosphorodiamidate morpholino oligomer (PMO), ethylene-bridged nucleic acid (ENA), optionally with 2'-O,4'-C-ethylene bridge, and bicyclic nucleic acid (BNA). Yet other examples are described below and/or are known in the art.

PRC1-binding fragments of any of the RNA sequences set forth in the sequence listing as summarized below are contemplated. In some aspects, the fragments may recruit PRC1 and enhance PRC1 activity, thereby repressing gene expression, while in other instances the fragments may interfere with PRC1 activity by masking the ncRNA-binding sites on PRC1. In particular, the invention features uses of fragments of the RNA below to modulate expression of any of the genes set forth in Tables 1-3, for use in treating a disease, disorder, condition or association (whether in the "opposite strand" column or the "same strand" column).

Moreover, inhibitory nucleic acids that specifically bind to any of the RNA peaks set forth in the sequence listing as summarized below, any one of SEQ ID NOs: 1 to 5893, 5894 to 17415, or 17416 to 36368, are also contemplated. In particular, the invention features uses of these inhibitory nucleic acids to upregulate expression of any of the genes set forth in Tables 1-3, for use in treating a disease, disorder, condition or association known in the art (whether in the "opposite strand" column or the "same strand"); upregulations of a set of genes grouped together in any one of the categories is contemplated. In some embodiments it is contemplated that expression may be increased by at least about 15-fold, 20-fold, 30-fold, 40-fold, 50-fold or 100-fold, or any range between any of the foregoing numbers. In other experiments, increased mRNA expression has been shown to correlate to increased protein expression.

Thus, in various aspects, the invention features inhibitory nucleic acids that specifically bind to any of the RNA sequences of any of Tables 1-3, for use in modulating expression of a group of reference genes that fall within any one or more of the categories set forth in the tables, and for treating corresponding diseases, disorders or conditions.

In another aspect, the invention also features inhibitory nucleic acids that specifically bind, or are complementary, to any of the RNA sequences of SEQ ID NOS: 17416 to 36368 [mouse Peaks] or 1 to 5893 [human Peaks] or 5894 to 17416 [human Peaks identified by LiftOver], whether in the "opposite strand" column or the "same strand" column of Tables 1-3. In some embodiments, the inhibitory nucleic acid is provided for use in a method of modulating expression of a gene targeted by the PRC1-binding RNA (e.g., an intersecting or nearby gene, as set forth in any of Tables 1-4 below).

Such methods may be carried out in vitro, ex vivo, or in vivo. In some embodiments, the inhibitory nucleic acid is provided for use in methods of treating disease, e.g. as described below. The treatments may involve modulating expression (either up or down) of a gene targeted by the PRC1-binding RNA, preferably upregulating gene expression. In some embodiments, the inhibitory nucleic acid is formulated as a sterile composition for parenteral administration. Thus, in one aspect the invention describes a group of inhibitory nucleic acids that specifically bind, or are complementary to, a group of RNA sequences, i.e., Peaks, in any one of Tables 1, 2, or 3. In particular, the invention features uses of such inhibitory nucleic acids to upregulate expression of any of the reference genes set forth in Tables 1-3, for use in treating a disease, disorder, or condition.

It is understood that inhibitory nucleic acids of the invention may be complementary to, or specifically bind to, Peaks, or regions adjacent to (within 100, 200, 300, 400, or 500 nts of) Peaks, as shown in Tables 1-3.

Also provided herein are methods for treating a subject with MECP2 Duplication Syndrome. The methods include administering a therapeutically effective amount of an inhibitory nucleic acid targeting a PRC1-binding region on Mecp2 RNA, e.g., an inhibitory nucleic acid targeting a sequence within the 3'UTR of Mecp2. In some embodiments, inhibitory nucleic acid comprises any of SEQ ID NOs:36399 to 36404.

Further provided herein are methods for treating a subject with systemic lupus erythematosus. The methods include administering a therapeutically effective amount of an inhibitory nucleic acid targeting a PRC1-binding region on MAK1 RNA, e.g., an inhibitory nucleci acid targeting a sequence within the 3'UTR of IRAK1.

In some embodiments, the inhibitory nucleic acid comprises any of SEQ ID NOs:36396 to 36398.

In some embodiments, the inhibitory nucleic acid comprises at least one locked nucleotide.

Also provided herein are inhibitory nucleic acids targeting a PRC1-binding region on Mecp2 RNA, preferably wherein the PRC1 binding region comprises SEQ ID NO:5876 or 5877, and/or preferably an inhibitory nucleic acid targeting a sequence within the 3'UTR of Mecp2, for use in treating a subject with MECP2 Duplication Syndrome, e.g., comprising any of SEQ ID NOs:36399 to 36404.

In addition, provided herein are inhibitory nucleic acids targeting a PRC1-binding region on IRAK1 RNA, preferably wherein the PRC1 binding region comprises SEQ ID NO:5874 or 5875, and/or preferably an inhibitory nucleic acid targeting a sequence within the 3'UTR of IRAK1, for use in treating a subject with systemic lupus erythematosus, e.g., an inhibitory nucleic acid comprising any of SEQ ID NOs:36396 to 36398.

In some or any embodiments, the inhibitory nucleic acids are, e.g., about 5 to 40, about 8 to 40, or 10 to 50 bases, or 5 to 50 bases in length. In some embodiments, the inhibitory nucleic acid comprises or consists of a sequence of bases at least 80% or 90% complementary to, e.g., at least 5, 10, 15, 20, 25 or 30 bases of, or up to 30 or 40 bases of, the target RNA (e.g., any one of SEQ ID NOs: 1 to 36,368), or comprises a sequence of bases with up to 3 mismatches (e.g., up to 1, or up to 2 mismatches) over 10, 15, 20, 25 or 30 bases of the target RNA.

Thus, as noted above, the inhibitory nucleic acid can comprise or consist of a sequence of bases at least 80% complementary to at least 10, or 10-30 or 10-40 contiguous bases of the target RNA, or at least 80% complementary to at least 15, or 15-30, or 15-40 contiguous bases of the target RNA, or at least 80% complementary to at least 20, or 20-30, or 20-40 contiguous bases of the target RNA, or at least 80% complementary to at least 25, or 25-30, or 25-40 contiguous bases of the target RNA, or at least 80% complementary to at least 30, or 30-40 contiguous bases of the target RNA, or at least 80% complementary to at least 40 contiguous bases of the target RNA. Moreover, the inhibitory nucleic acid can comprise or consist of a sequence of bases at least 90% complementary to at least 5, or 5-30 or 5-40 or 8-40 contiguous bases of the target RNA, or at least 90% complementary to at least 10, or 10-30, or 10-40 contiguous bases of the target RNA, or at least 90% complementary to at least 15, or 15-30, or 15-40 contiguous bases of the target RNA, or at least 90% complementary to at least 20, or 20-30, or 20-40 contiguous bases of the target RNA, or at least 90% complementary to at least 25, or 25-30, or 25-40 contiguous bases of the target RNA, or at least 90% complementary to at least 30, or 30-40 contiguous bases of the target RNA, or at least 90% complementary to at least 40 contiguous bases of the target RNA. Similarly, the inhibitory nucleic acid can comprise or consist of a sequence of bases fully complementary to at least 5, 10, or 15 contiguous bases of the target RNA. It is understood that some additional non-complementary bases may be included. It is understood that inhibitory nucleic acids that comprise such sequences of bases as described may also comprise other non-complementary bases. For example, an inhibitory nucleic acid can be 20 bases in total length but comprise a 15 base portion that is fully complementary to 15 bases of the target RNA. Similarly, an inhibitory nucleic acid can be 20 bases in total length but comprise a 15 base portion that is at least 80% complementary to 15 bases of the target RNA.

Complementarity can also be referenced in terms of the number of mismatches in complementary base pairing, as noted above. Thus, the inhibitory nucleic acid can comprise or consist of a sequence of bases with up to 3 mismatches over 10 contiguous bases of the target RNA, or up to 3 mismatches over 15 contiguous bases of the target RNA, or up to 3 mismatches over 20 contiguous bases of the target RNA, or up to 3 mismatches over 25 contiguous bases of the target RNA, or up to 3 mismatches over 30 contiguous bases of the target RNA. Similarly, the inhibitory nucleic acid can comprise or consist of a sequence of bases with up to 2 mismatches over 10 contiguous bases of the target RNA, or up to 2 mismatches over 15 contiguous bases of the target RNA, or up to 2 mismatches over 20 contiguous bases of the target RNA, or up to 2 mismatches over 25 contiguous bases of the target RNA, or up to 2 mismatches over 30 contiguous bases of the target RNA. Similarly, the the inhibitory nucleic acid can comprise or consist of a sequence of bases with one mismatch over 10, 15, 20, 25 or 30 contiguous bases of the target RNA.

In some or any of the embodiments of inhibitory nucleic acids described herein (e.g. in the summary, detailed description, or examples of embodiments) or the processes for designing or synthesizing them, the inhibitory nucleic acids may optionally exclude (a) any LNA that disrupts binding of PRC2 to an RNA, e.g., as describe in WO 2012/087983 or WO 2012/065143; (b) any one or more of the specific inhibitory nucleic acids made or actually disclosed (i.e. specific chemistry, single or double-stranded, specific modifications, and specific base sequence), set forth in WO 2012/065143 or WO 2012/087983; and/or the general base sequence of any one or more of the inhibitory nucleic acids of (b); and/or (c) the group of inhibitory nucleic acids that specifically bind or are complementary to the same specific portion of RNA (a stretch of contiguous bases) as any one or more of the inhibitory nucleic acids of (a); as disclosed in any one or more of the following publications: as targeting ANRIL RNA (as described in Yap et al., Mol Cell. 2010 Jun. 11; 38(5):662-74) HOTAIR RNA (Rinn et al., 2007), Tsix, RepA, or Xist RNAs ((Zhao et al., 2008) [SEQ ID NOs: 936166-936170 of WO 2012/087983], or (Sarma et al., 2010) [SEQ ID NOs: 936177-936186 of WO 2012/087983] or (Zhao et al., 2010) [SEQ ID NOs: 936187-936188 of WO 2012/087983] or (Prasnath et al., 2005) [SEQ ID NOs: 936173-936176 of WO 2012/087983] or (Shamovsky et al., 2006) [SEQ ID NO: 936172 of WO 2012/087983] or (Mariner et al., 2008) [SEQ ID NO: 936171 of WO 2012/087983] or (Sunwoo et al., 2008) or (Bernard et al., 2010) [SEQ ID NO: 936189 of WO 2012/087983]; or as targeting short RNAs of 50-200 nt that are identified as candidate PRC2 regulators (Kanhere et al., 2010); or (Kuwabara et al., US 2005/0226848) [SEQ ID NOs: 936190-936191 of WO 2012/087983] or (Li et al., US 2010/0210707) [SEQ ID NOs: 936192-936227 of WO 2012/087983] or (Corey et al., 7,709,456) [SEQ ID NOs: 936228-936245] or (Mattick et al., WO 2009/124341), or (Corey et al., US 2010/0273863) [SEQ ID NOs: 936246-936265 of WO 2012/087983], or (Wahlstedt et al., US 2009/0258925) [SEQ ID NOs: 935060-935126 of WO 2012/087983], or BACE: US 2009/0258925 [SEQ ID NOs: 935060-935126 of WO 2012/087983]; ApoA1: US 2010/0105760/EP235283 [SEQ ID NOs: 935127-935299 of WO 2012/087983], P73, p53, PTEN, WO 2010/065787 A2/EP2370582 [SEQ ID NOs: 935300-935345 of WO 2012/087983]; SIRT1: WO 2010/065662 A2/EP09831068 [SEQ ID NOs: 935346-935392 of WO 2012/087983]; VEGF: WO 2010/065671 A2/EP2370581 [SEQ ID NOs: 935393-935403 of WO 2012/087983]; EPO: WO 2010/065792 A2/EP09831152 [SEQ ID NOs: 935404-935412 of WO 2012/087983]; BDNF: WO2010/093904 [SEQ ID NOs: 935413-935423 of WO 2012/087983], DLK1: WO 2010/107740 [SEQ ID NOs: 935424-935430 of WO 2012/087983]; NRF2/NFE2L2: WO 2010/107733 [SEQ ID NOs: 935431-935438 of WO 2012/087983]; GDNF: WO 2010/093906 [SEQ ID NOs: 935439-935476 of WO 2012/087983]; SOX2, KLF4, Oct3A/B, "reprogramming factors: WO 2010/135329 [SEQ ID NOs: 935477-935493 of WO 2012/087983]; Dystrophin: WO 2010/129861 [SEQ ID NOs: 935494-935525 of WO 2012/087983]; ABCA1, LCAT, LRP1, ApoE, LDLR, ApoA1: WO 2010/129799 [SEQ ID NOs: 935526-935804 of WO 2012/087983]; HgF: WO 2010/127195 [SEQ ID NOs: 935805-935809 of WO 2012/087983]; TTP/Zfp36: WO 2010/129746[SEQ ID NOs: 935810-935824 of WO 2012/087983]; TFE3, IRS2: WO 2010/135695 [SEQ ID NOs: 935825-935839 of WO 2012/087983]; RIG1, MDA5, IFNA1: WO 2010/138806 [SEQ ID NOs: 935840-935878 of WO 2012/087983]; PON1: WO 2010/148065 [SEQ ID NOs: 935879-935885 of WO 2012/087983]; Collagen: WO/2010/148050 [SEQ ID NOs: 935886-935918 of WO 2012/087983]; Dyrk1A, Dscr1, "Down Syndrome Gene": WO/2010/151674 [SEQ ID NOs: 935919-935942 of WO 2012/087983]; TNFR2: WO/2010/151671 [SEQ ID NOs: 935943-935951 of WO 2012/087983]; Insulin: WO/2011/017516 [SEQ ID NOs: 935952-935963 of WO 2012/087983]; ADIPOQ: WO/2011/019815 [SEQ ID NOs: 935964-935992 of WO 2012/087983]; CHIP: WO/2011/022606 [SEQ ID NOs: 935993-936004 of WO 2012/087983]; ABCB1: WO/2011/025862 [SEQ ID NOs: 936005-936014 of WO 2012/087983]; NEUROD1, EUROD1, HNF4A, MAFA, PDX, KX6, "Pancreatic development gene": WO/2011/085066 [SEQ ID NOs: 936015-936054 of WO 2012/087983]; MBTPS1: WO/2011/084455 [SEQ ID NOs: 936055-936059 of WO 2012/087983]; SHBG: WO/2011/085347 [SEQ ID NOs: 936060-936075 of WO 2012/087983]; IRF8: WO/2011/082409 [SEQ ID NOs: 936076-936080 of WO 2012/087983]; UCP2: WO/2011/079263 [SEQ ID NOs: 936081-936093 of WO 2012/087983]; HGF: WO/2011/079261 [SEQ ID NOs: 936094-936104 of WO 2012/087983]; GH: WO/2011/038205 [SEQ ID NOs: 936105-936110 of WO 2012/087983]; IQGAP: WO/2011/031482 [SEQ ID NOs: 936111-936116 of WO 2012/087983]; NRF1: WO/2011/090740 [SEQ ID NOs: 936117-936123 of WO 2012/087983]; P63: WO/2011/090741 [SEQ ID NOs: 936124-936128 of WO 2012/087983]; RNAseHl: WO/2011/091390 [SEQ ID NOs: 936129-936140 of WO 2012/087983]; ALOX12B: WO/2011/097582 [SEQ ID NOs: 936141-936146 of WO 2012/087983]; PYCR1: WO/2011/103528 [SEQ ID NOs: 936147-936151 of WO 2012/087983]; CSF3: WO/2011/123745 [SEQ ID NOs: 936152-936157 of WO 2012/087983]; FGF21: WO/2011/127337 [SEQ ID NOs: 936158-936165 of WO 2012/087983]; SIRTUIN (SIRT): WO2011/139387 [SEQ ID NOs: 936266-936369 and 936408-936425 of WO 2012/087983]; PAR4: WO2011/143640 [SEQ ID NOs: 936370-936376 and 936426 of WO 2012/087983]; LHX2: WO2011/146675 [SEQ ID NOs: 936377-936388 and 936427-936429 of WO 2012/087983]; BCL2L11: WO2011/146674 [SEQ ID NO: 936389-936398 and 936430-936431 of WO 2012/087983]; MSRA: WO2011/150007 [SEQ ID NOs: 936399-936405 and 936432 of WO 2012/087983]; ATOH1: WO2011/150005 [SEQ ID NOs: 936406-936407 and 936433 of WO 2012/087983] of which each of the foregoing is incorporated by reference in its entirety herein. In some or any of the embodiments, optionally excluded from the invention are of inhibitory nucleic acids that specifically bind to, or are complementary to, any one or more of the following regions: Nucleotides 1-932 of SEQ ID NO: 935128 of WO 2012/087983; Nucleotides 1-1675 of SEQ ID NO: 935306 of WO 2012/087983; Nucleotides 1-518 of SEQ ID NO: 935307 of WO 2012/087983; Nucleotides 1-759 of SEQ ID NO: 935308 of WO 2012/087983; Nucleotides 1-25892 of SEQ ID NO: 935309 of WO 2012/087983; Nucleotides 1-279 of SEQ ID NO: 935310 of WO 2012/087983; Nucleotides 1-1982 of SEQ ID NO: 935311 of WO 2012/087983; Nucleotides 1-789 of SEQ ID NO: 935312 of WO 2012/087983; Nucleotides 1-467 of SEQ ID NO: 935313 of WO 2012/087983; Nucleotides 1-1028 of SEQ ID NO: 935347 of WO 2012/087983; Nucleotides 1-429 of SEQ ID NO: 935348 of WO 2012/087983; Nucleotides 1-156 of SEQ ID NO: 935349 of WO 2012/087983; Nucleotides 1-593 of SEQ ID NO:935350 of WO 2012/087983; Nucleotides 1-643 of SEQ ID NO: 935395 of WO 2012/087983; Nucleotides 1-513 of SEQ ID NO: 935396 of WO 2012/087983; Nucleotides 1-156 of SEQ ID NO: 935406 of WO 2012/087983; Nucleotides 1-3175 of SEQ ID NO: 935414 of WO 2012/087983; Nucleotides 1-1347 of SEQ ID NO: 935426 of WO 2012/087983; Nucleotides 1-5808 of SEQ ID NO: 935433 of WO 2012/087983; Nucleotides 1-237 of SEQ ID NO: 935440 of WO 2012/087983; Nucleotides 1-1246 of SEQ ID NO: 935441 of WO 2012/087983; Nucleotides 1-684 of SEQ ID NO: 935442 of WO 2012/087983; Nucleotides 1-400 of SEQ ID NO: 935473 of WO 2012/087983; Nucleotides 1-619 of SEQ ID NO: 935474 of WO 2012/087983; Nucleotides 1-813 of SEQ ID NO: 935475 of WO 2012/087983; Nucleotides 1-993 of SEQ ID NO: 935480 of WO 2012/087983; Nucleotides 1-401 of SEQ ID NO: 935480 of WO 2012/087983; Nucleotides 1-493 of SEQ ID NO: 935481 of WO 2012/087983; Nucleotides 1-418 of SEQ ID NO:

935482 of WO 2012/087983; Nucleotides 1-378 of SEQ ID NO: 935496 of WO 2012/087983; Nucleotides 1-294 of SEQ ID NO: 935497 of WO 2012/087983; Nucleotides 1-686 of SEQ ID NO: 935498 of WO 2012/087983; Nucleotides 1-480 of SEQ ID NO: 935499 of WO 2012/087983; Nucleotides 1-501 of SEQ ID NO: 935500 of WO 2012/087983; Nucleotides 1-1299 of SEQ ID NO: 935533 of WO 2012/087983; Nucleotides 1-918 of SEQ ID NO: 935534 of WO 2012/087983; Nucleotides 1-1550 of SEQ ID NO: 935535 of WO 2012/087983; Nucleotides 1-329 of SEQ ID NO: 935536 of WO 2012/087983; Nucleotides 1-1826 of SEQ ID NO: 935537 of WO 2012/087983; Nucleotides 1-536 of SEQ ID NO: 935538 of WO 2012/087983; Nucleotides 1-551 of SEQ ID NO: 935539 of WO 2012/087983; Nucleotides 1-672 of SEQ ID NO: 935540 of WO 2012/087983; Nucleotides 1-616 of SEQ ID NO: 935541 of WO 2012/087983; Nucleotides 1-471 of SEQ ID NO: 935542 of WO 2012/087983; Nucleotides 1-707 of SEQ ID NO: 935543 of WO 2012/087983; Nucleotides 1-741 of SEQ ID NO: 935544 of WO 2012/087983; Nucleotides 1-346 of SEQ ID NO: 935545 of WO 2012/087983; Nucleotides 1-867 of SEQ ID NO: 935546 of WO 2012/087983; Nucleotides 1-563 of SEQ ID NO: 935547 of WO 2012/087983; Nucleotides 1-970 of SEQ ID NO: 935812 of WO 2012/087983; Nucleotides 1-1117 of SEQ ID NO: 935913 of WO 2012/087983; Nucleotides 1-297 of SEQ ID NO: 935814 of WO 2012/087983; Nucleotides 1-497 of SEQ ID NO: 935827 of WO 2012/087983; Nucleotides 1-1267 of SEQ ID NO: 935843 of WO 2012/087983; Nucleotides 1-586 of SEQ ID NO: 935844 of WO 2012/087983; Nucleotides 1-741 of SEQ ID NO: 935845 of WO 2012/087983; Nucleotides 1-251 of SEQ ID NO: 935846 of WO 2012/087983; Nucleotides 1-681 of SEQ ID NO: 935847 of WO 2012/087983; Nucleotides 1-580 of SEQ ID NO: 935848 of WO 2012/087983; Nucleotides 1-534 of SEQ ID NO: 935880 of WO 2012/087983; Nucleotides 1-387 of SEQ ID NO: 935889 of WO 2012/087983; Nucleotides 1-561 of SEQ ID NO: 935890 of WO 2012/087983; Nucleotides 1-335 of SEQ ID NO: 935891 of WO 2012/087983; Nucleotides 1-613 of SEQ ID NO: 935892 of WO 2012/087983; Nucleotides 1-177 of SEQ ID NO: 935893 of WO 2012/087983; Nucleotides 1-285 of SEQ ID NO: 935894 of WO 2012/087983; Nucleotides 1-3814 of SEQ ID NO: 935921 of WO 2012/087983; Nucleotides 1-633 of SEQ ID NO: 935922 of WO 2012/087983; Nucleotides 1-497 of SEQ ID NO: 935923 Nucleotides 1-545 of SEQ ID NO: 935924 of WO 2012/087983; Nucleotides 1-413 of SEQ ID NO: 935950 of WO 2012/087983; Nucleotides 1-413 of SEQ ID NO: 935951 of WO 2012/087983; Nucleotides 1-334 of SEQ ID NO: 935962 of WO 2012/087983; Nucleotides 1-582 of SEQ ID NO: 935963 of WO 2012/087983; Nucleotides 1-416 of SEQ ID NO: 935964 of WO 2012/087983; Nucleotides 1-3591 of SEQ ID NO: 935990 of WO 2012/087983; Nucleotides 1-875 of SEQ ID NO: 935991 of WO 2012/087983; Nucleotides 1-194 of SEQ ID NO: 935992 of WO 2012/087983; Nucleotides 1-2074 of SEQ ID NO: 936003 of WO 2012/087983; Nucleotides 1-1237 of SEQ ID NO: 936004 of WO 2012/087983; Nucleotides 1-4050 of SEQ ID NO: 936013 of WO 2012/087983; Nucleotides 1-1334 of SEQ ID NO: 936014 of WO 2012/087983; Nucleotides 1-1235 of SEQ ID NO: 936048 of WO 2012/087983; Nucleotides 1-17,964 of SEQ ID NO: 936049 of WO 2012/087983; Nucleotides 1-50,003 of SEQ ID NO: 936050 of WO 2012/087983; Nucleotides 1-486 of SEQ ID NO: 936051 of WO 2012/087983; Nucleotides 1-494 of SEQ ID NO: 936052 of WO 2012/087983; Nucleotides 1-1992 of SEQ ID NO: 936053 of WO 2012/087983; Nucleotides 1-1767 of SEQ ID NO: 936054 of WO 2012/087983; Nucleotides 1-1240 of SEQ ID NO: 936059 of WO 2012/087983; Nucleotides 1-3016 of SEQ ID NO: 936074 of WO 2012/087983; Nucleotides 1-1609 of SEQ ID NO: 936075 of WO 2012/087983; Nucleotides 1-312 of SEQ ID NO: 936080 of WO 2012/087983; Nucleotides 1-243 of SEQ ID NO: 936092 of WO 2012/087983; Nucleotides 1-802 of SEQ ID NO: 936093 of WO 2012/087983; Nucleotides 1-514 of SEQ ID NO: 936102 of WO 2012/087983; Nucleotides 1-936 of SEQ ID NO: 936103 of WO 2012/087983; Nucleotides 1-1075 of SEQ ID NO: 936104 of WO 2012/087983; Nucleotides 1-823 of SEQ ID NO: 936110 of WO 2012/087983; Nucleotides 1-979 of SEQ ID NO: 936116 of WO 2012/087983; Nucleotides 1-979 of SEQ ID NO: 936123 of WO 2012/087983; Nucleotides 1-288 of SEQ ID NO: 936128 of WO 2012/087983; Nucleotides 1-437 of SEQ ID NO: 936137 of WO 2012/087983; Nucleotides 1-278 of SEQ ID NO: 936138 of WO 2012/087983; Nucleotides 1-436 of SEQ ID NO: 936139 of WO 2012/087983; Nucleotides 1-1140 of SEQ ID NO: 936140 of WO 2012/087983; Nucleotides 1-2082 of SEQ ID NO: 936146 of WO 2012/087983; Nucleotides 1-380 of SEQ ID NO: 936151 of WO 2012/087983; Nucleotides 1-742 of SEQ ID NO: 936157 of WO 2012/087983; Nucleotides 1-4246 of SEQ ID NO: 936165 of WO 2012/087983; Nucleotides 1-1028 of SEQ ID NO: 936408 of WO 2012/087983; Nucleotides 1-429 of SEQ ID NO: 936409 of WO 2012/087983; Nucleotides 1-508 of SEQ ID NO: 936410 of WO 2012/087983; Nucleotides 1-593 of SEQ ID NO: 936411 of WO 2012/087983; Nucleotides 1-373 of SEQ ID NO: 936412 of WO 2012/087983; Nucleotides 1-1713 of SEQ ID NO: 936413 of WO 2012/087983; Nucleotides 1-660 of SEQ ID NO:936414 of WO 2012/087983; Nucleotides 1-589 of SEQ ID NO: 936415 of WO 2012/087983; Nucleotides 1-726 of SEQ ID NO: 936416 of WO 2012/087983; Nucletides 1-320 of SEQ ID NO: 936417 of WO 2012/087983; Nucletides 1-616 of SEQ ID NO: 936418 of WO 2012/087983; Nucletides 1-492 of SEQ ID NO: 936419 of WO 2012/087983; Nucletides 1-428 of SEQ ID NO: 936420 of WO 2012/087983; Nucletides 1-4041 of SEQ ID NO: 936421 of WO 2012/087983; Nucleotides 1-705 of SEQ ID NO: 936422 of WO 2012/087983; Nucletides 1-2714 of SEQ ID NO: 936423 of WO 2012/087983; Nucletides 1-1757 of SEQ ID NO: 936424 of WO 2012/087983; Nucletides 1-3647 of SEQ ID NO: 936425 of WO 2012/087983; Nucleotides 1-354 of SEQ ID NO: 936426 of WO 2012/087983; Nucleotides 1-2145 of SEQ ID NO: 936427, Nucleotides 1-606 of SEQ ID NO: 936428 of WO 2012/087983; Nucleotides 1-480 of SEQ ID NO: 936429 of WO 2012/087983; Nucleotides 1-3026 of SEQ ID NO: 936430 of WO 2012/087983; Nucleotides 1-1512 of SEQ ID NO: 936431 of WO 2012/087983; Nucleotides 1-3774 of SEQ ID NO: 936432 of WO 2012/087983; Nucleotides 1-589 of SEQ ID NO: 936433.

In some of the embodiments of inhibitory nucleic acids described herein, or processes for designing or synthesizing them, the inhibitory nucleic acids will upregulate gene expression and may specifically bind or specifically hybridize or be complementary to the PRC1-binding RNA that is transcribed from the same strand as a protein coding reference gene. The inhibitory nucleic acid may bind to a region of the PRC1-binding RNA, that originates within or overlaps an intron, exon, intron-exon junction, 5' UTR, 3' UTR, a translation initiation region, or a translation termination region of a protein-coding sense-strand of a reference gene (refGene).

In some or any of the embodiments of inhibitory nucleic acids described herein, or processes for designing or syntheisizing them, the inhibitory nucleic acids will upregulate gene expression and may specifically bind or specifically hybridize or be complementary to a PRC1 binding RNA that transcribed from the opposite strand (the antisense-strand) of a protein-coding reference gene.

The inhibitory nucleic acids described herein may be modified, e.g. comprise a modified sugar moiety, a modified internucleoside linkage, a modified nucleotide and/or combinations thereof. In addition, the inhibitory nucleic acids can exhibit one or more of the following properties: do not induce substantial cleavage or degradation of the target RNA; do not cause substantially complete cleavage or degradation of the target RNA; do not activate the RNAse H pathway; do not activate RISC; do not recruit any Argonaute family protein; are not cleaved by Dicer; do not mediate alternative splicing; are not immune stimulatory; are nuclease resistant; have improved cell uptake compared to unmodified oligonucleotides; are not toxic to cells or mammals; may have improved endosomal exit; do interfere with interaction of ncRNA with PRC1, preferably the Ezh2 subunit but optionally the Suz12, Eed, RbAp46/48 subunits or accessory factors such as Jarid2; do decrease histone H3-lysine27 methylation and/or do upregulate gene expression.

In some or any of the embodiments of inhibitory nucleic acids described herein, or processes for designing or synthesizing them, the inhibitory nucleic acids may optionally exclude those that bind DNA of a promoter region, as described in Kuwabara et al., US 2005/0226848 or Li et al., US 2010/0210707 or Corey et al., U.S. Pat. No. 7,709,456 or Mattick et al., WO 2009/124341, or those that bind DNA of a 3' UTR region, as described in Corey et al., US 2010/0273863.

Inhibitory nucleic acids that are designed to interact with RNA to modulate gene expression are a distinct subset of base sequences from those that are designed to bind a DNA target (e.g., are complementary to the underlying genomic DNA sequence from which the RNA is transcribed).

This application incorporates by reference the entire disclosures of U.S. provisional Nos. 61/425,174 filed on Dec. 20, 2010, and 61/512,754 filed on Jul. 28, 2011, and International Patent Appliation Nos. PCT/US2011/060493, filed Nov. 12, 2011, and PCT/US2011/065939, filed on Dec. 19, 2011.

Unless otherwise defined, all technical and scientific terms used herein have the same meaning as commonly understood by one of ordinary skill in the art to which this invention belongs. Methods and materials are described herein for use in the present invention; other, suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

Other features and advantages of the invention will be apparent from the following detailed description and figures, and from the claims.

REFERENCE TO SEQUENCE LISTING

This application includes a Sequence Listing in .txt format, filed herewith as 29539-0159WO1_ST25.txt, a file of 67.2 MB. The entire content of this file is hereby incorporated by reference.

Table 1: Human CBX7-RNA binding sites as determined by denaturing CLIP-seq analysis in Human 293 cells. All coordinates in hg19. The columns (c) correspond to: c1, SEQ ID Number. c2, Chromosome number. c3, Read start position. c4, Read end position. c5, chromosome strand that the transcript is made from (+, top or Watson strand; −, bottom or Crick strand of each chromosome). C6, nearest gene name. c7, gene categories as defined in Example 2.

Table 2: Human LiftOver sequences corresponding to CBX7-RNA binding sites as determined by denaturing CLIP-seq analysis in mouse ES cells shown. All coordinates in hg19. CBX7-binding sites derived from CLIP-seq performed in the mouse ES cell line, 16.7, as shown in Table 3, are translated from mouse mm9 to human hg19 coordinates.

Table 3: Mouse CBX7-RNA binding sites as determined by denaturing CLIP-seq analysis in ES cells derived from

*Mus musculus.* All coordinates in mm9. CLIP-seq performed in the mouse ES cell line, EL 16.7. CBX7 binding sites in the RNA are shown.

DETAILED DESCRIPTION

The new 'denaturing' CLIP-seq (dCLIP-seq) method, which utilizes a biotin tag to enable purification of RNA-protein complexes under denaturing conditions to increase the specificity of the purification scheme, was used to capture a genome-wide pool of transcripts (>30 nt) that bind with the PRC1 complex via the CBX7 subunit. Transcriptome characterization has identified classes of medically significant targets. Many if not all of the mouse PRC1-transcripts identified herein were shown by LiftOver analysis to have direct counterparts in the human epigenome.

As demonstrated herein, at least a subset of RNAs directly interacts with PRC1 in vivo and, in many cases, the interacting subunit is a CBX protein, e.g., CBX7. In some cases, the interacting subunit is CBX2, 4, 6, or 8. CBX7 is generally expressed earlier in development in less-differentiated cells, while CBX2, 4, 6, 8 are expressed in more differentiated cells and may be more tissue-specific. The CBX family is likely to have highly overlapping RNA interactomes, because the proteins are highly similar to each other and have RNA-binding domains.

Figure 3A:
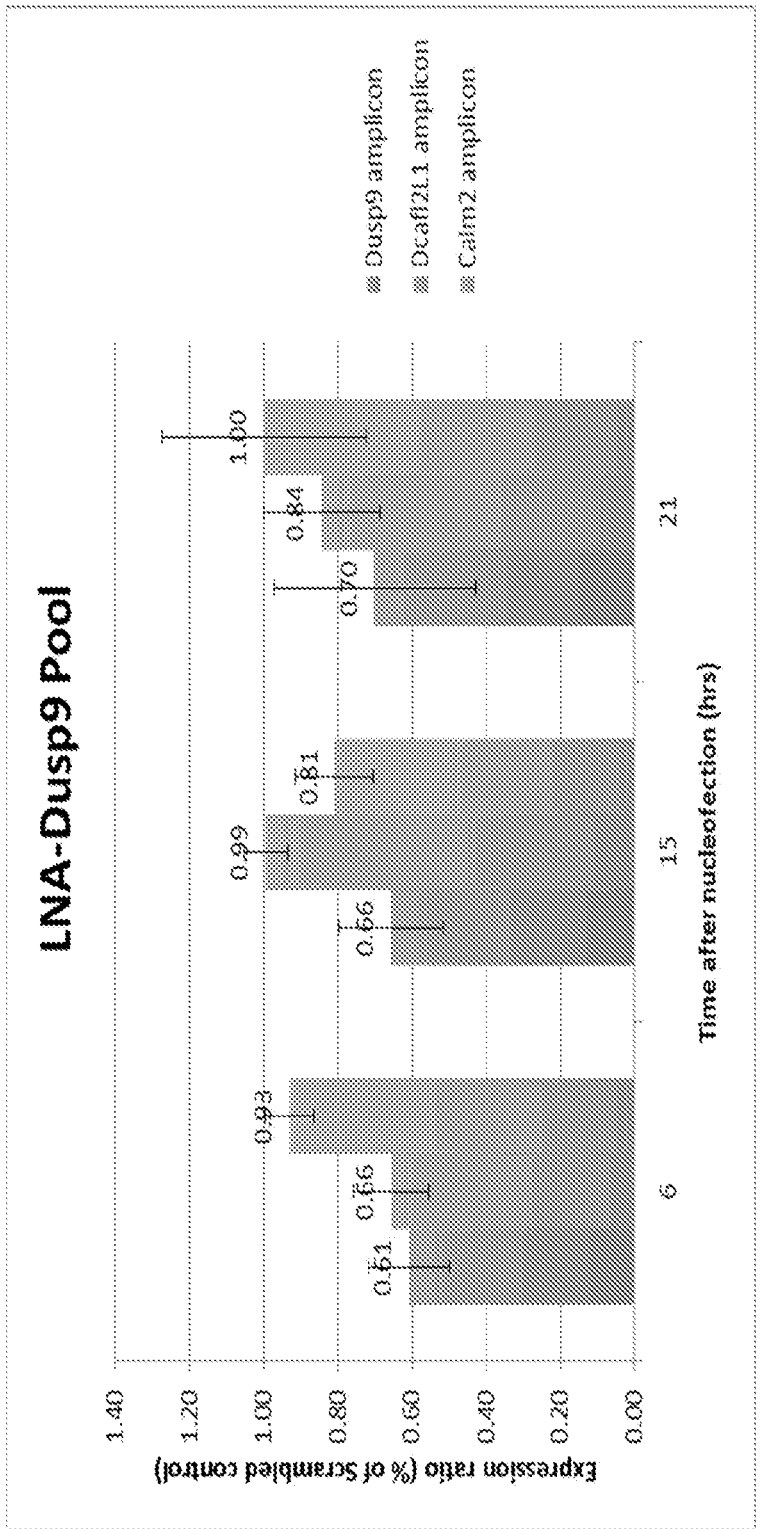
FIG. 3 is a graph showing gene upregulation as a result of disrupting PRC1-3'UTR interactions. 16.7 ES cells were nucleofected with pooled mixmer LNAs against Calmodulin 2 (Calm2) (leftmost bars) or DDB1 and CUL4 Associated Factor 12-Like 1 (Dcaf12L1) (middle bars); Dual-specific phosphatase 9 (Dusp9) was used as a negative control (right bars). Cells were harvested after 24 hours and whole cell RNA was used for quantitative gene expression analysis using real-time RT-PCR. Expression of specific transcripts was normalized to beta-actin as a reference gene.
Figure 3B:
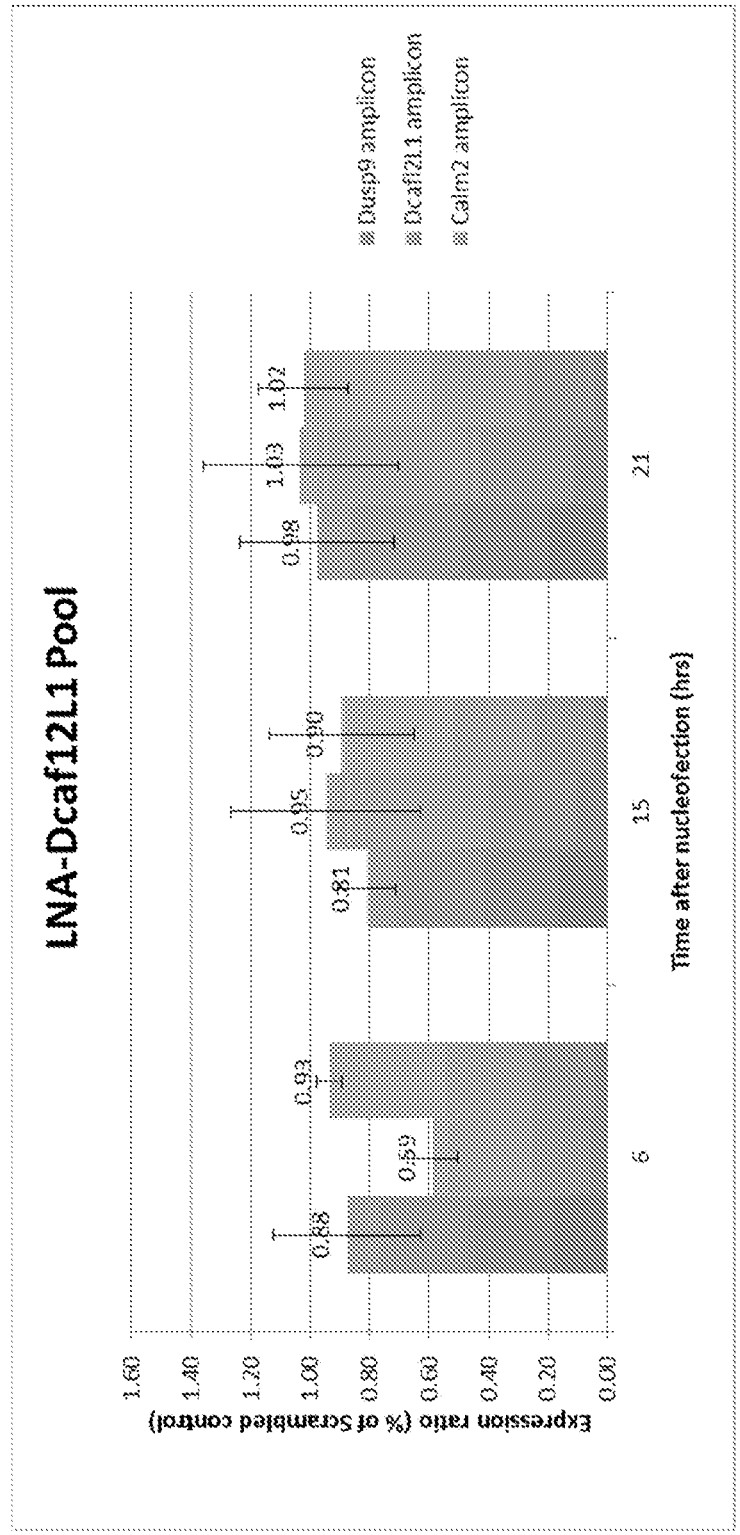
Figure 3C:
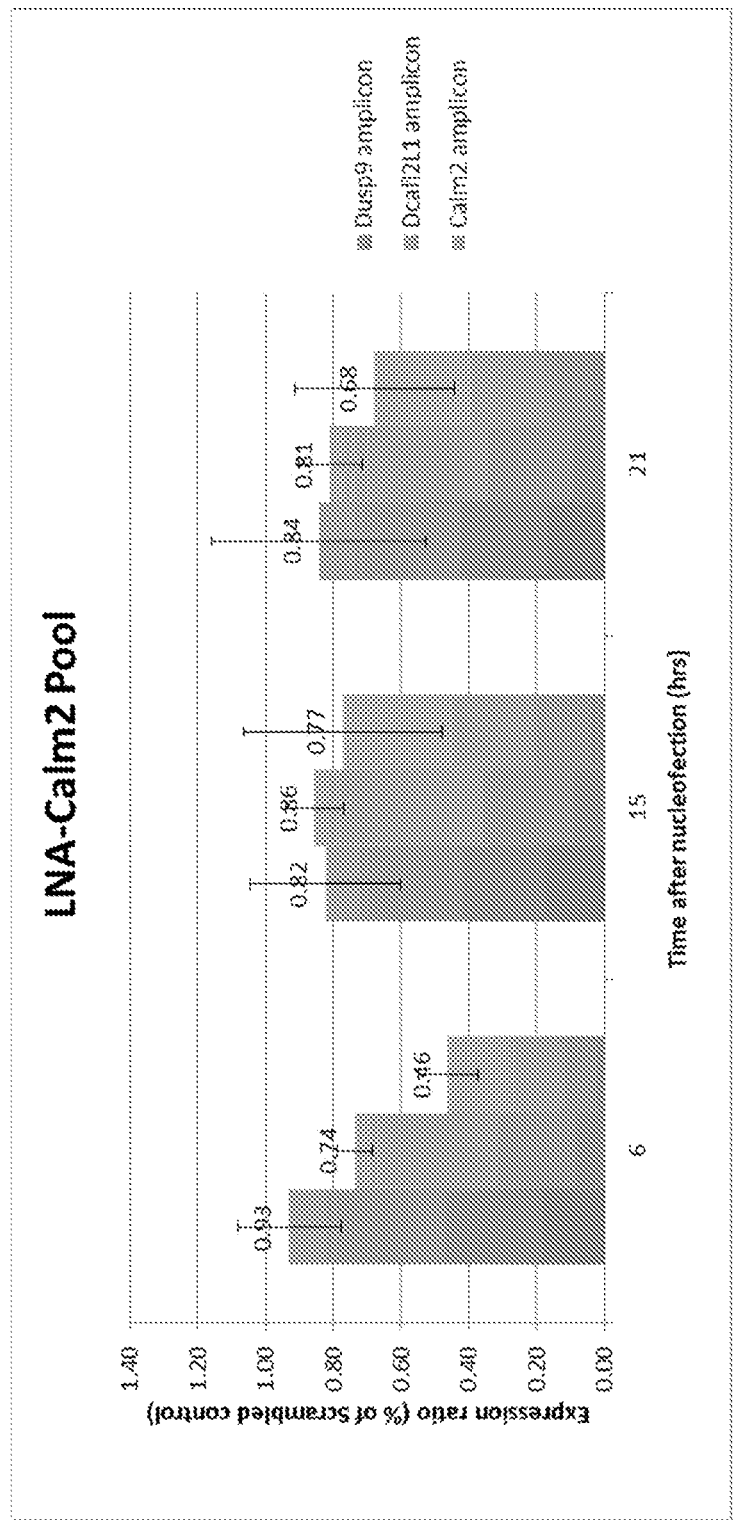

The present analysis suggests that both cis and trans mechanisms may be utilized by RNAs in the PRC1 RNA interactome. As shown herein, PRC1 has a number of different cis-regulatory effects. PRC1 binding sites can be classified into several groups, including (i) 3' untranslated region (3' UTR), (ii) promoter-associated, (iii) gene body, (iv) antisense, and (v) intergenic. Disrupting the interaction between PRC1 and a binding RNA could lead to either activation or repression. For example, targeting the PRC1 binding sites within the 3' UTR of Calm2 and Dcaf1211 results in upregulation of these coding genes (FIG. 3). Calm2 is a member of the calmodulin gene family, with three distinct calmodulin genes throughout the genome that encode an identical protein. CALM2 is a calcium binding protein that plays a role in signaling pathways, cell cycle progression and proliferation. Mutations are associated with long-QT syndrome (LQTS, life-threatening ventricular arrhythmias) with delayed neurodevelopment and epilepsy. By contrast, targeting various regions within Mecp2 and IRAK1 resulted in gene downregulation (FIGS. 5A-B). The present methods may be especially useful when one aims to titrate down but not eliminate gene expression, such as in the case of MECP2 Duplication Syndrome (a disease in which the MECP2 gene is duplicated and causes an Rett Syndrome-like disorder) or for treating autoimmune or inflammatory diseases, such as systemic lupus erythematosis (SLE), for which IRAK1 (interleukin 1 associated kinase 1) has been implicated.

As used herein, the 3'UTR is the last exon of a protein coding gene that usually includes the last few translated codons and the rest of the untranslated 3' end of the mRNA encoded by the gene.

The evidence presented herein further demonstrates that RNA cofactors are a general feature of Polycomb regulation and that inhibitory nucleic acids as described herein that target RNAs in the PRC1 RNA interactome can successfully modulate (e.g., upregulate) gene expression, with effects dependent on the target site in the interacting transcript. The effects are presumed to be caused by inhibiting PRC1-RNA interactions. Genes in cis, in either antisense-strand orientation or same strand orientation, and extending 1 kb or more, e.g. 5 or 20 kb, from the location of the PRC1-binding RNA, can be regulated. Because chromatin modifiers such as PRC1 play a central role in maintaining stem cell pluripotency and in cancer, a genome-wide profile of regulatory RNAs will be a valuable resource in the quest to diagnose and treat disease. To downregulate gene expression, targeting RNA-PRC1 interactions by antisense oligonucleotides provides an alternative approach to RNAi methods, when one aims to titrate down but not eliminate gene expression, such as in the case of MECP2 Duplication Syndrome (a disease in which the MECP2 gene is duplicated and causes an Rett Syndrome-like disorder) or for treating autoimmune or inflammatory diseases, such as systemic lupus erythematosis (SLE), for which IRAK1 (interleukin 1 associated kinase 1) has been implicated.

Denaturing CLIP-seq Methods (dCLIP-seq)

Described herein are methods for pulling down RNAs that bind to a protein of interest, to produce libraries of those RNAs, and to identify regions of the RNAs to which the proteins bind. These methods were used to identify RNAs that bind the CBX7 portion of the PRC1 complex, but can be used with any proteins known or suspected to bind RNA. In some embodiments, the methods include the steps shown in FIGS. 1A and/or 1B; one of skill in the art will appreciate that other techniques can be substituted for those shown. These include conventional CLIP (see, e.g., Davidovich et al., Mol Cell. 2015 Feb. 5; 57(3):552-8), HITS-CLIP (Darnell, Wiley Interdiscip Rev RNA. 2010 September-October; 1(2): 266-286), PAR-CLIP, iCLIP (huppertz et al., Methods. 2014 February; 65(3): 274-287), and native RIP (Zhao et al., Mol Cell. 2010 Dec. 22; 40(6):939-53).

In preferred embodiments, the methods are practiced using cells, e.g., mammalian cells, that express the bacterial biotin ligase BirA, and an RNA-binding protein of interest, e.g., CBX2, CBX4, CBX6, CBX7, or CBX8, fused to a biotinylation tag sequence. In some embodiments, the BirA and RNA binding protein are on separate vectors, preferably separate vectors with different selectable markers, e.g., different antibiotic resistance genes, or different fluorescent proteins. In some embodiments, the BirA is expressed from a first vector under neomycin resistance, and the protein of interest fused to a biotinylation tag sequence is expressed from a second vector under puromycin resistance. Biotinylation tag sequences are known in the art, see, e.g., Schatz, Biotechnology (N Y). 1993 October; 11(10):1138-43; Tucker and Grisshammer, Biochem J. 1996 Aug. 1; 317 (Pt 3):891-9; and Beckett et al., Protein Sci. 1999 April; 8(4): 921-9. An exemplary biotinylation sequence is GLNDIFEAQKIEWHE (SEQ ID NO: 36369); other sequences are known in the art, e.g., GLNDIFEAQKIEWH (SEQ ID NO: 36370); and others as disclosed in Beckett et al., Protein Science 1999, 8:921-929, e.g., in FIG. 5 and Table 2 therein. Sequences for BirA are also known in the art; see, e.g., Howard et al., Gene. 1985; 35(3):321-31. An exemplary protein sequence for BirA is as follows:

```
                              (SEQ ID NO: 36371)
        10          20          30          40
MKDNTVPLKL  IALLANGEFH  SGEQLGETLG  MSRAAINKHI 50          60          70          80
QTLRDWGVDV  FTVPGKGYSL  PEPIQLLNAK  QILGQLDGGS 90         100         110         120
VAVLPVIDST  NQYLLDRIGE  LKSGDACIAE  YQQAGRGRRG
```

-continued

```
       130        140        150        160
RKWFSPFGAN LYLSMFWRLE QGPAAAIGLS LVIGIVMAEV 170        180        190        200
LRKLGADKVR VKWPNDLYLQ DRKLAGILVE LTGKTGDAAQ 210        220        230        240
IVIGAGINMA MRRVEESVVN QGWITLQEAG INLDRNTLAA 250        260        270        280
MLIRELRAAL ELFEQEGLAP YLSRWEKLDN FINRPVKLII 290        300        310        320
GDKEIFGISR GIDKQGALLL EQDGIIKPWM GGEISLRSAE K
```

Additional exemplary sequences include those at GenBank Acc. No. NP_418404.1 and YP_491483.1; exemplary coding sequences can be found at NC_000913.3 and NC_007779.1.

Cells are crosslinked by exposure to ultraviolet (UV) light (e.g., preferably 254 nm, but a range of 200 nm to 400 nm may be possible), cellular lysates are prepared, then DNAsed to solubilize the chromatin, and protein-RNA complexes are pulled down using streptavidin beads. Importantly, the samples are then washed, preferably with a high stringency wash, e.g., using 8 M urea (range: 5-10 M, 6-10M, 7-10M, 7-9M, or 7.5-8.5M)+0.1% SDS (range: 0.0-2.0%). Other detergents may be used as substitutes for SDS, including Triton X-100 and NP40. Samples can then be further washed, e.g., in PBS+2% SDS and further in high salt buffer (e.g., PBS+750 mM NaCl+1% NP40+0.5% NaDeoxycholate+0.1% SDS; variations on salt/detergent conditions are possible). Under such suitable stringent conditions, most proteins are denatured, resulting in the loss of the nonspecific RNA-protein interactions. Only the extremely high-affinity biotin-avidin interaction survives. Thus, these steps can be used to effectively remove the vast majority of background RNA, resulting in extremely clean "peaks" of binding. The samples are then treated with DNAse to remove contaminating DNA. The RNA is phosphorylated using P32-ATP and run on SDS-PAGE and transferred onto membrane. Bands corresponding to the protein-RNA complex are then excised and eluted for cDNA preparation.

In some embodiments, the methods include contacting the sample with an agent, e.g., an antibody, that binds specifically to an RNA-binding protein or protein complex such as PRC1, e.g., to CBX7.

In some embodiments, the methods include some or all of the following: isolating the complexes; synthesizing DNA complementary to the RNAs to provide an initial population of cDNAs; PCR-amplifying, if necessary, using strand-specific primers; purifying the initial population of cDNAs to obtain a purified population of cDNAs that are at least 20 nucleotides (nt) in length; and high-throughput sequencing the purified population of cDNAs. Homopolymer reads are filtered, and reads matching the mitochondrial genome and ribosomal RNAs are excluded from all subsequent analyses. Reads that align to a reference genome with ≤1 mismatch are retained, excluding homopolymers, reads that align to the mitochondrial genome, and ribosomal RNAs. High probability PRC1-interacting transcripts are then called based on criteria that reads were significantly enriched in the wildtype library versus control library (such as a protein-null or tag-only control library, a minus-crosslinking library, or library made from an IgG pulldown done in parallel) for any given transcript. For example, under one set of criteria published in Zhao et al., 2010, the transcripts were enriched 3:1 in the wildtype library over the EZH2-null library, and each transcript had an RPKM minimum of 0.4. The criteria can be adjusted up or down based on empirical control data suggesting what cutoffs could be reasonably used. Statistical methods may also be used to call enrichment or "peaks" (binding sites) in the PRC1 library relative to control libraries, as has been used for the peaks called herein.

In general, to construct dCLIP-seq libraries, RNAs are extracted from the gel using standard techniques. To capture all RNAs (not just polyA RNAs) and to preserve strand information, 3'end-specific adapter is ligated to the extracted RNA fragments followed by hybridization with reverse transcription primer specific to 3'end adaptor and ligation of second adaptor specific to 5' end. The subsequent reverse transcription step creates first strand cDNA sequence that contains sequences complementary to the 3' and 5' adapters. The resulting PCR using 3'- and 5'-adaptor specific primer pairs is then performed to amplify the cDNAs and the products sequenced via standard methods of high throughput sequencing. Prior to sequencing, a size-selection step is incorporated in which amplified PCR products of desired sizes are excised after separation by gel electrophoresis (e.g., on a Nu-Sieve agarose gel or in an acrylamide gel) in order to remove an undesirable side products such as adapter dimers.

Kits

Provided herein are kits for use in the dCLIP-seq methods described herein. The kits can include, but are not limited to, an expression vector for expressing the bacterial biotin ligase BirA in a cell type of interest, and an expression vector for expressing RNA-binding proteins of interest, e.g., mammalian (e.g., human or mouse) RNA-binding proteins of interest PRC1 components such as CBX2, CBX4, CBX6, CBX7, CBX8, or RYPB fused in-frame to a Flag-biotinylation tag sequence. In addition to PRC1 components, PRC2 components (EZH2, EZH1, SUZ12, etc) or any other RNA-binding protein (ATRX, YY1, CTCF, as three examples) may be used as bait and fused in frame to the biotin tag. In some embodiments, the kits include buffers, e.g., a high stringency denaturing buffer, e.g., comprising 8 M urea (range: 5-10 M, 6-10M, 7-10M, 7-9M, or 7.5-8.5M) plus 0.1% SDS (range: 0.0-2.0%); wash buffer (e.g., PBS+2% SDS; high salt wash buffer (e.g., PBS+750 mM NaCl+1% NP40+0.5% NaDeoxycholate+0.1% SDS. Other detergents may be used as substitutes for SDS, including Triton X-100 and NP40; variations on salt conditions are also possible. In some embodiments, the kits include cells expressing BirA.

PRC1-Interatcting RNAs and RNA Libraries

The present invention includes the individual PRC1-binding regions of RNAs described herein, as well as libraries of RNAs produced by methods described herein. In some embodiments, the libraries are in solution, or are lyophilized. In some embodiments, the libraries are bound to a substrate, e.g., wherein each member of the library is bound to an individually addressable member, e.g., an individual area on an array (e.g., a microarray), or a bead. The PRC1 RNA interactome consists of both coding and noncoding transcripts. Non-coding PRC1-interacting RNA transcripts may also include a protein-coding sequence of bases, e.g., a distinct transcript that overlaps in position with a protein-coding reference gene (e.g., the gene whose expression is modulated in cis).

In one embodiment, an RNA includes a nucleotide sequence that is at least about 85% or more homologous or identical to the entire length of an RNA sequence shown herein, e.g., in any of Tables 1-4, or a fragment comprising at least 20 nt thereof (e.g., at least 25, 30, 35, 40, 50, 60, 70, 80, 90, or 100 nt thereof, e.g., at least 5%, 10%, 15%, 20%, 25%, 30%, 35%, 40%, 50% or more of the full length RNA). In some embodiments, the nucleotide sequence is at least about 90%, 91%, 92%, 93%, 94%, 95%, 96%, 97%, 98%, 99% or 100% homologous or identical to an RNA sequence shown herein.

Mouse-to-human LiftOver analysis and analysis in the UCSC genome browser of syntenic positions indicate the existence of similar transcripts in the human genome. This process and LiftOver chains are generally described in Kent et al., *Proc. Nat'l Acad. Sci.*, 100(20) 11484-11489 (2003). Given the geographic and sequence similarities between the mouse and human transcripts, we believe that a similar number of PRC1-interacting transcripts occur in the human system. The data suggest that many if not all of the mouse PRC1-transcripts have direct counterparts in the human epigenome. Such direct counterparts in other species are termed "orthologous" herein.

RNAs may be functionally conserved without being highly conserved at the level of overall nucleotide identity. For example, mouse Xist shows only 76% overall nucleotide identity with human XIST using sliding 21-bp windows, or an overall sequence identity of only 60%. However, within specific functional domains, the degree of conservation can be >70% between different mammalian species. The crucial motif in some RNAs (e.g., Repeat A of XIST) is the secondary structures formed by the repeat. An RNA interacting with PRC1 may therefore be similarly low in overall conservation but still have conservation in secondary structure within specific domains of the RNA, and thereby demonstrate functional conservation with respect to recruitment of PRC1.

Calculations of homology or sequence identity between sequences (the terms are used interchangeably herein) are performed as follows.

To determine the percent identity of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). The length of a reference sequence aligned for comparison purposes is at least 80% of the length of the reference sequence, and in some embodiments is at least 90% or 100%. The nucleotides at corresponding amino acid positions or nucleotide positions are then compared. When a position in the first sequence is occupied by the same nucleotide as the corresponding position in the second sequence, then the molecules are identical at that position (as used herein nucleic acid "identity" is equivalent to nucleic acid "homology"). The percent identity between the two sequences is a function of the number of identical positions shared by the sequences, taking into account the number of gaps, and the length of each gap, which need to be introduced for optimal alignment of the two sequences.

For purposes of the present invention, the comparison of sequences and determination of percent identity between two sequences can be accomplished using a Blossum 62 scoring matrix with a gap penalty of 12, a gap extend penalty of 4, and a frameshift gap penalty of 5.

There are several potential uses for the RNAs described herein in the expanded PRC1 transcriptome: The RNAs themselves, or antagomirs and small molecules designed against them, can be utilized to modulate expression (either up or down) of Polycomb target genes.

In various related aspects, including with respect to the targeting of RNAs by LNA molecule, PRC1-binding RNAs can include endogenous coding and non-coding cellular RNAs, including but not limited to those RNAs that are greater than 60 nt in length, e.g., greater than 100 nt, e.g., greater than 200 nt, have no positive-strand open reading frames greater than 100 amino acids in length, are identified as ncRNAs by experimental evidence, and are distinct from known (smaller) functional-RNA classes (including but not limited to ribosomal, transfer, and small nuclear/nucleolar RNAs, siRNA, piRNA, and miRNA). See, e.g., Lipovich et al., "MacroRNA underdogs in a microRNA world: Evolutionary, regulatory, and biomedical significance of mammalian long non-protein-coding RNA" Biochimica et Biophysica Acta (2010) doi:10.1016/j.bbagrm.2010.10.001; Ponting et al., Cell 136(4):629-641 (2009), Jia et al., RNA 16 (8) (2010) 1478-1487, Dinger et al., Nucleic Acids Res. 37 1685 (2009) D122-D126 (database issue); and references cited therein. ncRNAs have also been referred to as, and can include, long non-coding RNA, long RNA, large RNA, macro RNA, intergenic RNA, and NonCoding Transcripts.

The methods described herein can be used to target both coding and non-coding RNAs. Known classes of RNAs include large intergenic non-coding RNAs (lincRNAs, see, e.g., Guttman et al., Nature. 2009 Mar. 12; 458(7235):223-7. Epub 2009 Feb. 1, which describes over a thousand exemplary highly conserved large non-coding RNAs in mammals; and Khalil et al., PNAS 106(28)11675-11680 (2009)); promoter associated short RNAs (PASRs; see, e.g., Seila et al., Science. 2008 Dec. 19; 322(5909):1849-51. Epub 2008 Dec. 4; Kanhere et al., Molecular Cell 38, 675-688, (2010)); endogenous antisense RNAs (see, e.g., Numata et al., BMC Genomics. 10:392 (2009); Okada et al., Hum Mol Genet. 17(11):1631-40 (2008); Numata et al., Gene 392(1-2):134-141 (2007); and Røsok and Sioud, Nat Biotechnol. 22(1): 104-8 (2004)); and RNAs that bind chromatin modifiers such as PRC2 and LSD1 (see, e.g., Tsai et al., Science. 2010 Aug. 6; 329(5992):689-93. Epub 2010 Jul. 8; and Zhao et al., Science. 2008 Oct. 31; 322(5902):750-6).

Exemplary ncRNAs include XIST, TSIX, SRA1, and KCNQ10T1. The sequences for more than 17,000 long human ncRNAs can be found in the NCode™ Long ncRNA Database on the Invitrogen website. Additional long ncRNAs can be identified using, e.g., manual published literature, Functional Annotation of Mouse (FANTOM3) project, Human Full-length cDNA Annotation Invitational (H-Invitational) project, antisense ncRNAs from cDNA and EST database for mouse and human using a computation pipeline (Zhang et al., Nucl. Acids Res. 35 (suppl 1): D156-D161 (2006); Engstrom et al., PLoS Genet. 2:e47 (2006)), human snoRNAs and scaRNAs derived from snoRNA-LBME-db, RNAz (Washietl et al. 2005), Noncoding RNA Search (Torarinsson, et al. 2006), and EvoFold (Pedersen et al. 2006).

Methods of Modulating Gene Expression

The RNAs described herein, including fragments thereof that are at least 20 nt in length, and inhibitory nucleic acids and small molecules targeting (e.g., complementary to) them, can be used to modulate gene expression in a cell, e.g., a cancer cell, a stem cell, or other normal cell types for gene or epigenetic therapy. The cells can be in vitro, including ex vivo, or in vivo (e.g., in a subject who has cancer, e.g., a tumor).

The methods described herein can be used for modulating expression of oncogenes and tumor suppressors in cells, e.g., cancer cells. For example, to decrease expression of an gene (e.g., an oncogene or imprinted gene) in a cell, the methods include introducing into the cell an inhibitory nucleic acid or small molecule that specifically binds, or is complementary, to a PRC1-binding region of an RNA that increases expression of the gene, e.g., an oncogene and/or an imprinted gene, set forth in Tables 1-3. As another example, to increase expression of a gene, e.g., a tumor suppressor, in a cell, the methods include introducing into the cell an inhibitory nucleic acid or small molecule that specifically binds, or is complementary, to a PRC1-binding region of an RNA that decreases expression of the gene, e.g., of a tumor suppressor gene, set forth in Tables 1-3, e.g., in subjects with cancer, e.g., lung adenocarcinoma patients.

In general, the methods include introducing into the cell an inhibitory nucleic acid that specifically binds, or is complementary, to a region of an RNA that modulated expression of a gene as set forth in Tables 1-3.

In preferred embodiments, the inhibitory nucleic acid binds to a region within or near (e.g., within 100, 200, 300, 400, 500, 600, 700, 1K, 2K, or 5K bases of) a PRC1-binding region of the RNA as set forth in Tables 1-3. The empirically-identified "peaks," which are believed to represent PRC1-binding regions are shown in Table 1, with 500 nts of sequence on each side, so that in some the methods can include targeting a sequence as shown in one of the sequences in Tables 1-3, or a sequence that is between 500 nts from the start and 500 nts of the end of a sequence shown in Tables 1-3, or between 400 nts from the start and 400 nts of the end, 300 nts from the start and 300 nts of the end, between 200 nts from the start and 200 nts of the end, or between 100 nts from the start and 100 nts of the end, of a sequence shown in Tables 1-3. A nucleic acid that binds "specifically" binds primarily to the target RNA or related RNAs to inhibit regulatory function of the RNA but not of other non-target RNAs. The specificity of the nucleic acid interaction thus refers to its function (e.g., inhibiting the PRC1-associated repression of gene expression) rather than its hybridization capacity. Inhibitory nucleic acids may exhibit nonspecific binding to other sites in the genome or other RNAs, without interfering with binding of other regulatory proteins and without causing degradation of the non-specifically-bound RNA. Thus this nonspecific binding does not significantly affect function of other non-target RNAs and results in no significant adverse effects.

These methods can be used to treat a cancer in a subject by administering to the subject a composition (e.g., as described herein) comprising a PRC1-binding fragment of an RNA as described herein and/or an inhibitory nucleic acid that binds to an RNA (e.g., an inhibitory nucleic acid that binds to an RNA that inhibits a tumor suppressor, or cancer-suppressing gene, or imprinted gene and/or other growth-suppressing genes in any of Tables 1-3). Examples of cellular proliferative and/or differentiative disorders include cancer, e.g., carcinoma, sarcoma, metastatic disorders or hematopoietic neoplastic disorders, e.g., leukemias. A metastatic tumor can arise from a multitude of primary tumor types, including but not limited to those of prostate, colon, lung, breast and liver origin.

As used herein, treating includes "prophylactic treatment" which means reducing the incidence of or preventing (or reducing risk of) a sign or symptom of a disease in a patient at risk for the disease, and "therapeutic treatment", which means reducing signs or symptoms of a disease, reducing progression of a disease, reducing severity of a disease, in a patient diagnosed with the disease. With respect to cancer, treating includes inhibiting tumor cell proliferation, increasing tumor cell death or killing, inhibiting rate of tumor cell growth or metastasis, reducing size of tumors, reducing number of tumors, reducing number of metastases, increasing 1-year or 5-year survival rate.

As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states may be categorized as pathologic, i.e., characterizing or constituting a disease state, or may be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathologic type or stage of invasiveness. "Pathologic hyperproliferative" cells occur in disease states characterized by malignant tumor growth. Examples of non-pathologic hyperproliferative cells include proliferation of cells associated with wound repair.

The terms "cancer" or "neoplasms" include malignancies of the various organ systems, such as affecting lung (e.g. small cell, non-small cell, squamous, adenocarcinoma), breast, thyroid, lymphoid, gastrointestinal, genito-urinary tract, kidney, bladder, liver (e.g. hepatocellular cancer), pancreas, ovary, cervix, endometrium, uterine, prostate, brain, as well as adenocarcinomas which include malignancies such as most colon cancers, colorectal cancer, renal-cell carcinoma, prostate cancer and/or testicular tumors, non-small cell carcinoma of the lung, cancer of the small intestine and cancer of the esophagus.

The term "carcinoma" is art recognized and refers to malignancies of epithelial or endocrine tissues including respiratory system carcinomas, gastrointestinal system carcinomas, genitourinary system carcinomas, testicular carcinomas, breast carcinomas, prostatic carcinomas, endocrine system carcinomas, and melanomas. In some embodiments, the disease is renal carcinoma or melanoma. Exemplary carcinomas include those forming from tissue of the cervix, lung, prostate, breast, head and neck, colon and ovary. The term also includes carcinosarcomas, e.g., which include malignant tumors composed of carcinomatous and sarcomatous tissues. An "adenocarcinoma" refers to a carcinoma derived from glandular tissue or in which the tumor cells form recognizable glandular structures.

The term "sarcoma" is art recognized and refers to malignant tumors of mesenchymal derivation.

Additional examples of proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. Preferably, the diseases arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus, L. (1991) *Crit Rev. in Oncol./Hemotol.* 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Sternberg disease.

In some embodiments, specific cancers that can be treated using the methods described herein include, but are not limited to: breast, lung, prostate, CNS (e.g., glioma), salivary gland, prostate, ovarian, and leukemias (e.g., ALL, CML, or AML). Associations of these genes with a particular cancer are known in the art, e.g., as described in Futreal et al., Nat Rev Cancer. 2004; 4; 177-83; and The COSMIC (Catalogue of Somatic Mutations in Cancer) database and website, Bamford et al., Br J Cancer. 2004; 91; 355-8; see also Forbes et al., Curr Protoc Hum Genet. 2008; Chapter 10; Unit 10.11, and the COSMIC database, e.g., v. 50 (Nov. 30, 2010).

In addition, the methods described herein can be used for modulating (e.g., enhancing or decreasing) pluripotency of a stem cell and to direct stem cells down specific differentiation pathways to make endoderm, mesoderm, ectoderm, and their developmental derivatives. To increase, maintain, or enhance pluripotency, the methods include introducing into the cell an inhibitory nucleic acid that specifically binds to, or is complementary to, a PRC1-binding site on a non-coding RNA as set forth in any of Tables 1-3. Stem cells useful in the methods described herein include adult stem cells (e.g., adult stem cells obtained from the inner ear, bone marrow, mesenchyme, skin, fat, liver, muscle, or blood of a subject, e.g., the subject to be treated); embryonic stem cells, or stem cells obtained from a placenta or umbilical cord; progenitor cells (e.g., progenitor cells derived from the inner ear, bone marrow, mesenchyme, skin, fat, liver, muscle, or blood); and induced pluripotent stem cells (e.g., iPS cells).

Furthermore, the present methods can be used to treat Systemic Lupus erythematosus (SLE), an autoimmune disease that affects 1.5 million Americans (16,000 new cases per year). Ages 10-50 are the most affected, with more sufferers being female than male. SLE is a multi-organ disease; the effects include arthritis, joint pain & swelling, chest pain, fatigue, general malaise, hair loss, mouth sores, sensitivity to light, skin rash, and swollen lymph nodes. Current treatments include corticosteroids, immunosuppressants, and more recently belimumab (an inhibitor of B cell activating factor).

The causes of SLE are probably multiple, including HLA haplotypes. The interleukin 1 receptor associated kinase 1 (IRAK1) has been implicated in some patients. IRAK1 is X-linked (possibly explaining the female predominance of the disease) and is involved in immune response to foreign antigens and pathogens. IRAK1 has been associated with SLE in both adult and pediatric forms. Overexpression of IRAK1 in animal models causes SLE, and knocking out IRAK1 in mice alleviates symptoms of SLE. See, e.g., Jacob et al., Proc Natl Acad Sci USA. 2009 Apr 14; 106(15):6256-61. The present methods can include treating a subject with SLE by administering an inhibitory nucleic acid that is complementary to a PRC1-binding region on IRAK1 RNA, e.g., an LNA targeting the 3' UTR, e.g., as shown in Table 4.

Figure 2A:
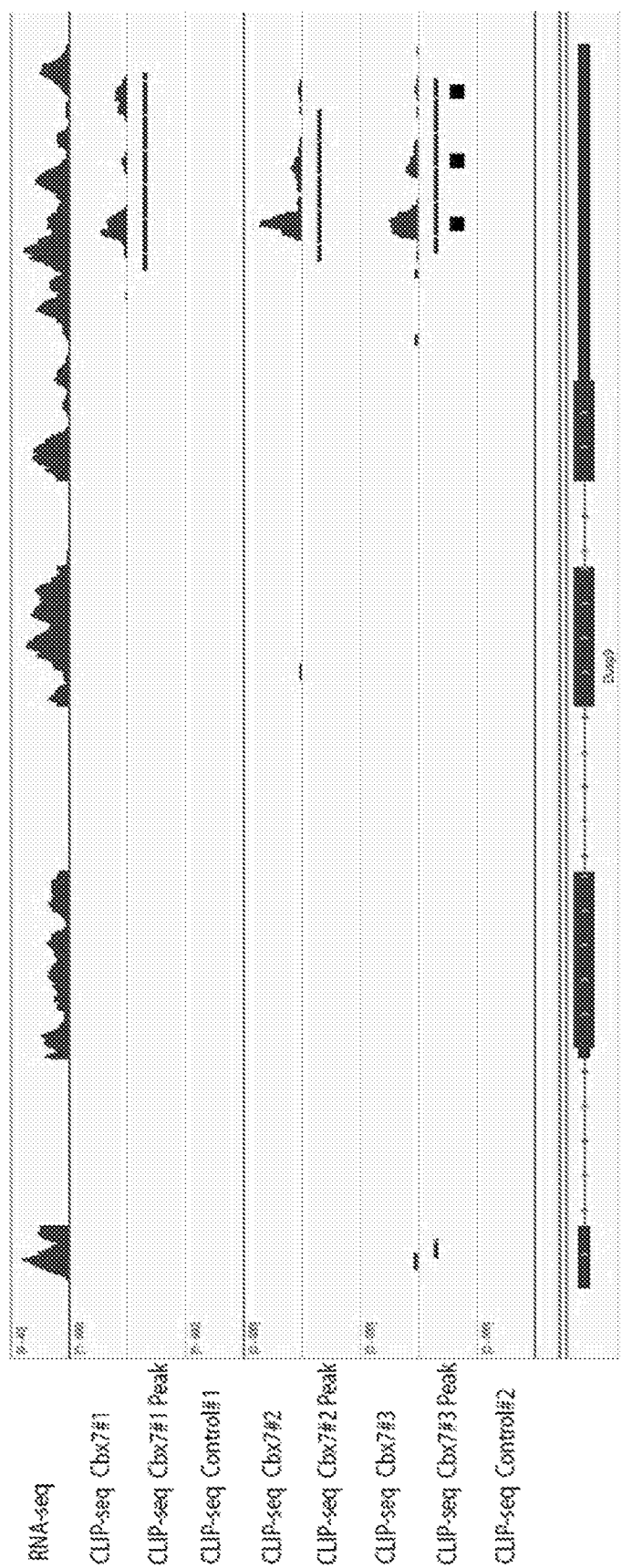
FIGS. 2A-C show four test genes for effects of disrupting PRC1-3'UTR interactions. IGV screenshots shown for three Chromobox Homolog 7 (CBX7)-binding RNAs: (2A) Mouse DDB1 and CUL4 Associated Factor 12-Like 1 (Dcaf12L1); (2B) Mouse Calmodulin 2 (Calm2); and (2C) Mouse methyl CpG binding protein 2 (Mecp2). For each gene, the RNA-seq profile shows the FPKM expression values of each gene. CLIP-seq profiles are then shown for various biological replicates (e.g., Cbx7 #1, #2, #3). For Dcaf12L1 and Calm2, statistically significant peaks ("Peak", as called by PeakRanger software) shown as bars under each replicate's track. Two control (tag-only libraries) are shown for each gene. Only the relevant strand is shown (Watson or Crick). Note highly reproducible CLIP profiles and very clean control libraries. ASO LNA mixmers used for knockoff ananlysis are shown as black bars. The mixmers were pooled for the transfections.
Figure 2B:
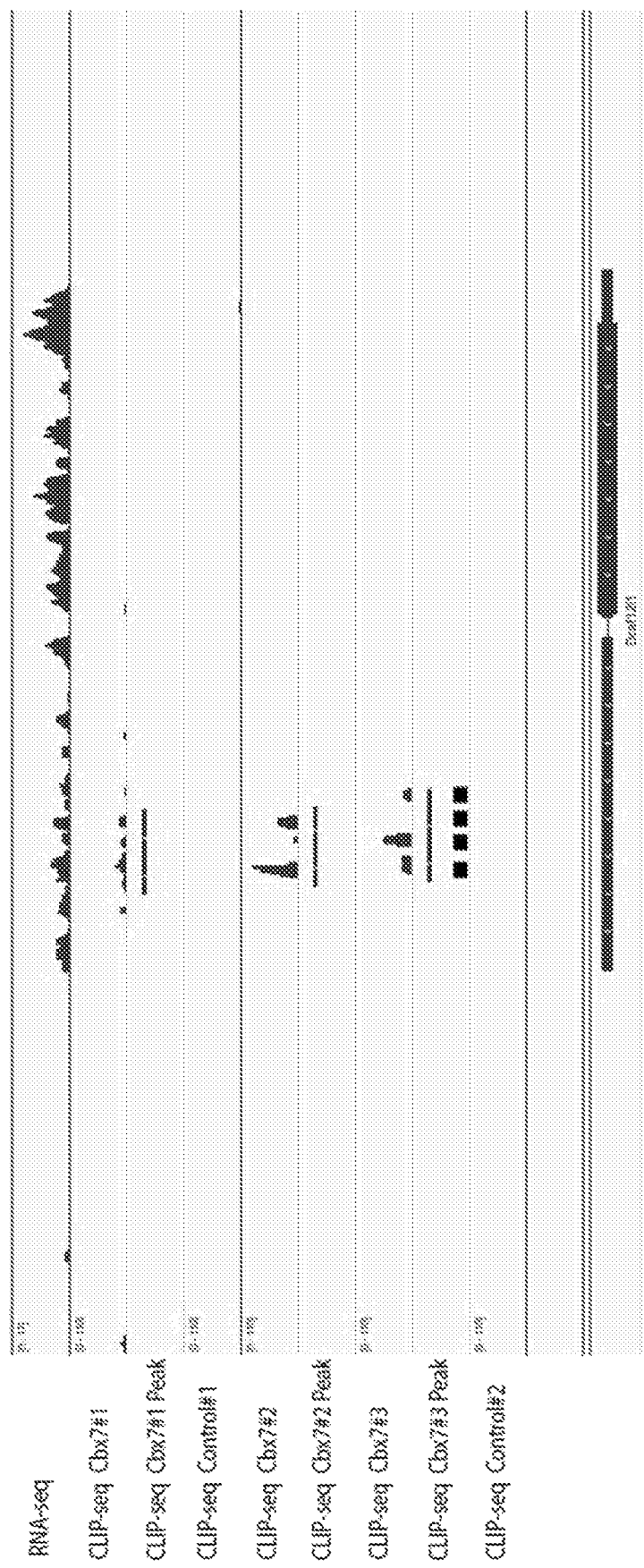
Figure 2C:
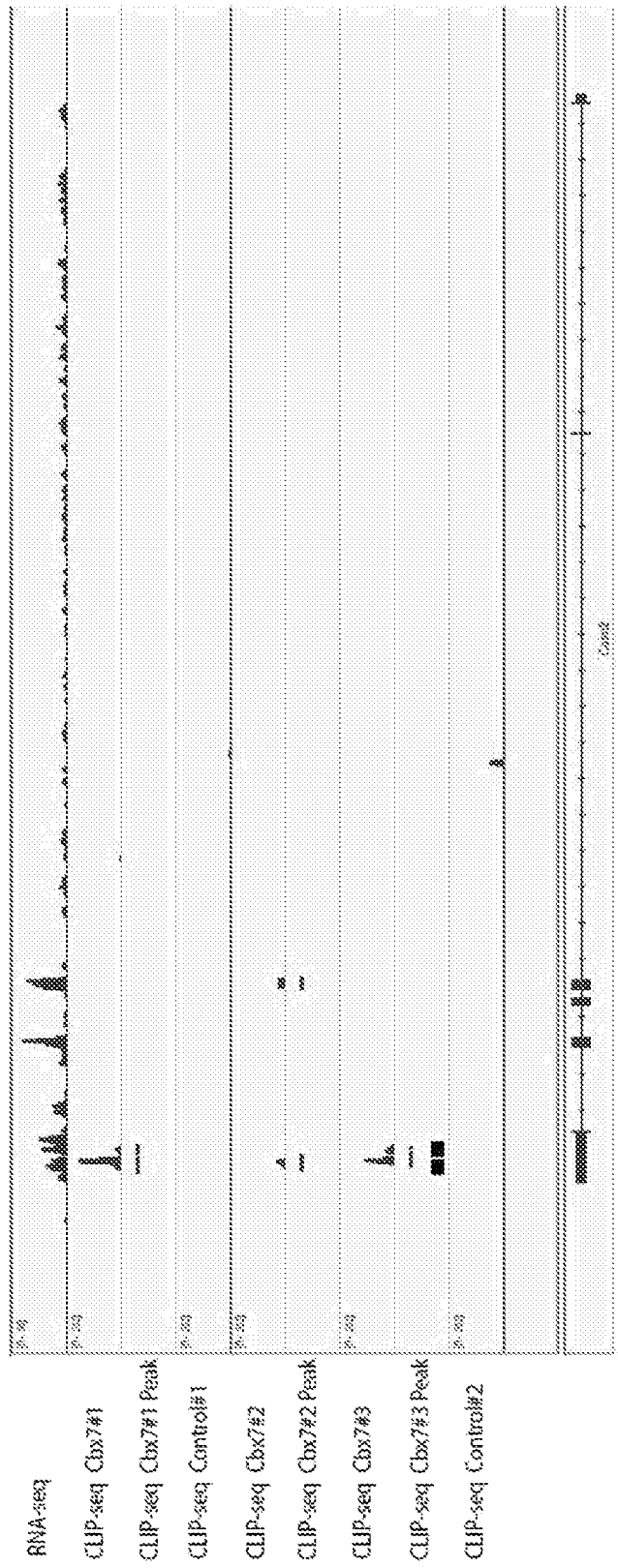

The present methods can also be used to treat MECP2 Duplication Syndrome in a subject. This condition is characterized by mental retardation, weak muscle tone, and feeding difficulties, as well as poor/absent speech, seizures, and muscle spasticity. There are more reported cases in males than in females; female carriers may have skewed XCI. There is a 50% mortality rate by age 25 associated with this condition, which accounts for 1-2% of X-linked mental retardation. The real rate of incidence is unknown, as many go undiagnosed. Genetically, the cause is duplication (even triplication) of MECP2 gene. There is no current treatment. The present methods can include treating a subject with MECP2 Duplication Syndrome by administering an inhibitory nucleic acid that is complementary to a PRC1-binding region on Mecp2 RNA, e.g., an LNA targeting the 3'UTR of Mecp2 as shown in FIG. 2C, e.g., as shown in Table 4.

In some embodiments, the methods described herein include administering a composition, e.g., a sterile composition, comprising an inhibitory nucleic acid that is complementary to a PRC1-binding region on an RNA described herein, e.g., as set forth in any of Tables 1-3, or SEQ ID NOS:1-5893 (human) or 5894-17415 (human LiftOver). Inhibitory nucleic acids for use in practicing the methods described herein can be an antisense or small interfering RNA, including but not limited to an shRNA or siRNA. In some embodiments, the inhibitory nucleic acid is a modified nucleic acid polymer (e.g., a locked nucleic acid (LNA) molecule). The present methods can include administration of a Inhibitory nucleic acids have been employed as therapeutic moieties in the treatment of disease states in animals, including humans. Inhibitory nucleic acids can be useful therapeutic modalities that can be configured to be useful in treatment regimes for the treatment of cells, tissues and animals, especially humans.

For therapeutics, an animal, preferably a human, suspected of having cancer is treated by administering an RNA or inhibitory nucleic acid in accordance with this invention. For example, in one non-limiting embodiment, the methods comprise the step of administering to the animal in need of treatment, a therapeutically effective amount of an RNA or inhibitory nucleic acid as described herein.

Inhibitory Nucleic Acids

Inhibitory nucleic acids useful in the present methods and compositions include antisense oligonucleotides, ribozymes, external guide sequence (EGS) oligonucleotides, siRNA compounds, single- or double-stranded RNA interference (RNAi) compounds such as siRNA compounds, molecules comprising modified bases, locked nucleic acid molecules (LNA molecules), antagomirs, peptide nucleic acid molecules (PNA molecules), and other oligomeric compounds or oligonucleotide mimetics which hybridize to at least a portion of the target nucleic acid and modulate its function. In some embodiments, the inhibitory nucleic acids include antisense RNA, antisense DNA, chimeric antisense oligonucleotides, antisense oligonucleotides comprising modified linkages, interference RNA (RNAi), short interfering RNA (siRNA); a micro, interfering RNA (miRNA); a small, temporal RNA (stRNA); or a short, hairpin RNA (shRNA); small RNA-induced gene activation (RNAa); small activating RNAs (saRNAs), or combinations thereof. See, e.g., WO 2010040112.

In the present methods, the inhibitory nucleic acids are preferably designed to target a specific region of the RNA that binds to PRC1, as described herein (see Tables 1-3). These "inhibitory" nucleic acids are believed to work by inhibiting the interaction between the RNA and PRC1, and as described herein can be used to modulate expression of a gene.

In some embodiments, the inhibitory nucleic acids are 10 to 50, 13 to 50, or 13 to 30 nucleotides in length. One having ordinary skill in the art will appreciate that this embodies oligonucleotides having antisense (complementary) portions of 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, or 50 nucleotides in length, or any range therewithin. It is understood that non-complementary bases may be included in such inhibitory nucleic acids; for example, an inhibitory nucleic acid 30 nucleotides in length may have a portion of 15 bases that is complementary to the targeted RNA. In some embodiments, the oligonucleotides are 15 nucleotides in length. In some embodiments, the antisense or oligonucleotide compounds of the invention are 12 or 13 to 30 nucleotides in length. One having ordinary skill in the art will appreciate that this embodies inhibitory nucleic acids having antisense (complementary) portions of 12, 13, 14, 15, 16, 17, 18, 19, 20, 21, 22, 23, 24, 25, 26, 27, 28, 29 or 30 nucleotides in length, or any range therewithin.

Preferably the inhibitory nucleic acid comprises one or more modifications comprising: a modified sugar moiety, and/or a modified internucleoside linkage, and/or a modified nucleotide and/or combinations thereof. It is not necessary for all positions in a given oligonucleotide to be uniformly modified, and in fact more than one of the modifications described herein may be incorporated in a single oligonucleotide or even at within a single nucleoside within an oligonucleotide.

In some embodiments, the inhibitory nucleic acids are chimeric oligonucleotides that contain two or more chemically distinct regions, each made up of at least one nucleotide. These oligonucleotides typically contain at least one region of modified nucleotides that confers one or more beneficial properties (such as, for example, increased nuclease resistance, increased uptake into cells, increased binding affinity for the target) and a region that is a substrate for enzymes capable of cleaving RNA:DNA or RNA:RNA hybrids. Chimeric inhibitory nucleic acids of the invention may be formed as composite structures of two or more oligonucleotides, modified oligonucleotides, oligonucleosides and/or oligonucleotide mimetics as described above. Such compounds have also been referred to in the art as hybrids or gapmers. Representative United States patents that teach the preparation of such hybrid structures comprise, but are not limited to, U.S. Pat. Nos. 5,013,830; 5,149,797; 5,220,007; 5,256,775; 5,366,878; 5,403,711; 5,491,133; 5,565,350; 5,623,065; 5,652,355; 5,652,356; and 5,700,922, each of which is herein incorporated by reference.

In some embodiments, the inhibitory nucleic acid comprises at least one nucleotide modified at the 2' position of the sugar, most preferably a 2'-O-alkyl, 2'-O-alkyl-O-alkyl or 2'-fluoro-modified nucleotide. In other preferred embodiments, RNA modifications include 2'-fluoro, 2'-amino and 2' O-methyl modifications on the ribose of pyrimidines, abasic residues or an inverted base at the 3' end of the RNA. Such modifications are routinely incorporated into oligonucleotides and these oligonucleotides have been shown to have a higher Tm (i.e., higher target binding affinity) than; 2'-deoxyoligonucleotides against a given target.

A number of nucleotide and nucleoside modifications have been shown to make the oligonucleotide into which they are incorporated more resistant to nuclease digestion than the native oligodeoxynucleotide; these modified oligos survive intact for a longer time than unmodified oligonucleotides. Specific examples of modified oligonucleotides include those comprising modified backbones, for example, phosphorothioates, phosphotriesters, methyl phosphonates, short chain alkyl or cycloalkyl intersugar linkages or short chain heteroatomic or heterocyclic intersugar linkages. Most preferred are oligonucleotides with phosphorothioate backbones and those with heteroatom backbones, particularly CH$_2$—NH—O—CH$_2$, CH, ~N(CH$_3$)~O~CH$_2$ (known as a methylene(methylimino) or MMT backbone], CH$_2$—O—N(CH$_3$)—CH$_2$, CH$_2$—N(CH$_3$)—N(CH$_3$)—CH$_2$ and O—N(CH$_3$)—CH$_2$—CH$_2$ backbones, wherein the native phosphodiester backbone is represented as O—P—O—CH,); amide backbones (see De Mesmaeker et al. Ace. Chem. Res. 1995, 28:366-374); morpholino backbone structures (see Summerton and Weller, U.S. Pat. No. 5,034,506); peptide nucleic acid (PNA) backbone (wherein the phosphodiester backbone of the oligonucleotide is replaced with a polyamide backbone, the nucleotides being bound directly or indirectly to the aza nitrogen atoms of the polyamide backbone, see Nielsen et al., Science 1991, 254, 1497). Phosphorus-containing linkages include, but are not limited to, phosphorothioates, chiral phosphorothioates, phosphorodithioates, phosphotriesters, aminoalkylphosphotriesters, methyl and other alkyl phosphonates comprising 3'alkylene phosphonates and chiral phosphonates, phosphinates, phosphoramidates comprising 3'-amino phosphoramidate and aminoalkylphosphoramidates, thionophosphoramidates, thionoalkylphosphonates, thionoalkylphosphotriesters, and boranophosphates having normal 3'-5' linkages, 2'-5' linked analogs of these, and those having inverted polarity wherein the adjacent pairs of nucleoside units are linked 3'-5' to 5'-3' or 2'-5' to 5'-2'; see U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050.

Morpholino-based oligomeric compounds are described in Dwaine A. Braasch and David R. Corey, Biochemistry, 2002, 41(14), 4503-4510); Genesis, volume 30, issue 3, 2001; Heasman, J., Dev. Biol., 2002, 243, 209-214; Nasevicius et al., Nat. Genet., 2000, 26, 216-220; Lacerra et al., Proc. Natl. Acad. Sci., 2000, 97, 9591-9596; and U.S. Pat. No. 5,034,506, issued Jul. 23, 1991. In some embodiments, the morpholino-based oligomeric compound is a phosphorodiamidate morpholino oligomer (PMO) (e.g., as described in Iverson, Curr. Opin. Mol. Ther., 3:235-238, 2001; and Wang et al., J. Gene Med., 12:354-364, 2010; the disclosures of which are incorporated herein by reference in their entireties).

Cyclohexenyl nucleic acid oligonucleotide mimetics are described in Wang et al., J. Am. Chem. Soc., 2000, 122, 8595-8602.

Modified oligonucleotide backbones that do not include a phosphorus atom therein have backbones that are formed by short chain alkyl or cycloalkyl internucleoside linkages, mixed heteroatom and alkyl or cycloalkyl internucleoside linkages, or one or more short chain heteroatomic or heterocyclic internucleoside linkages. These comprise those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and CH2 component parts; see U.S. Pat. Nos. 5,034,506; 5,166,315; 5,185,444; 5,214,134; 5,216,141; 5,235,033; 5,264,562; 5,264,564; 5,405,938; 5,434,257; 5,466,677; 5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; and 5,677,439, each of which is herein incorporated by reference.

Modified oligonucleotides are also known that include oligonucleotides that are based on or constructed from arabinonucleotide or modified arabinonucleotide residues. Arabinonucleosides are stereoisomers of ribonucleosides, differing only in the configuration at the 2'-position of the sugar ring. In some embodiments, a 2'-arabino modification is 2'-F arabino. In some embodiments, the modified oligonucleotide is 2'-fluoro-D-arabinonucleic acid (FANA) (as described in, for example, Lon et al., Biochem., 41:3457-3467, 2002 and Min et al., Bioorg. Med. Chem. Lett., 12:2651-2654, 2002; the disclosures of which are incorporated herein by reference in their entireties). Similar modifications can also be made at other positions on the sugar, particularly the 3' position of the sugar on a 3' terminal nucleoside or in 2'-5' linked oligonucleotides and the 5' position of 5' terminal nucleotide.

PCT Publication No. WO 99/67378 discloses arabinonucleic acids (ANA) oligomers and their analogues for improved sequence specific inhibition of gene expression via association to complementary messenger RNA.

Other preferred modifications include ethylene-bridged nucleic acids (ENAs) (e.g., International Patent Publication No. WO 2005/042777, Morita et al., Nucleic Acid Res., Suppl 1:241-242, 2001; Surono et al., Hum. Gene Ther., 15:749-757, 2004; Koizumi, Curr. Opin. Mol. Ther., 8:144-149, 2006 and Horie et al., Nucleic Acids Symp. Ser (Oxf), 49:171-172, 2005; the disclosures of which are incorporated herein by reference in their entireties). Preferred ENAs include, but are not limited to, 2'-O,4'-C-ethylene-bridged nucleic acids.

Examples of LNAs are described in WO 2008/043753 and include compounds of the following formula.

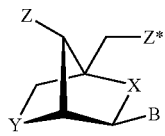

where X and Y are independently selected among the groups —O—,

—S—, —N(H)—, N(R)—, —CH$_2$— or —CH— (if part of a double bond),

—CH$_2$—O—, —CH$_2$—S—, —CH$_2$—N(H)—, —CH$_2$—N(R)—, —CH$_2$—CH$_2$— or —CH$_2$—CH— (if part of a double bond), —CH═CH—, where R is selected from hydrogen and C$_{1-4}$-alkyl; Z and Z* are independently selected among an internucleoside linkage, a terminal group or a protecting group; B constitutes a natural or non-natural nucleotide base moiety; and the asymmetric groups may be found in either orientation.

Preferably, the LNA used in the oligomer of the invention comprises at least one LNA unit according any of the formulas

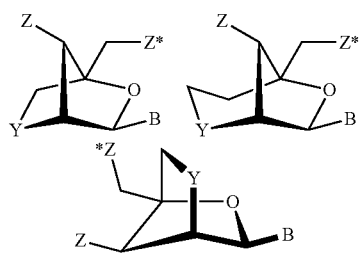

wherein Y is —O—, —S—, —NH—, or N(R$^H$); Z and Z* are independently selected among an internucleoside linkage, a terminal group or a protecting group; B constitutes a natural or non-natural nucleotide base moiety, and RH is selected from hydrogen and C$_{1-4}$-alkyl.

Preferably, the Locked Nucleic Acid (LNA) used in the oligomeric compound, such as an antisense oligonucleotide, of the invention comprises at least one nucleotide comprises a Locked Nucleic Acid (LNA) unit according any of the formulas shown in Scheme 2 of PCT/DK2006/000512.

Preferably, the LNA used in the oligomer of the invention comprises internucleoside linkages selected from —O—P(O)$_2$—O—, —O—P(O,S)—O—, —O—P(S)$_2$—O—, —S—P(O)$_2$—O—, —S—P(O,S)—O—, —S—P(S)$_2$—O—, —O—P(O)$_2$—S—, —O—P(O,S)—S—, —S—P(O)$_2$—S—, —O—PO(R$^H$)—O—, O—PO(OCH$_3$)—O—, —O—PO(NR$^H$)—O—, —O—PO(OCH$_2$CH$_2$S—R)—O—, —O—PO(BH$_3$)—O—, —O—PO(NHR$^H$)—O—, —O—P(O)$_2$—NR$^H$—, —NR$^H$—P(O)$_2$—O—, —NR$^H$—CO—O—, where R$^H$ is selected from hydrogen and C$_{1-4}$-alkyl.

Specifically preferred LNA units are shown in scheme 2:

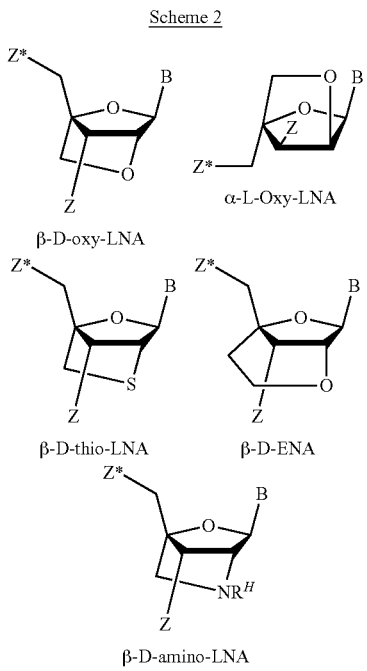

The term "thio-LNA" comprises a locked nucleotide in which at least one of X or Y in the general formula above is selected from S or —CH2-S—. Thio-LNA can be in both beta-D and alpha-L-configuration.

The term "amino-LNA" comprises a locked nucleotide in which at least one of X or Y in the general formula above is selected from —N(H)—, N(R)—, CH$_2$—N(H)—, and —CH$_2$—N(R)— where R is selected from hydrogen and C$_{1-4}$-alkyl. Amino-LNA can be in both beta-D and alpha-L-configuration.

The term "oxy-LNA" comprises a locked nucleotide in which at least one of X or Y in the general formula above represents —O— or —CH$_2$—O—. Oxy-LNA can be in both beta-D and alpha-L-configuration.

The term "ena-LNA" comprises a locked nucleotide in which Y in the general formula above is —CH$_2$—O—

(where the oxygen atom of —CH$_2$—O— is attached to the 2'-position relative to the base B).

LNAs are described in additional detail below.

One or more substituted sugar moieties can also be included, e.g., one of the following at the 2' position: OH, SH, SCH$_3$, F, OCN, OCH$_3$OCH$_3$, OCH$_3$O(CH$_2$)nCH$_3$, O(CH$_2$)nNH$_2$ or O(CH$_2$)nCH$_3$ where n is from 1 to about 10; Ci to C10 lower alkyl, alkoxyalkoxy, substituted lower alkyl, alkaryl or aralkyl; Cl; Br; CN; CF3; OCF3; O-, S-, or N-alkyl; O-, S-, or N-alkenyl; SOCH3; SO2 CH3; ONO2; NO2; N3; NH2; heterocycloalkyl; heterocycloalkaryl; aminoalkylamino; polyalkylamino; substituted silyl; an RNA cleaving group; a reporter group; an intercalator; a group for improving the pharmacokinetic properties of an oligonucleotide; or a group for improving the pharmacodynamic properties of an oligonucleotide and other sub stituents having similar properties. A preferred modification includes 2'-methoxyethoxy [2'-0-CH$_2$CH$_2$OCH$_3$, also known as 2'-O-(2-methoxyethyl)] (Martin et al, Helv. Chim. Acta, 1995, 78, 486). Other preferred modifications include 2'-methoxy (2'-0-CH$_3$), 2'-propoxy (2'-OCH$_2$CH$_2$CH$_3$) and 2'-fluoro (2'-F). Similar modifications may also be made at other positions on the oligonucleotide, particularly the 3' position of the sugar on the 3' terminal nucleotide and the 5' position of 5' terminal nucleotide. Oligonucleotides may also have sugar mimetics such as cyclobutyls in place of the pentofuranosyl group.

Inhibitory nucleic acids can also include, additionally or alternatively, nucleobase (often referred to in the art simply as "base") modifications or substitutions. As used herein, "unmodified" or "natural" nucleobases include adenine (A), guanine (G), thymine (T), cytosine (C) and uracil (U). Modified nucleobases include nucleobases found only infrequently or transiently in natural nucleic acids, e.g., hypoxanthine, 6-methyladenine, 5-Me pyrimidines, particularly 5-methylcytosine (also referred to as 5-methyl-2' deoxycytosine and often referred to in the art as 5-Me-C), 5-hydroxymethylcytosine (HMC), glycosyl HMC and gentobiosyl HMC, isocytosine, pseudoisocytosine, as well as synthetic nucleobases, e.g., 2-aminoadenine, 2-(methylamino)adenine, 2-(imidazolylalkyl)adenine, 2-(aminoalklyamino)adenine or other heterosubstituted alkyladenines, 2-thiouracil, 2-thiothymine, 5-bromouracil, 5-hydroxymethyluracil, 5-propynyluracil, 8-azaguanine, 7-deazaguanine, N6 (6-aminohexyl)adenine, 6-aminopurine, 2-aminopurine, 2-chloro-6-aminopurine and 2,6-diaminopurine or other diaminopurines. See, e.g., Kornberg, "DNA Replication," W. H. Freeman & Co., San Francisco, 1980, pp 75-77; and Gebeyehu, G., et al. Nucl. Acids Res., 15:4513 (1987)). A "universal" base known in the art, e.g., inosine, can also be included. 5-Me-C substitutions have been shown to increase nucleic acid duplex stability by 0.6-1.2<0>C. (Sanghvi, in Crooke, and Lebleu, eds., Antisense Research and Applications, CRC Press, Boca Raton, 1993, pp. 276-278) and are presently preferred base substitutions.

It is not necessary for all positions in a given oligonucleotide to be uniformly modified, and in fact more than one of the modifications described herein may be incorporated in a single oligonucleotide or even at within a single nucleoside within an oligonucleotide.

In some embodiments, both a sugar and an internucleoside linkage, i.e., the backbone, of the nucleotide units are replaced with novel groups. The base units are maintained for hybridization with an appropriate nucleic acid target compound. One such oligomeric compound, an oligonucleotide mimetic that has been shown to have excellent hybridization properties, is referred to as a peptide nucleic acid (PNA). In PNA compounds, the sugar-backbone of an oligonucleotide is replaced with an amide containing backbone, for example, an aminoethylglycine backbone. The nucleobases are retained and are bound directly or indirectly to aza nitrogen atoms of the amide portion of the backbone. Representative United States patents that teach the preparation of PNA compounds include, but are not limited to, U.S. Pat. Nos. 5,539,082; 5,714,331; and 5,719,262, each of which is herein incorporated by reference. Further teaching of PNA compounds can be found in Nielsen et al, Science, 1991, 254, 1497-1500.

Inhibitory nucleic acids can also include one or more nucleobase (often referred to in the art simply as "base") modifications or substitutions. As used herein, "unmodified" or "natural" nucleobases comprise the purine bases adenine (A) and guanine (G), and the pyrimidine bases thymine (T), cytosine (C) and uracil (U). Modified nucleobases comprise other synthetic and natural nucleobases such as 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudo-uracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylquanine and 7-methyladenine, 8-azaguanine and 8-azaadenine, 7-deazaguanine and 7-deazaadenine and 3-deazaguanine and 3-deazaadenine.

Further, nucleobases comprise those disclosed in U.S. Pat. No. 3,687,808, those disclosed in "The Concise Encyclopedia of Polymer Science And Engineering", pages 858-859, Kroschwitz, ed. John Wiley & Sons, 1990; those disclosed by Englisch et al., Angewandle Chemie, International Edition, 1991, 30, page 613, and those disclosed by Sanghvi, Chapter 15, Antisense Research and Applications," pages 289-302, Crooke, and Lebleu, eds., CRC Press, 1993. Certain of these nucleobases are particularly useful for increasing the binding affinity of the oligomeric compounds of the invention. These include 5-substituted pyrimidines, 6-azapyrimidines and N-2, N-6 and 0-6 substituted purines, comprising 2-aminopropyladenine, 5-propynyluracil and 5-propynylcytosine. 5-methylcytosine substitutions have been shown to increase nucleic acid duplex stability by 0.6-1.2<0>C (Sanghvi, et al., eds, "Antisense Research and Applications," CRC Press, Boca Raton, 1993, pp. 276-278) and are presently preferred base substitutions, even more particularly when combined with 2'-O-methoxyethyl sugar modifications. Modified nucleobases are described in U.S. Pat. No. 3,687,808, as well as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,596,091; 5,614,617; 5,750,692, and 5,681,941, each of which is herein incorporated by reference.

In some embodiments, the inhibitory nucleic acids are chemically linked to one or more moieties or conjugates that enhance the activity, cellular distribution, or cellular uptake of the oligonucleotide. For example, one or more inhibitory nucleic acids, of the same or different types, can be conjugated to each other; or inhibitory nucleic acids can be conjugated to targeting moieties with enhanced specificity for a cell type or tissue type. Such moieties include, but are not limited to, lipid moieties such as a cholesterol moiety (Letsinger et al., Proc. Natl. Acad. Sci. USA, 1989, 86, 6553-6556), cholic acid (Manoharan et al., Bioorg. Med. Chem. Let., 1994, 4, 1053-1060), a thioether, e.g., hexyl-S-tritylthiol (Manoharan et al, Ann. N. Y. Acad. Sci., 1992, 660, 306-309; Manoharan et al., Bioorg. Med. Chem. Let., 1993, 3, 2765-2770), a thiocholesterol (Oberhauser et al., Nucl. Acids Res., 1992, 20, 533-538), an aliphatic chain, e.g., dodecandiol or undecyl residues (Kabanov et al., FEBS Lett., 1990, 259, 327-330; Svinarchuk et al., Biochimie, 1993, 75, 49-54), a phospholipid, e.g., di-hexadecyl-rac-glycerol or triethylammonium 1,2-di-O-hexadecyl-rac-glycero-3-H-phosphonate (Manoharan et al., Tetrahedron Lett., 1995, 36, 3651-3654; Shea et al., Nucl. Acids Res., 1990, 18, 3777-3783), a polyamine or a polyethylene glycol chain (Mancharan et al., Nucleosides & Nucleotides, 1995, 14, 969-973), or adamantane acetic acid (Manoharan et al., Tetrahedron Lett., 1995, 36, 3651-3654), a palmityl moiety (Mishra et al., Biochim. Biophys. Acta, 1995, 1264, 229-237), or an octadecylamine or hexylamino-carbonyl-t oxy-cholesterol moiety (Crooke et al., J. Pharmacol. Exp. Ther., 1996, 277, 923-937). See also U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941, each of which is herein incorporated by reference.

These moieties or conjugates can include conjugate groups covalently bound to functional groups such as primary or secondary hydroxyl groups. Conjugate groups of the invention include intercalators, reporter molecules, polyamines, polyamides, polyethylene glycols, polyethers, groups that enhance the pharmacodynamic properties of oligomers, and groups that enhance the pharmacokinetic properties of oligomers. Typical conjugate groups include cholesterols, lipids, phospholipids, biotin, phenazine, folate, phenanthridine, anthraquinone, acridine, fluoresceins, rhodamines, coumarins, and dyes. Groups that enhance the pharmacodynamic properties, in the context of this invention, include groups that improve uptake, enhance resistance to degradation, and/or strengthen sequence-specific hybridization with the target nucleic acid. Groups that enhance the pharmacokinetic properties, in the context of this invention, include groups that improve uptake, distribution, metabolism or excretion of the compounds of the present invention. Representative conjugate groups are disclosed in International Patent Application No. PCT/US92/09196, filed Oct. 23, 1992, and U.S. Pat. No. 6,287,860, which are incorporated herein by reference. Conjugate moieties include, but are not limited to, lipid moieties such as a cholesterol moiety, cholic acid, a thioether, e.g., hexyl-5-tritylthiol, a thiocholesterol, an aliphatic chain, e.g., dodecandiol or undecyl residues, a phospholipid, e.g., di-hexadecyl-rac-glycerol or triethylammonium 1,2-di-O-hexadecyl-rac-glycero-3-H-phosphonate, a polyamine or a polyethylene glycol chain, or adamantane acetic acid, a palmityl moiety, or an octadecylamine or hexylamino-carbonyl-oxy cholesterol moiety. See, e.g., U.S. Pat. Nos. 4,828,979; 4,948,882; 5,218,105; 5,525,465; 5,541,313; 5,545,730; 5,552,538; 5,578,717; 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928 and 5,688,941.

The inhibitory nucleic acids useful in the present methods are sufficiently complementary to the target RNA, e.g., hybridize sufficiently well and with sufficient biological functional specificity, to give the desired effect. "Complementary" refers to the capacity for pairing, through base stacking and specific hydrogen bonding, between two sequences comprising naturally or non-naturally occurring (e.g., modified as described above) bases (nucleosides) or analogs thereof. For example, if a base at one position of an inhibitory nucleic acid is capable of hydrogen bonding with a base at the corresponding position of an RNA, then the bases are considered to be complementary to each other at that position. 100% complementarity is not required. As noted above, inhibitory nucleic acids can comprise universal bases, or inert abasic spacers that provide no positive or negative contribution to hydrogen bonding. Base pairings may include both canonical Watson-Crick base pairing and non-Watson-Crick base pairing (e.g., Wobble base pairing and Hoogsteen base pairing). It is understood that for complementary base pairings, adenosine-type bases (A) are complementary to thymidine-type bases (T) or uracil-type bases (U), that cytosine-type bases (C) are complementary to guanosine-type bases (G), and that universal bases such as such as 3-nitropyrrole or 5-nitroindole can hybridize to and are considered complementary to any A, C, U, or T. Nichols et al., Nature, 1994; 369:492-493 and Loakes et al., Nucleic Acids Res., 1994; 22:4039-4043. Inosine (I) has also been considered in the art to be a universal base and is considered complementary to any A, C, U, or T. See Watkins and SantaLucia, Nucl. Acids Research, 2005; 33 (19): 6258-6267.

In some embodiments, the location on a target RNA to which an inhibitory nucleic acids hybridizes is defined as a region to which a protein binding partner binds, as shown in Tables 1-3. Routine methods can be used to design an inhibitory nucleic acid that binds to this sequence with sufficient specificity. In some embodiments, the methods include using bioinformatics methods known in the art to identify regions of secondary structure, e.g., one, two, or more stem-loop structures, or pseudoknots, and selecting those regions to target with an inhibitory nucleic acid. For example, methods of designing oligonucleotides similar to the inhibitory nucleic acids described herein, and various options for modified chemistries or formats, are exemplified in Lennox and Behlke, Gene Therapy (2011) 18: 1111-1120, which is incorporated herein by reference in its entirety, with the understanding that the present disclosure does not target miRNA 'seed regions'.

While the specific sequences of certain exemplary target segments are set forth herein, one of skill in the art will recognize that these serve to illustrate and describe particular embodiments within the scope of the present invention. Additional target segments are readily identifiable by one having ordinary skill in the art in view of this disclosure. Target segments 5-500 nucleotides in length comprising a stretch of at least five (5) consecutive nucleotides within the protein binding region, or immediately adjacent thereto, are considered to be suitable for targeting as well. Target segments can include sequences that comprise at least the 5 consecutive nucleotides from the 5'-terminus of one of the protein binding regions (the remaining nucleotides being a consecutive stretch of the same RNA beginning immediately upstream of the 5'-terminus of the binding segment and continuing until the inhibitory nucleic acid contains about 5 to about 100 nucleotides). Similarly preferred target segments are represented by RNA sequences that comprise at least the 5 consecutive nucleotides from the 3'-terminus of one of the illustrative preferred target segments (the remaining nucleotides being a consecutive stretch of the same RNA beginning immediately downstream of the 3'-terminus of the target segment and continuing until the inhibitory nucleic acid contains about 5 to about 100 nucleotides). One having skill in the art armed with the sequences provided herein will be able, without undue experimentation, to identify further preferred protein binding regions to target with complementary inhibitory nucleic acids.

In the context of the present disclosure, hybridization means base stacking and hydrogen bonding, which may be Watson-Crick, Hoogsteen or reversed Hoogsteen hydrogen bonding, between complementary nucleoside or nucleotide bases. For example, adenine and thymine are complementary nucleobases which pair through the formation of hydrogen bonds. Complementary, as the term is used in the art, refers to the capacity for precise pairing between two nucleotides. For example, if a nucleotide at a certain position of an oligonucleotide is capable of hydrogen bonding with a nucleotide at the same position of a RNA molecule, then the inhibitory nucleic acid and the RNA are considered to be complementary to each other at that position. The inhibitory nucleic acids and the RNA are complementary to each other when a sufficient number of corresponding positions in each molecule are occupied by nucleotides that can hydrogen bond with each other through their bases. Thus, "specifically hybridizable" and "complementary" are terms which are used to indicate a sufficient degree of complementarity or precise pairing such that stable and specific binding occurs between the inhibitory nucleic acid and the RNA target. For example, if a base at one position of an inhibitory nucleic acid is capable of hydrogen bonding with a base at the corresponding position of a RNA, then the bases are considered to be complementary to each other at that position. 100% complementarity is not required.

It is understood in the art that a complementary nucleic acid sequence need not be 100% complementary to that of its target nucleic acid to be specifically hybridizable. A complementary nucleic acid sequence for purposes of the present methods is specifically hybridizable when binding of the sequence to the target RNA molecule interferes with the normal function of the target RNA to cause a loss of activity (e.g., inhibiting PRC1-associated repression with consequent up-regulation of gene expression) and there is a sufficient degree of complementarity to avoid non-specific binding of the sequence to non-target RNA sequences under conditions in which avoidance of the non-specific binding is desired, e.g., under physiological conditions in the case of in vivo assays or therapeutic treatment, and in the case of in vitro assays, under conditions in which the assays are performed under suitable conditions of stringency. For example, stringent salt concentration will ordinarily be less than about 750 mM NaCl and 75 mM trisodium citrate, preferably less than about 500 mM NaCl and 50 mM trisodium citrate, and more preferably less than about 250 mM NaCl and 25 mM trisodium citrate. Low stringency hybridization can be obtained in the absence of organic solvent, e.g., formamide, while high stringency hybridization can be obtained in the presence of at least about 35% formamide, and more preferably at least about 50% formamide. Stringent temperature conditions will ordinarily include temperatures of at least about 30° C., more preferably of at least about 37° C., and most preferably of at least about 42° C. Varying additional parameters, such as hybridization time, the concentration of detergent, e.g., sodium dodecyl sulfate (SDS), and the inclusion or exclusion of carrier DNA, are well known to those skilled in the art. Various levels of stringency are accomplished by combining these various conditions as needed. In a preferred embodiment, hybridization will occur at 30° C. in 750 mM NaCl, 75 mM trisodium citrate, and 1% SDS. In a more preferred embodiment, hybridization will occur at 37° C. in 500 mM NaCl, 50 mM trisodium citrate, 1% SDS, 35% formamide, and 100 µg/ml denatured salmon sperm DNA (ssDNA). In a most preferred embodiment, hybridization will occur at 42° C. in 250 mM NaCl, 25 mM trisodium citrate, 1% SDS, 50% formamide, and 200 µg/ml ssDNA. Useful variations on these conditions will be readily apparent to those skilled in the art.

For most applications, washing steps that follow hybridization will also vary in stringency. Wash stringency conditions can be defined by salt concentration and by temperature. As above, wash stringency can be increased by decreasing salt concentration or by increasing temperature. For example, stringent salt concentration for the wash steps will preferably be less than about 30 mM NaCl and 3 mM trisodium citrate, and most preferably less than about 15 mM NaCl and 1.5 mM trisodium citrate. Stringent temperature conditions for the wash steps will ordinarily include a temperature of at least about 25° C., more preferably of at least about 42° C., and even more preferably of at least about 68° C. In a preferred embodiment, wash steps will occur at 25° C. in 30 mM NaCl, 3 mM trisodium citrate, and 0.1% SDS. In a more preferred embodiment, wash steps will occur at 42° C. in 15 mM NaCl, 1.5 mM trisodium citrate, and 0.1% SDS. In a more preferred embodiment, wash steps will occur at 68° C. in 15 mM NaCl, 1.5 mM trisodium citrate, and 0.1% SDS. Additional variations on these conditions will be readily apparent to those skilled in the art. Hybridization techniques are well known to those skilled in the art and are described, for example, in Benton and Davis (Science 196:180, 1977); Grunstein and Hogness (Proc. Natl. Acad. Sci., USA 72:3961, 1975); Ausubel et al. (Current Protocols in Molecular Biology, Wiley Interscience, New York, 2001); Berger and Kimmel (Guide to Molecular Cloning Techniques, 1987, Academic Press, New York); and Sambrook et al., Molecular Cloning: A Laboratory Manual, Cold Spring Harbor Laboratory Press, New York.

In general, the inhibitory nucleic acids useful in the methods described herein have at least 80% sequence complementarity to a target region within the target nucleic acid, e.g., 90%, 95%, or 100% sequence complementarity to the target region within an RNA. For example, an antisense compound in which 18 of 20 nucleobases of the antisense oligonucleotide are complementary, and would therefore specifically hybridize, to a target region would represent 90 percent complementarity. Percent complementarity of an inhibitory nucleic acid with a region of a target nucleic acid can be determined routinely using basic local alignment search tools (BLAST programs) (Altschul et al., J. Mol. Biol., 1990, 215, 403-410; Zhang and Madden, Genome Res., 1997, 7, 649-656). Antisense and other compounds of the invention that hybridize to an RNA are identified through routine experimentation. In general the inhibitory nucleic acids must retain specificity for their target, i.e., either do not directly bind to, or do not directly significantly affect expression levels of, transcripts other than the intended target.

Target-specific effects, with corresponding target-specific functional biological effects, are possible even when the inhibitory nucleic acid exhibits non-specific binding to a large number of non-target RNAs. For example, short 8 base long inhibitory nucleic acids that are fully complementary to a RNA may have multiple 100% matches to hundreds of sequences in the genome, yet may produce target-specific effects, e.g. upregulation of a specific target gene through inhibition of PRC1 activity. 8-base inhibitory nucleic acids have been reported to prevent exon skipping with with a high degree of specificity and reduced off-target effect. See Singh et al., RNA Biol., 2009; 6(3): 341-350. 8-base inhibitory nucleic acids have been reported to interfere with miRNA activity without significant off-target effects. See Obad et al., Nature Genetics, 2011; 43: 371-378.

For further disclosure regarding inhibitory nucleic acids, please see US2010/0317718 (antisense oligos); US2010/0249052 (double-stranded ribonucleic acid (dsRNA)); US2009/0181914 and US2010/0234451 (LNA molecules); US2007/0191294 (siRNA analogues); US2008/0249039 (modified siRNA); and WO2010/129746 and WO2010/040112 (inhibitory nucleic acids).

Antisense

In some embodiments, the inhibitory nucleic acids are antisense oligonucleotides. Antisense oligonucleotides are typically designed to block expression of a DNA or RNA target by binding to the target and halting expression at the level of transcription, translation, or splicing. Antisense oligonucleotides of the present invention are complementary nucleic acid sequences designed to hybridize under stringent conditions to an RNA in vitro, and are expected to inhibit the activity of PRC1 in vivo. Thus, oligonucleotides are chosen that are sufficiently complementary to the target, i.e., that hybridize sufficiently well and with sufficient biological functional specificity, to give the desired effect.

Modified Base, Including Locked Nucleic Acids (LNAs)

In some embodiments, the inhibitory nucleic acids used in the methods described herein comprise one or more modified bonds or bases. Modified bases include phosphorothioate, methylphosphonate, peptide nucleic acids, or locked nucleic acids (LNAs). Preferably, the modified nucleotides are part of locked nucleic acid molecules, including [alpha]-L-LNAs. LNAs include ribonucleic acid analogues wherein the ribose ring is "locked" by a methylene bridge between the 2'-oxygen and the 4'-carbon—i.e., oligonucleotides containing at least one LNA monomer, that is, one 2'-O,4'-C-methylene-β-D-ribofuranosyl nucleotide. LNA bases form standard Watson-Crick base pairs but the locked configuration increases the rate and stability of the basepairing reaction (Jepsen et al., Oligonucleotides, 14, 130-146 (2004)). LNAs also have increased affinity to base pair with RNA as compared to DNA. These properties render LNAs especially useful as probes for fluorescence in situ hybridization (FISH) and comparative genomic hybridization, as knockdown tools for miRNAs, and as antisense oligonucleotides to target mRNAs or other RNAs, e.g., RNAs as described herien.

The modified base/LNA molecules can include molecules comprising 10-30, e.g., 12-24, e.g., 12, 13, 14, 15, 16, 17, 18, 19, 20, 21, 22, 23, 24, 25, 26, 27, 28, 29, or 30 nucleotides in each strand, wherein one of the strands is substantially identical, e.g., at least 80% (or more, e.g., 85%, 90%, 95%, or 100%) identical, e.g., having 3, 2, 1, or 0 mismatched nucleotide(s), to a target region in the RNA. The modified base/LNA molecules can be chemically synthesized using methods known in the art.

The modified base/LNA molecules can be designed using any method known in the art; a number of algorithms are known, and are commercially available (e.g., on the internet, for example at exiqon.com). See, e.g., You et al., Nuc. Acids. Res. 34:e60 (2006); McTigue et al., Biochemistry 43:5388-405 (2004); and Levin et al., Nuc. Acids. Res. 34:e142 (2006). For example, "gene walk" methods, similar to those used to design antisense oligos, can be used to optimize the inhibitory activity of a modified base/LNA molecule; for example, a series of oligonucleotides of 10-30 nucleotides spanning the length of a target RNA can be prepared, followed by testing for activity. Optionally, gaps, e.g., of 5-10 nucleotides or more, can be left between the LNAs to reduce the number of oligonucleotides synthesized and tested. GC content is preferably between about 30-−60%. General guidelines for designing modified base/LNA molecules are known in the art; for example, LNA sequences will bind very tightly to other LNA sequences, so it is preferable to avoid significant complementarity within an LNA molecule. Contiguous runs of three or more Gs or Cs, or more than four LNA residues, should be avoided where possible (for example, it may not be possible with very short (e.g., about 9-10 nt) oligonucleotides). In some embodiments, the LNAs are xylo-LNAs.

For additional information regarding LNA molecules see U.S. Pat. Nos. 6,268,490; 6,734,291; 6,770,748; 6,794,499; 7,034,133; 7,053,207; 7,060,809; 7,084,125; and 7,572,582; and U.S. Pre-Grant Pub. Nos. 20100267018; 20100261175; and 20100035968; Koshkin et al. Tetrahedron 54, 3607-3630 (1998); Obika et al. Tetrahedron Lett. 39, 5401-5404 (1998); Jepsen et al., Oligonucleotides 14:130-146 (2004); Kauppinen et al., Drug Disc. Today 2(3):287-290 (2005); and Ponting et al., Cell 136(4):629-641 (2009), and references cited therein.

As demonstrated herein and previously (see, e.g., WO 2012/065143 and WO 2012/087983, incorporated herein by reference), LNA molecules can be used as a valuable tool to manipulate and aid analysis of RNAs. Advantages offered by an LNA molecule-based system are the relatively low costs, easy delivery, and rapid action. While other inhibitory nucleic acids may exhibit effects after longer periods of time, LNA molecules exhibit effects that are more rapid, e.g., a comparatively early onset of activity, are fully reversible after a recovery period following the synthesis of new RNA, and occur without causing substantial or substantially complete RNA cleavage or degradation. One or more of these design properties may be desired properties of the inhibitory nucleic acids of the invention. Additionally, LNA molecules make possible the systematic targeting of domains within much longer nuclear transcripts. Although a PNA-based system has been described earlier, the effects on Xi were apparent only after 24 hours (Beletskii et al., Proc Natl Acad Sci USA. 2001; 98:9215-9220). The LNA technology enables high-throughput screens for functional analysis of non-coding RNAs and also provides a novel tool to manipulate chromatin states in vivo for therapeutic applications.

In various related aspects, the methods described herein include using LNA molecules to target RNAs for a number of uses, including as a research tool to probe the function of a specific RNA, e.g., in vitro or in vivo. The methods include selecting one or more desired RNAs, designing one or more LNA molecules that target the RNA, providing the designed LNA molecule, and administering the LNA molecule to a cell or animal. The methods can optionally include selecting a region of the RNA and designing one or more LNA molecules that target that region of the RNA.

Aberrant imprinted gene expression is implicated in several diseases including Long QT syndrome, Beckwith-Wiedemann, Prader-Willi, and Angelman syndromes, as well as behavioral disorders and carcinogenesis (see, e.g., Falls et al., Am. J. Pathol. 154:635-647 (1999); Lalande, Annu Rev Genet 30:173-195 (1996); Hall Annu Rev Med. 48:35-44 (1997)). LNA molecules can be created to treat such imprinted diseases. As one example, the long QT Syndrome can be caused by a K+ gated Calcium-channel encoded by Kcnql. This gene is regulated by its antisense counterpart, the long noncoding RNA, Kcnqlotl (Pandey et al., Mol Cell. 2008 Oct. 24; 32(2):232-46). Disease arises when Kcnqlotl is aberrantly expressed. LNA molecules can be created to downregulate Kcnqlotl, thereby restoring expression of Kcnql. As another example, LNA molecules could inhibit RNA cofactors for polycomb complex chromatin modifiers to reverse the imprinted defect.

From a commercial and clinical perspective, the timepoints between about 1 to 24 hours potentially define a window for epigenetic reprogramming. The advantage of the LNA system is that it works quickly, with a defined half-life, and is therefore reversible upon degradation of LNAs, at the same time that it provides a discrete timeframe during which epigenetic manipulations can be made. By targeting nuclear long RNAs, LNA molecules or similar polymers, e.g., xylo-LNAs, might be utilized to manipulate the chromatin state of cells in culture or in vivo, by transiently eliminating the regulatory RNA and associated proteins long enough to alter the underlying locus for therapeutic purposes. In particular, LNA molecules or similar polymers that specifically bind to, or are complementary to, PRC1-binding RNA can prevent recruitment of PRC1 to a specific chromosomal locus, in a gene-specific fashion.

LNA molecules might also be administered in vivo to treat other human diseases, such as but not limited to cancer, neurological disorders, infections, inflammation, and myotonic dystrophy. For example, LNA molecules might be delivered to tumor cells to downregulate the biologic activity of a growth-promoting or oncogenic long nuclear RNA (e.g., Gt12 or MALAT1 (Luo et al., Hepatology. 44(4):1012-24 (2006)), a RNA associated with metastasis and is frequently upregulated in cancers). Repressive RNAs downregulating tumor suppressors can also be targeted by LNA molecules to promote reexpression. For example, expression of the INK4b/ARF/INK4a tumor suppressor locus is controlled by Polycomb group proteins including PRC1 and PRC1 and repressed by the antisense noncoding RNA ANRIL (Yap et al., Mol Cell. 2010 Jun. 11; 38(5):662-74). PRC1-binding regions described herein in ANRIL can be targeted by LNA molecules to promote reexpression of the INK4b/ARF/INK4a tumor suppressor. Some ncRNAs may be positive regulators of oncogenes. Such "activating ncRNAs" have been described recently (e.g., Jpx (Tian et al., Cell. 143(3):390-403 (2010) and others (Ørom et al., Cell. 143(1):46-58 (2010)). Therefore, LNA molecules could be directed at these activating ncRNAs to downregulate oncogenes. LNA molecules could also be delivered to inflammatory cells to downregulate regulatory ncRNA that modulate the inflammatory or immune response. (e.g., LincRNA-Cox2, see Guttman et al., Nature. 458(7235):223-7. Epub 2009 Feb. 1 (2009)).

In still other related aspects, the LNA molecules targeting PRC1-binding regions in RNAs described herein can be used to create animal or cell models of conditions associated with altered gene expression (e.g., as a result of altered epigenetics).

The methods described herein may also be useful for creating animal or cell models of other conditions associated with aberrant imprinted gene expression, e.g., as noted above.

In various related aspects, the results described herein demonstrate the utility of LNA molecules for targeting RNA, for example, to transiently disrupt chromatin for purposes of reprogramming chromatin states ex vivo. Because LNA molecules stably displace RNA for hours and chromatin does not rebuild for hours thereafter, LNA molecules create a window of opportunity to manipulate the epigenetic state of specific loci ex vivo, e.g., for reprogramming of hiPS and hESC prior to stem cell therapy. For example, Gt12 controls expression of DLK1, which modulates the pluripotency of iPS cells. Low Gt12 and high DLK1 is correlated with increased pluripotency and stability in human iPS cells. Thus, LNA molecules targeting Gt12 can be used to inhibit differentiation and increase pluripotency and stability of iPS cells.

See also PCT/US11/60493, which is incorporated by reference herein in its entirety.

Interfering RNA, Including siRNA/shRNA

In some embodiments, the inhibitory nucleic acid sequence that is complementary to an RNA can be an interfering RNA, including but not limited to a small interfering RNA ("siRNA") or a small hairpin RNA ("shRNA"). Methods for constructing interfering RNAs are well known in the art. For example, the interfering RNA can be assembled from two separate oligonucleotides, where one strand is the sense strand and the other is the anti sense strand, wherein the antisense and sense strands are self-complementary (i.e., each strand comprises nucleotide sequence that is complementary to nucleotide sequence in the other strand; such as where the antisense strand and sense strand form a duplex or double stranded structure); the antisense strand comprises nucleotide sequence that is complementary to a nucleotide sequence in a target nucleic acid molecule or a portion thereof (i.e., an undesired gene) and the sense strand comprises nucleotide sequence corresponding to the target nucleic acid sequence or a portion thereof. Alternatively, interfering RNA is assembled from a single oligonucleotide, where the self-complementary sense and anti sense regions are linked by means of nucleic acid based or non-nucleic acid-based linker(s). The interfering RNA can be a polynucleotide with a duplex, asymmetric duplex, hairpin or asymmetric hairpin secondary structure, having self-complementary sense and antisense regions, wherein the antisense region comprises a nucleotide sequence that is complementary to nucleotide sequence in a separate target nucleic acid molecule or a portion thereof and the sense region having nucleotide sequence corresponding to the target nucleic acid sequence or a portion thereof. The interfering can be a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide can be processed either in vivo or in vitro to generate an active siRNA molecule capable of mediating RNA interference.

In some embodiments, the interfering RNA coding region encodes a self-complementary RNA molecule having a sense region, an antisense region and a loop region. Such an RNA molecule when expressed desirably forms a "hairpin" structure, and is referred to herein as an "shRNA." The loop region is generally between about 2 and about 10 nucleotides in length. In some embodiments, the loop region is from about 6 to about 9 nucleotides in length. In some embodiments, the sense region and the antisense region are between about 15 and about 20 nucleotides in length. Following post-transcriptional processing, the small hairpin RNA is converted into a siRNA by a cleavage event mediated by the enzyme Dicer, which is a member of the RNase III family. The siRNA is then capable of inhibiting the expression of a gene with which it shares homology. For details, see Brummelkamp et al., Science 296:550-553, (2002); Lee et al, Nature Biotechnol., 20, 500-505, (2002); Miyagishi and Taira, Nature Biotechnol 20:497-500, (2002); Paddison et al. Genes & Dev. 16:948-958, (2002); Paul, Nature Biotechnol, 20, 505-508, (2002); Sui, Proc. Natl. Acad. Sd. USA, 99(6), 5515-5520, (2002); Yu et al. Proc Natl Acad Sci USA 99:6047-6052, (2002).

The target RNA cleavage reaction guided by siRNAs is highly sequence specific. In general, siRNA containing a nucleotide sequences identical to a portion of the target nucleic acid are preferred for inhibition. However, 100% sequence identity between the siRNA and the target gene is not required to practice the present invention. Thus the invention has the advantage of being able to tolerate sequence variations that might be expected due to genetic mutation, strain polymorphism, or evolutionary divergence. For example, siRNA sequences with insertions, deletions, and single point mutations relative to the target sequence have also been found to be effective for inhibition. Alternatively, siRNA sequences with nucleotide analog substitutions or insertions can be effective for inhibition. In general the siRNAs must retain specificity for their target, i.e., must not directly bind to, or directly significantly affect expression levels of, transcripts other than the intended target.

Ribozymes

In some embodiments, the inhibitory nucleic acids are ribozymes. Trans-cleaving enzymatic nucleic acid molecules can also be used; they have shown promise as therapeutic agents for human disease (Usman & McSwiggen, 1995 Ann. Rep. Med. Chem. 30, 285-294; Christoffersen and Marr, 1995 J. Med. Chem. 38, 2023-2037). Enzymatic nucleic acid molecules can be designed to cleave specific RNA targets within the background of cellular RNA. Such a cleavage event renders the RNA non-functional.

In general, enzymatic nucleic acids with RNA cleaving activity act by first binding to a target RNA. Such binding occurs through the target binding portion of a enzymatic nucleic acid which is held in close proximity to an enzymatic portion of the molecule that acts to cleave the target RNA. Thus, the enzymatic nucleic acid first recognizes and then binds a target RNA through complementary base pairing, and once bound to the correct site, acts enzymatically to cut the target RNA. Strategic cleavage of such a target RNA will destroy its ability to direct synthesis of an encoded protein. After an enzymatic nucleic acid has bound and cleaved its RNA target, it is released from that RNA to search for another target and can repeatedly bind and cleave new targets.

Several approaches such as in vitro selection (evolution) strategies (Orgel, 1979, Proc. R. Soc. London, B 205, 435) have been used to evolve new nucleic acid catalysts capable of catalyzing a variety of reactions, such as cleavage and ligation of phosphodiester linkages and amide linkages, (Joyce, 1989, Gene, 82, 83-87; Beaudry et al., 1992, Science 257, 635-641; Joyce, 1992, Scientific American 267, 90-97; Breaker et al, 1994, TIBTECH 12, 268; Bartel et al, 1993, Science 261:1411-1418; Szostak, 1993, TIBS 17, 89-93; Kumar et al, 1995, FASEB J., 9, 1183; Breaker, 1996, Curr. Op. Biotech., 1, 442). The development of ribozymes that are optimal for catalytic activity would contribute significantly to any strategy that employs RNA-cleaving ribozymes for the purpose of regulating gene expression. The hammerhead ribozyme, for example, functions with a catalytic rate (kcat) of about 1 $min^{-1}$ in the presence of saturating (10 MM) concentrations of $Mg^{2+}$ cofactor. An artificial "RNA ligase" ribozyme has been shown to catalyze the corresponding self-modification reaction with a rate of about 100 $min^{-1}$. In addition, it is known that certain modified hammerhead ribozymes that have substrate binding arms made of DNA catalyze RNA cleavage with multiple turn-over rates that approach 100 $min^{-1}$.

Making and Using Inhibitory Nucleic Acids

The nucleic acid sequences used to practice the methods described herein, whether RNA, cDNA, genomic DNA, vectors, viruses or hybrids thereof, can be isolated from a variety of sources, genetically engineered, amplified, and/or expressed/generated recombinantly. If desired, nucleic acid sequences of the invention can be inserted into delivery vectors and expressed from transcription units within the vectors. The recombinant vectors can be DNA plasmids or viral vectors. Generation of the vector construct can be accomplished using any suitable genetic engineering techniques well known in the art, including, without limitation, the standard techniques of PCR, oligonucleotide synthesis, restriction endonuclease digestion, ligation, transformation, plasmid purification, and DNA sequencing, for example as described in Sambrook et al. Molecular Cloning: A Laboratory Manual. (1989)), Coffin et al. (Retroviruses. (1997)) and "RNA Viruses: A Practical Approach" (Alan J. Cann, Ed., Oxford University Press, (2000)).

Preferably, inhibitory nucleic acids of the invention are synthesized chemically. Nucleic acid sequences used to practice this invention can be synthesized in vitro by well-known chemical synthesis techniques, as described in, e.g., Adams (1983) J. Am. Chem. Soc. 105:661; Belousov (1997) Nucleic Acids Res. 25:3440-3444; Frenkel (1995) Free Radic. Biol. Med. 19:373-380; Blommers (1994) Biochemistry 33:7886-7896; Narang (1979) Meth. Enzymol. 68:90; Brown (1979) Meth. Enzymol. 68:109; Beaucage (1981) Tetra. Lett. 22:1859; U.S. Pat. No. 4,458,066; WO/2008/043753 and WO/2008/049085, and the refences cited therein.

Nucleic acid sequences of the invention can be stabilized against nucleolytic degradation such as by the incorporation of a modification, e.g., a nucleotide modification. For example, nucleic acid sequences of the invention includes a phosphorothioate at least the first, second, or third internucleotide linkage at the 5' or 3' end of the nucleotide sequence. As another example, the nucleic acid sequence can include a 2'-modified nucleotide, e.g., a 2'-deoxy, 2'-deoxy-2'-fluoro, 2'-O-methyl, 2'-O-methoxyethyl (2'-O-MOE), 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O—N-methylacetamido (2'-O—NMA). As another example, the nucleic acid sequence can include at least one 2'-O-methyl-modified nucleotide, and in some embodiments, all of the nucleotides include a 2'-O-methyl modification. In some embodiments, the nucleic acids are "locked," i.e., comprise nucleic acid analogues in which the ribose ring is "locked" by a methylene bridge connecting the 2'-O atom and the 4'-C atom (see, e.g., Kaupinnen et al., Drug Disc. Today 2(3):287-290 (2005); Koshkin et al., J. Am. Chem. Soc., 120(50):13252-13253 (1998)). For additional modifications see US 20100004320, US 20090298916, and US 20090143326.

It is understood that any of the modified chemistries or formats of inhibitory nucleic acids described herein can be combined with each other, and that one, two, three, four, five, or more different types of modifications can be included within the same molecule.

Techniques for the manipulation of nucleic acids used to practice this invention, such as, e.g., subcloning, labeling probes (e.g., random-primer labeling using Klenow polymerase, nick translation, amplification), sequencing, hybridization and the like are well described in the scientific and patent literature, see, e.g., Sambrook et al., Molecular Cloning; A Laboratory Manual 3d ed. (2001); Current Protocols in Molecular Biology, Ausubel et al., eds. (John Wiley & Sons, Inc., New York 2010); Kriegler, Gene Transfer and Expression: A Laboratory Manual (1990); Laboratory Techniques In Biochemistry And Molecular Biology: Hybridization With Nucleic Acid Probes, Part I. Theory and Nucleic Acid Preparation, Tijssen, ed. Elsevier, N.Y. (1993).

Pharmaceutical Compositions

The methods described herein can include the administration of pharmaceutical compositions and formulations comprising inhibitory nucleic acid sequences designed to target an RNA.

In some embodiments, the compositions are formulated with a pharmaceutically acceptable carrier. The pharmaceutical compositions and formulations can be administered parenterally, topically, orally or by local administration, such as by aerosol or transdermally. The pharmaceutical compositions can be formulated in any way and can be administered in a variety of unit dosage forms depending upon the condition or disease and the degree of illness, the general medical condition of each patient, the resulting preferred method of administration and the like. Details on techniques for formulation and administration of pharmaceuticals are well described in the scientific and patent literature, see, e.g., Remington: The Science and Practice of Pharmacy, 21st ed., 2005.

The inhibitory nucleic acids can be administered alone or as a component of a pharmaceutical formulation (composition). The compounds may be formulated for administration, in any convenient way for use in human or veterinary medicine. Wetting agents, emulsifiers and lubricants, such as sodium lauryl sulfate and magnesium stearate, as well as coloring agents, release agents, coating agents, sweetening, flavoring and perfuming agents, preservatives and antioxidants can also be present in the compositions.

Formulations of the compositions of the invention include those suitable for intradermal, inhalation, oral/nasal, topical, parenteral, rectal, and/or intravaginal administration. The formulations may conveniently be presented in unit dosage form and may be prepared by any methods well known in the art of pharmacy. The amount of active ingredient (e.g., nucleic acid sequences of this invention) which can be combined with a carrier material to produce a single dosage form will vary depending upon the host being treated, the particular mode of administration, e.g., intradermal or inhalation. The amount of active ingredient which can be combined with a carrier material to produce a single dosage form will generally be that amount of the compound which produces a therapeutic effect, e.g., an antigen specific T cell or humoral response.

Pharmaceutical formulations of this invention can be prepared according to any method known to the art for the manufacture of pharmaceuticals. Such drugs can contain sweetening agents, flavoring agents, coloring agents and preserving agents. A formulation can be admixtured with nontoxic pharmaceutically acceptable excipients which are suitable for manufacture. Formulations may comprise one or more diluents, emulsifiers, preservatives, buffers, excipients, etc. and may be provided in such forms as liquids, powders, emulsions, lyophilized powders, sprays, creams, lotions, controlled release formulations, tablets, pills, gels, on patches, in implants, etc.

Pharmaceutical formulations for oral administration can be formulated using pharmaceutically acceptable carriers well known in the art in appropriate and suitable dosages. Such carriers enable the pharmaceuticals to be formulated in unit dosage forms as tablets, pills, powder, dragees, capsules, liquids, lozenges, gels, syrups, slurries, suspensions, etc., suitable for ingestion by the patient. Pharmaceutical preparations for oral use can be formulated as a solid excipient, optionally grinding a resulting mixture, and processing the mixture of granules, after adding suitable additional compounds, if desired, to obtain tablets or dragee cores. Suitable solid excipients are carbohydrate or protein fillers include, e.g., sugars, including lactose, sucrose, mannitol, or sorbitol; starch from corn, wheat, rice, potato, or other plants; cellulose such as methyl cellulose, hydroxypropylmethyl-cellulose, or sodium carboxy-methylcellulose; and gums including arabic and tragacanth; and proteins, e.g., gelatin and collagen. Disintegrating or solubilizing agents may be added, such as the cross-linked polyvinyl pyrrolidone, agar, alginic acid, or a salt thereof, such as sodium alginate. Push-fit capsules can contain active agents mixed with a filler or binders such as lactose or starches, lubricants such as talc or magnesium stearate, and, optionally, stabilizers. In soft capsules, the active agents can be dissolved or suspended in suitable liquids, such as fatty oils, liquid paraffin, or liquid polyethylene glycol with or without stabilizers.

Aqueous suspensions can contain an active agent (e.g., nucleic acid sequences of the invention) in admixture with excipients suitable for the manufacture of aqueous suspensions, e.g., for aqueous intradermal injections. Such excipients include a suspending agent, such as sodium carboxymethylcellulose, methylcellulose, hydroxypropylmethylcellulose, sodium alginate, polyvinylpyrrolidone, gum tragacanth and gum acacia, and dispersing or wetting agents such as a naturally occurring phosphatide (e.g., lecithin), a condensation product of an alkylene oxide with a fatty acid (e.g., polyoxyethylene stearate), a condensation product of ethylene oxide with a long chain aliphatic alcohol (e.g., heptadecaethylene oxycetanol), a condensation product of ethylene oxide with a partial ester derived from a fatty acid and a hexitol (e.g., polyoxyethylene sorbitol mono-oleate), or a condensation product of ethylene oxide with a partial ester derived from fatty acid and a hexitol anhydride (e.g., polyoxyethylene sorbitan mono-oleate). The aqueous suspension can also contain one or more preservatives such as ethyl or n-propyl p-hydroxybenzoate, one or more coloring agents, one or more flavoring agents and one or more sweetening agents, such as sucrose, aspartame or saccharin. Formulations can be adjusted for osmolarity.

In some embodiments, oil-based pharmaceuticals are used for administration of nucleic acid sequences of the invention. Oil-based suspensions can be formulated by suspending an active agent in a vegetable oil, such as arachis oil, olive oil, sesame oil or coconut oil, or in a mineral oil such as liquid paraffin; or a mixture of these. See e.g., U.S. Pat. No. 5,716,928 describing using essential oils or essential oil components for increasing bioavailability and reducing inter- and intra-individual variability of orally administered hydrophobic pharmaceutical compounds (see also U.S. Pat. No. 5,858,401). The oil suspensions can contain a thickening agent, such as beeswax, hard paraffin or cetyl alcohol. Sweetening agents can be added to provide a palatable oral preparation, such as glycerol, sorbitol or sucrose. These formulations can be preserved by the addition of an antioxidant such as ascorbic acid. As an example of an injectable oil vehicle, see Minto (1997) J. Pharmacol. Exp. Ther. 281:93-102.

Pharmaceutical formulations can also be in the form of oil-in-water emulsions. The oily phase can be a vegetable oil or a mineral oil, described above, or a mixture of these. Suitable emulsifying agents include naturally-occurring gums, such as gum acacia and gum tragacanth, naturally occurring phosphatides, such as soybean lecithin, esters or partial esters derived from fatty acids and hexitol anhydrides, such as sorbitan mono-oleate, and condensation products of these partial esters with ethylene oxide, such as polyoxyethylene sorbitan mono-oleate. The emulsion can also contain sweetening agents and flavoring agents, as in the formulation of syrups and elixirs. Such formulations can also contain a demulcent, a preservative, or a coloring agent. In alternative embodiments, these injectable oil-in-water emulsions of the invention comprise a paraffin oil, a sorbitan monooleate, an ethoxylated sorbitan monooleate and/or an ethoxylated sorbitan trioleate.

The pharmaceutical compounds can also be administered by in intranasal, intraocular and intravaginal routes including suppositories, insufflation, powders and aerosol formulations (for examples of steroid inhalants, see e.g., Rohatagi (1995) J. Clin. Pharmacol. 35:1187-1193; Tjwa (1995) Ann. Allergy Asthma Immunol. 75:107-111). Suppositories formulations can be prepared by mixing the drug with a suitable non-irritating excipient which is solid at ordinary temperatures but liquid at body temperatures and will therefore melt in the body to release the drug. Such materials are cocoa butter and polyethylene glycols.

In some embodiments, the pharmaceutical compounds can be delivered transdermally, by a topical route, formulated as applicator sticks, solutions, suspensions, emulsions, gels, creams, ointments, pastes, jellies, paints, powders, and aerosols.

In some embodiments, the pharmaceutical compounds can also be delivered as microspheres for slow release in the body. For example, microspheres can be administered via intradermal injection of drug which slowly release subcutaneously; see Rao (1995) J. Biomater Sci. Polym. Ed. 7:623-645; as biodegradable and injectable gel formulations, see, e.g., Gao (1995) Pharm. Res. 12:857-863 (1995); or, as microspheres for oral administration, see, e.g., Eyles (1997) J. Pharm. Pharmacol. 49:669-674.

In some embodiments, the pharmaceutical compounds can be parenterally administered, such as by intravenous (IV) administration or administration into a body cavity or lumen of an organ. These formulations can comprise a solution of active agent dissolved in a pharmaceutically acceptable carrier. Acceptable vehicles and solvents that can be employed are water and Ringer's solution, an isotonic sodium chloride. In addition, sterile fixed oils can be employed as a solvent or suspending medium. For this purpose any bland fixed oil can be employed including synthetic mono- or diglycerides. In addition, fatty acids such as oleic acid can likewise be used in the preparation of injectables. These solutions are sterile and generally free of undesirable matter. These formulations may be sterilized by conventional, well known sterilization techniques. The formulations may contain pharmaceutically acceptable auxiliary substances as required to approximate physiological conditions such as pH adjusting and buffering agents, toxicity adjusting agents, e.g., sodium acetate, sodium chloride, potassium chloride, calcium chloride, sodium lactate and the like. The concentration of active agent in these formulations can vary widely, and will be selected primarily based on fluid volumes, viscosities, body weight, and the like, in accordance with the particular mode of administration selected and the patient's needs. For IV administration, the formulation can be a sterile injectable preparation, such as a sterile injectable aqueous or oleaginous suspension. This suspension can be formulated using those suitable dispersing or wetting agents and suspending agents. The sterile injectable preparation can also be a suspension in a nontoxic parenterally-acceptable diluent or solvent, such as a solution of 1,3-butanediol. The administration can be by bolus or continuous infusion (e.g., substantially uninterrupted introduction into a blood vessel for a specified period of time).

In some embodiments, the pharmaceutical compounds and formulations can be lyophilized. Stable lyophilized formulations comprising an inhibitory nucleic acid can be made by lyophilizing a solution comprising a pharmaceutical of the invention and a bulking agent, e.g., mannitol, trehalose, raffinose, and sucrose or mixtures thereof. A process for preparing a stable lyophilized formulation can include lyophilizing a solution about 2.5 mg/mL protein, about 15 mg/mL sucrose, about 19 mg/mL NaCl, and a sodium citrate buffer having a pH greater than 5.5 but less than 6.5. See, e.g., U.S. 20040028670.

The compositions and formulations can be delivered by the use of liposomes. By using liposomes, particularly where the liposome surface carries ligands specific for target cells, or are otherwise preferentially directed to a specific organ, one can focus the delivery of the active agent into target cells in vivo. See, e.g., U.S. Pat. Nos. 6,063,400; 6,007,839; Al-Muhammed (1996) J. Microencapsul. 13:293-306; Chonn (1995) Curr. Opin. Biotechnol. 6:698-708; Ostro (1989) Am. J. Hosp. Pharm. 46:1576-1587. As used in the present invention, the term "liposome" means a vesicle composed of amphiphilic lipids arranged in a bilayer or bilayers. Liposomes are unilamellar or multilamellar vesicles that have a membrane formed from a lipophilic material and an aqueous interior that contains the composition to be delivered. Cationic liposomes are positively charged liposomes that are believed to interact with negatively charged DNA molecules to form a stable complex. Liposomes that are pH-sensitive or negatively-charged are believed to entrap DNA rather than complex with it. Both cationic and noncationic liposomes have been used to deliver DNA to cells.

Liposomes can also include "sterically stabilized" liposomes, i.e., liposomes comprising one or more specialized lipids. When incorporated into liposomes, these specialized lipids result in liposomes with enhanced circulation lifetimes relative to liposomes lacking such specialized lipids. Examples of sterically stabilized liposomes are those in which part of the vesicle-forming lipid portion of the liposome comprises one or more glycolipids or is derivatized with one or more hydrophilic polymers, such as a polyethylene glycol (PEG) moiety. Liposomes and their uses are further described in U.S. Pat. No. 6,287,860.

The formulations of the invention can be administered for prophylactic and/or therapeutic treatments. In some embodiments, for therapeutic applications, compositions are administered to a subject who is need of reduced triglyceride levels, or who is at risk of or has a disorder described herein, in an amount sufficient to cure, alleviate or partially arrest the clinical manifestations of the disorder or its complications; this can be called a therapeutically effective amount. For example, in some embodiments, pharmaceutical compositions of the invention are administered in an amount sufficient to decrease serum levels of triglycerides in the subject.

The amount of pharmaceutical composition adequate to accomplish this is a therapeutically effective dose. The dosage schedule and amounts effective for this use, i.e., the dosing regimen, will depend upon a variety of factors, including the stage of the disease or condition, the severity of the disease or condition, the general state of the patient's health, the patient's physical status, age and the like. In calculating the dosage regimen for a patient, the mode of administration also is taken into consideration.

The dosage regimen also takes into consideration pharmacokinetics parameters well known in the art, i.e., the active agents' rate of absorption, bioavailability, metabolism, clearance, and the like (see, e.g., Hidalgo-Aragones (1996) J. Steroid Biochem. Mol. Biol. 58:611-617; Groning (1996) Pharmazie 51:337-341; Fotherby (1996) Contraception 54:59-69; Johnson (1995) J. Pharm. Sci. 84:1144-1146; Rohatagi (1995) Pharmazie 50:610-613; Brophy (1983) Eur. J. Clin. Pharmacol. 24:103-108; Remington: The Science and Practice of Pharmacy, 21st ed., 2005). The state of the art allows the clinician to determine the dosage regimen for each individual patient, active agent and disease or condition treated. Guidelines provided for similar compositions used as pharmaceuticals can be used as guidance to determine the dosage regiment, i.e., dose schedule and dosage levels, administered practicing the methods of the invention are correct and appropriate.

Single or multiple administrations of formulations can be given depending on for example: the dosage and frequency as required and tolerated by the patient, the degree and amount of therapeutic effect generated after each administration (e.g., effect on tumor size or growth), and the like. The formulations should provide a sufficient quantity of active agent to effectively treat, prevent or ameliorate conditions, diseases or symptoms.

In alternative embodiments, pharmaceutical formulations for oral administration are in a daily amount of between about 1 to 100 or more mg per kilogram of body weight per day. Lower dosages can be used, in contrast to administration orally, into the blood stream, into a body cavity or into a lumen of an organ. Substantially higher dosages can be used in topical or oral administration or administering by powders, spray or inhalation. Actual methods for preparing parenterally or non-parenterally administrable formulations will be known or apparent to those skilled in the art and are described in more detail in such publications as Remington: The Science and Practice of Pharmacy, 21st ed., 2005.

Various studies have reported successful mammalian dosing using complementary nucleic acid sequences. For example, Esau C., et al., (2006) Cell Metabolism, 3(2):87-98 reported dosing of normal mice with intraperitoneal doses of miR-122 antisense oligonucleotide ranging from 12.5 to 75 mg/kg twice weekly for 4 weeks. The mice appeared healthy and normal at the end of treatment, with no loss of body weight or reduced food intake. Plasma transaminase levels were in the normal range (AST ¾ 45, ALT ¾ 35) for all doses with the exception of the 75 mg/kg dose of miR-122 ASO, which showed a very mild increase in ALT and AST levels. They concluded that 50 mg/kg was an effective, non-toxic dose. Another study by Krutzfeldt J., et al., (2005) Nature 438, 685-689, injected anatgomirs to silence miR-122 in mice using a total dose of 80, 160 or 240 mg per kg body weight. The highest dose resulted in a complete loss of miR-122 signal. In yet another study, locked nucleic acid molecules ("LNA molecules") were successfully applied in primates to silence miR-122. Elmen J., et al., (2008) Nature 452, 896-899, report that efficient silencing of miR-122 was achieved in primates by three doses of 10 mg kg-1 LNA-antimiR, leading to a long-lasting and reversible decrease in total plasma cholesterol without any evidence for LNA-associated toxicities or histopathological changes in the study animals.

In some embodiments, the methods described herein can include co-administration with other drugs or pharmaceuticals, e.g., compositions for providing cholesterol homeostasis. For example, the inhibitory nucleic acids can be co-administered with drugs for treating or reducing risk of a disorder described herein.

EXAMPLES

The invention is further described in the following examples, which do not limit the scope of the invention described in the claims.

Example 1. A Denaturing CLIP-seq Method for Identifying RNA Interactomes of Chromatin Complexes with High Specificity PRC1 is Polycomb Repressive Complex 1, a Polycomb complex that is biochemically distinct from PRC2. PRC1 is the ezymatic complex that ubiquitylates histone H2A at lysine 119 (H2AK119Ub). Action of PRC1 on chromatin results in chromatin compaction and transcriptional repression. Although PRC1 binds thousands of sites in the mammalian genome, how PRC1 is targeted to chromatin has remained a mystery. YY1 may recruit PRC1 in some contexts, but is unlikely to be the general mechanism. RNA-mediated targeting is another potential mechanism. PRC1 is known to interact with at least one RNA-ANRIL (Yap et al., Mol Cell. 2010 Jun. 11; 38(5):662-74). This example describes methods that were developed to determing how many RNAs interact with PRC1 and whether they are a general recruiting tool for PRC1.

Figure 1A:
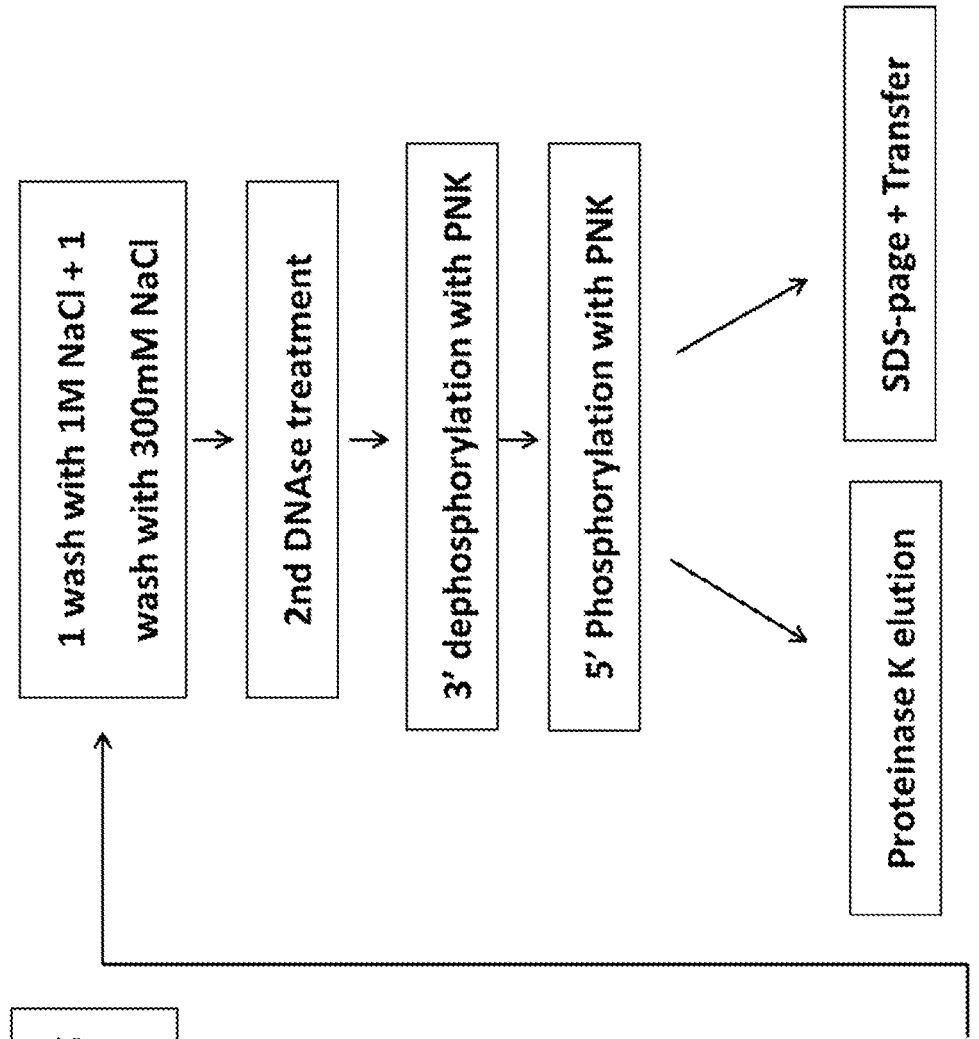
FIGS. 1A-B are schematics of exemplary denaturing CLIP (dCLIP) pull-down methods (1A) and library preparation methods (1B).
Figure 1A:
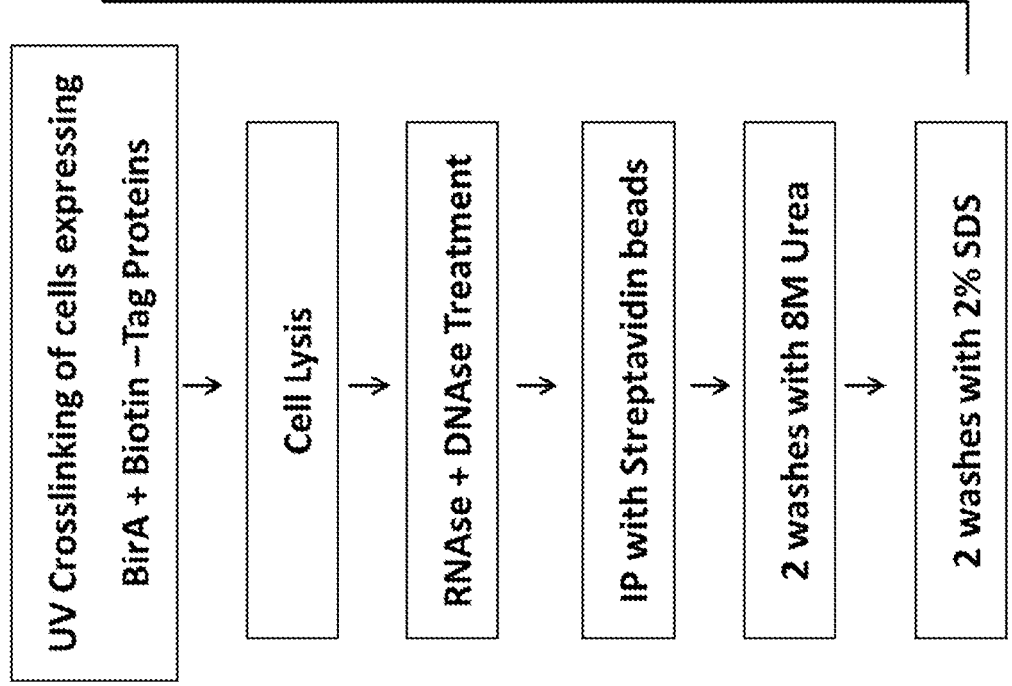
Figure 1B:
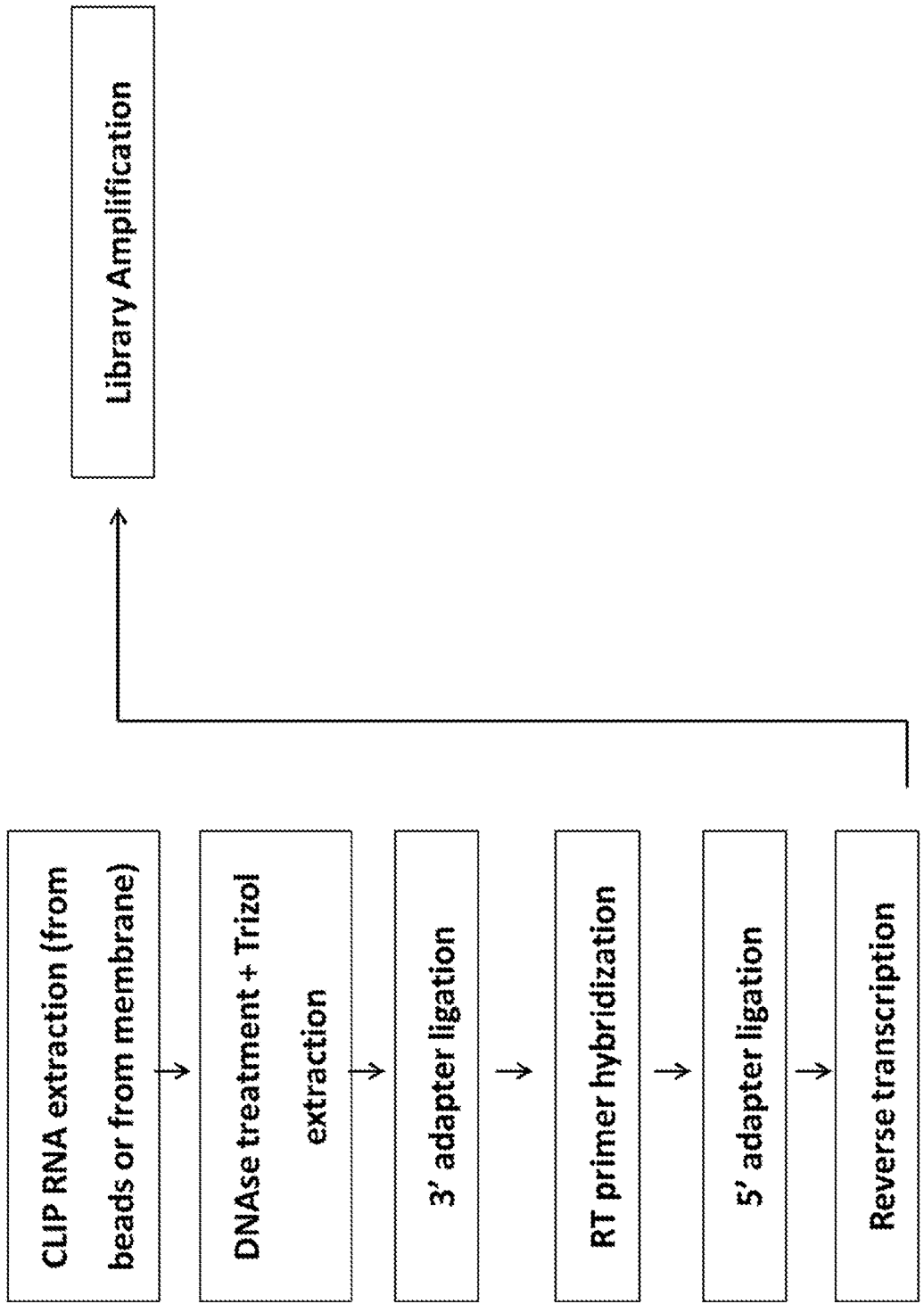

These "denaturing" CLIP-seq methods (also referred to herein as dCLIP-seq) utilize a biotin tag to enable purification of RNA-protein complexes under denaturing conditions to increase the specificity of the purification scheme. As shown in FIGS. 1A-B, for the denaturing CLIP method, cell lines stably expressing two vectors were prepared: vector #1—expressing bacterial biotin ligase BirA under neomycin resistance; and vector #2—expressing a protein of interest (here, PRC1) fused to a biotinylation tag or control vector under puromycin resistance. Both human HEK 293 kidney cells and mouse 16.7 ES cells were used. Cells were crosslinked by exposure to ultraviolet (UV) light (254 nm) at 150-400 mJ/cm$^2$ on ice depending on cell layer thickness, cellular lysates are prepared, then treated with DNAse to solubilize the chromatin, and protein-RNA complexes were pulled down using streptavidin beads. Importantly, the samples were then washed with a high stringency wash using 8 M urea+0.1% SDS (range: 0.0-2.0%) at room temperature. Samples were then further washed in PBS+2% SDS and further in high salt buffer (PBS+750 mM NaCl+1% NP40+0.5% NaDeoxycholate+0.1% SDS), each at room temperature. Under such stringent conditions, most proteins are denatured, resulting in the loss of the nonspecific RNA-protein interactions. Only the extremely high-affinity biotin-avidin interaction survives. Thus, these steps can be used to effectively remove the vast majority of background RNA, resulting in extremely clean "peaks" of binding. The samples are then treated with DNAse to remove contaminating DNA. The RNA was phosphorylated using $^{32}$P-ATP and run on SDS-PAGE and transferred onto a membrane. Broad bands corresponding to the RNA-PRC1 complex were identified by the presence of radioactive labeling (hot smear on the membrane) and then excised and eluted for cDNA preparation preparation prior to deep sequencing.

Peaks (high-frequency sequences, believed to correlate with protein binding sites on the RNA), were called by the following methods. About 40 million paired-end 50 nucleotide (nt) reads were generated for every dCLIP-seq sample. Adaptor sequences were trimmed with either Trim Galore! v0.3.3 (for dCLIP-seq; stringency 15 and allowed error rate 0.2), or cutadapt (v1.0). Identical sequences (PCR duplicates) were removed by custom programs prior to alignment. To account for the *M. mus* (*mus*)/*M. castaneus* (cas) hybrid character of mouse 16.7 ES cell line used for a dCLIP-seq, reads were first aligned to custom *mus*/129 and cas genomes, and then mapped back to the reference mm9 genome (Pinter et al., Genome Res 22, 1864-1876, 2012). For dCLIP-seq data obtained from human HEK293 cell line, alignments were performed to hg19 human reference genome. All alignments were performed with Tophat (v2.0.11) (Kim et al., Genome Biol 14, R36, 2013). Post-processing of alignments was performed with custom scripts using SAMtools (Li et al., Bioinformatics 25, 2078-2079, 2009), and BEDtools v2.17.0 (Quinlan and Hall, Bioinformatics 26, 841-842, 2010). These included accounting, alignment file-type conversion, extracting and sorting reads (SAMtools), and obtaining wig coverage files (SAMtools depth).

Fragment per million (fpm) wig files were then created by scaling uniquely aligned wig files to total number of fragments per million in each library (determined by SAMtools flagstat combining reads "with itself and mate mapped" and "singletons"). Then consecutive wig entries of equal coverage were merged forming bed files that were used for peak calling. The peak caller software peakranger (v.16) (Uren et al., Bioinformatics 28, 3013-3020, 2012) was used. The software peakranger requires an even distribution of watson/ crick entries, so prior to calling, strand specific bed file entries were randomized for strand. The software peakranger was called with arguments ranger -p 0.01-- format bed-gene_annot_file (either mm9 or hg19 appropriate), -d experiment and -c mock-transfected control, to find narrow peaks with p-value 0.01 or less. To extract more uniquely aligned reads, a second round of peak calling was performed from the *mus* track, this time including "pegged" reads attained using tophat2 with the option -g 100. Pegged reads are singletons extracted from the reps track where the locus of one end is fixed locus and other varies. We then merged the results with the previous method.

Example 2. Human CBX7-RNA Binding Sites as Determined by Denaturing CLIP-seq Analysis in Human 293 Cells CLIP-seq performed in human female embryonic kidney fibroblast line, HEK293, as described above in Example 1. CBX7 binding sites in the RNA are shown in Table 1. Peaks were called from uniquely mapped reads using the software peakranger (p=0.01). The resulting strand specific bed files were then converted to their respective strands. To produce non-overlapping peaks, entries, from two biological replicate bed files were expanded by 500 nucleotides on each side and merged. The envelope of 500 bases was added because RNA-protein interactions could be affected by changes in nucleic acid folding nearby, which in turn could cause allosteric effects on the RNA-protein interaction. Then the closest gene was determined for each entry (bedtools closest) and categorized as "Imprinted" gene, "Oncogene", and/or "Tumor Suppressor".

Our analysis turned up 5893 binding sites in RNA for human CBX7. The columns (c) in Table 1 correspond to: c1, SEQ ID Number. c2, Chromosome number. c3, Read start position. c4, Read end position. c5, chromosome strand that the transcript is made from (+, top or Watson strand; -, bottom or Crick strand of each chromosome). C6, nearest gene name. c7, gene categories as defined in the following way.

The hexadecimal code is used in Table 1 to indicate the number of categories satisfied by each gene: The 4 bit represents an Imprinted gene (IM). The 2 bit represents an Oncogene (OC). The 1 bit represents a Tumor Suppressor (TS). The hexadecimal code can be translated to binary. Each bit represents the condition (1) or absence (0) of the condition.

Thus:

| Value | binary | meaning |
|---|---|---|
| 0x1 | 0 0 1 | TS |
| 0x2 | 0 1 0 | OC |
| 0x3 | 0 1 1 | TS and OC |
| 0x4 | 1 0 0 | IM |
| 0x5 | 1 0 1 | IM and TS |
| 0x6 | 1 1 0 | IM and OC |
| 0x7 | 1 1 1 | IM and OC and TS |

Example 3. Mouse CBX7-RNA Binding Sites as Determined by Denaturing CLIP-seq Analysis in ES Cells Derived from *Mus musculus*

CLIP-seq was performed as described in Example 1 in the mouse ES cell line, EL 16.7. CBX7 binding sites in the RNA are shown in Table 3. Peaks were called from uniquely mapped reads using the software peakranger (p=0.01). The resulting strand specific bed files were then converted to their respective strand. To produce non-overlapping peaks entries, 3 biological replicates of undifferentiated and 1 biological replicate of day 7-differentiated ES cells were expanded by 500 nucleotides on each side and merged. The envelope of 500 bases was added because RNA-protein interactions could be affected by changes in nucleic acid folding nearby, which in turn could cause allosteric effects on the RNA-protein interaction. Then the closest gene was determined for each entry (bedtools closest) and categorized as "Imprinted" gene, "Oncogene", and/or "Tumor Suppressor".

Our analysis revealed 18,953 binding sites (peaks) in RNA for mouse ES cells. The columns (c) in Table 3 correspond to: c1, SEQ ID Number. c2, Chromosome number. c3, Read start position. c4, Read end position. c5, chromosome strand that the transcript is made from (+, top or Watson strand; −, bottom or Crick strand of each chromosome). C6, nearest gene name. c7, gene categories as defined above in Example 2.

Example 4. Human LiftOver Sequences Corresponding to CBX7-RNA Binding Sites as Determined by Denaturing CLIP-seq Analysis in Mouse ES Cells CBX7-binding sites shown in Table 2 were derived from dCLIP-seq performed in the mouse ES cell line, 16.7, as shown in Table 3, translated from mouse mm9 to human hg19 coordinates. The software UCSC Liftover was used to convert mouse mm9 coordinates from the mouse sub-sheet to human hg19 in the human liftover sub-sheet, prior to the envelope extension and merge step. The analysis led to 11,522 binding sites in human RNA. The columns (c) in Table 2 correspond to: c1, SEQ ID Number. c2, Chromosome number. c3, Read start position. c4, Read end position. c5, chromosome strand that the transcript is made from (+, top or Watson strand; −, bottom or Crick strand of each chromosome). C6, nearest gene name. c7, gene categories as defined in Example 2.

Example 5. Targeting the PRC1-RNA Interaction to Modulate Gene Expression

Analysis of the results described above indicated that PRC1 binding sites can be classified into several groups, including (i) 3' untranslated region [3' UTR], (ii) promoter-associated, (iii) gene body, (iv) antisense, and (v) intergenic. In order to block the identified interactions between Cbx7 and specific RNA transcripts, antisense oligonucleotides (ASO) LNAs were administered to cells in culture, to determine whether targeting the interaction between PRC1 and each of these RNA classes would change gene expression in cis.

First, the effects of disrupting PRC1-3'UTR interactions were examined. Potential Cbx7 binding sites (identified as described above) that were within 3'UTRs of three selected transcripts were identified based on CLIP-seq data, including (FIG. 2A) Mouse DDB1 and CUL4 Associated Factor 12-Like 1 (Dcaf12L1); (FIG. 2B) Mouse Calmodulin 2 (Calm2); (FIG. 2C) Mouse Mecp2; and Human IRAK1. 22-mer mixmer LNAs targeting selected binding sites (FIG. 3) were designed with the following sequences:

TABLE 4

Sequences of LNAs targeting Dusp9, Dcaf12L1, IRAK1, Mecp2, and Calm2

| Target Gene | LNA I.D | LNA sequence | SEQ ID NO: |
|---|---|---|---|
| Dusp9 | Dusp9-1-a | CCTACAGTTCCAAGAAGTCTAA | 36372 |
| | Dusp9-1-b | GAAGCAGGAAGGAGTCTACACG | 36373 |
| | Dusp9-2-a | CAGTTTGACCACCCTCAGTCAC | 36374 |
| | Dusp9-2-b | AAAGAAACAGTCAGGGCACCAG | 36375 |
| | Dusp9-3-a | CACAGGTATTGCCAGCTCCAGG | 36376 |
| | Dusp9-3-b | CACACACACAGAGTCTACAACG | 36377 |

TABLE 4-continued

Sequences of LNAs targeting Dusp9, Dcaf12L1, IRAK1, Mecp2, and Calm2

| Target Gene | LNA I.D | LNA sequence | SEQ ID NO: |
|---|---|---|---|
| Dcaf12L1 | Dcaf12L1-1 | CCTGTCTGCCATACATTCTACA | 36378 |
| | Dcaf12L1-2 | GCTCAGACTTCTTCCTTTGCAC | 36379 |
| | Dcaf12L1-3 | GTAACAGATCTATTCTACTTGA | 36380 |
| | Dcaf12L1-4-a | CATTATCTCTATTTATCTGAAC | 36381 |
| | Dcaf12L1-4-b | GGAGAAAACCAATCTATCCGCA | 36382 |
| Calm2 | Calm2-1-a | GCCAGAGTAAGCCACATGCAAC | 36383 |
| | Calm2-1-b | TTAGATGTGCAGACGGGCTTAG | 36384 |
| | Calm2-2-a | TTACAGCTCCACACTTCAACAAC | 36385 |
| | Calm2-2-b | ACATGCTGACAGTTCCTAAAAG | 36386 |
| Scrambled control | LNA-Scr | GTGTAACACGTCTATACGCCCA | 36387 |
| Tsix | Tsix-region-1 | AGAGTACAGTTAACAAGCTGGGT | 36388 |
| | Tsix-region-2 | TGTTTTGTGACAGGGATTCT | 36389 |
| | Tsix-region-3a | TTCTTCCTTGCATTGTGTCTA | 36390 |
| | Tsix-region-3b | GGTGTGTCCTATGGTCCTATGT | 36391 |
| | Tsix-region-3c | CCATGTAACAGAATGTTGAGAT | 36392 |
| | Tsix-region-4a | CATAATCTGTGACCAGTACCTC | 36393 |
| | Tsix-region-4b | CATCAGAAGAGGTTAGATAT | 36394 |
| | Tsix-region-4c | TGGAGGCAGGTGGATTTCTAAC | 36395 |
| IRAK1 | IRAK1-a | CCAACATGCGCCAGCCTCCTCA | 36396 |
| | IRAK1-b | AAGTGCTGGGATTACAGGCGTG | 36397 |
| | IRAK1-c | ATCATGACTCACTGCAGCCTCG | 36398 |
| Mecp2 | Mecp2-reg1-a | TCGCTATACCACAGTCCACAGG | 36399 |
| | Mecp2-reg1-b | TGAAGCAGAGAGCAGGAAGAAG | 36400 |
| | Mecp2-reg1-c | ACACCTCAAATCTCAAGAGGCT | 36401 |
| | Mecp2-reg2-a | GATTACTCCCTAGAGCAAGGCC | 36402 |
| | Mecp2-reg2-b | CACAAGGAAAGGGCTCGGCACA | 36403 |
| | Mecp2-reg2-c | CCACTTCCCTCCCTTCAAATGC | 36404 |

Phosphate residues were replaced with phosphorothioate residues for increased stability. Multiple LNA oligonucleotides (LNAs) targeting the same transcript were pooled together to the final concentration of 50 µM. Following trypsinization and feeder removal, a total of $2 \times 10^6$ EL16.7 mouse ES cells were resuspended in 100 µL of ES cell nucleofector solution (Lonza) supplemented with 2 µM LNAs. The cells were transfected using the A-030 program. A 0.5 mL of culture medium was added to the cells and 250 µL of this suspension was plated on gelatinized 6-well tissue culture dish with 2 ml of fibroblast-conditioned media. Per time point, whole cell RNA was extracted using a Trizol reagent and expression of the target genes was estimated using quantitative real-time RT-PCR (normalized to beta-actin as a reference gene).

The effect of LNAs on gene expression was represented as a ratio between specific LNAs and scrambled control. The results are shown in FIGS. 3 and 5A-B. To test the specificity of LNA pools, two unrelated amplicons were tested for every LNA pool along with a specific one. There was a specific increase in Dcaf12L1 gene expression 24 hrs after nucleofection with the Dcaf12L1-specific LNA pool as compared to unrelated Calm2 or Dusp9 genes (FIG. 3, right). The same was true for the LNA pool against Calm2, which resulted in a specific increase in Calm2 mRNA levels as compared to unrelated Dsup9 and Dcaf12L1 genes 24 hrs after nucleofection (FIG. 3, left). These results indicate that targeting the RNA interaction with PRC1 lead to an increase in gene expression.

In contrast, LNAs targeting Mecp2 and IRAK1 interaction with PRC1-binding RNA resulted in gene downregulation, presumably as a result of disrupting PRC1 RNA interactions. Mouse embryonic fibroblasts (MEFs) were nucleofected with pooled LNAs and harvested after 24 hours for qRT-PCR analysis of Mecp2 expression. Downregulation was seen after Mecp2-specific LNA treatment, but not seen with LNAs against Tsix or scrambled control. In addition, human PC3 cells were transfected with pooled IRAK1-specific LNA or control scrambled LNA, then harvested after 24 hours or 36 hours for qRT-PCR analysis of IRAK1 expression. Specific downregulation was seen for IRAK1-specific LNA. Thus, these LNAs caused downregulation but not elimination of gene expression in cis. Thus, targeting 3' UTR-PRC1 interactions by antisense oligonucleotides provides an alternative approach to RNAi methods and may be especially useful when one aims to titrate down but not eliminate gene expression, such as in the case of MECP2 Duplication Syndrome.

Figure 4A:
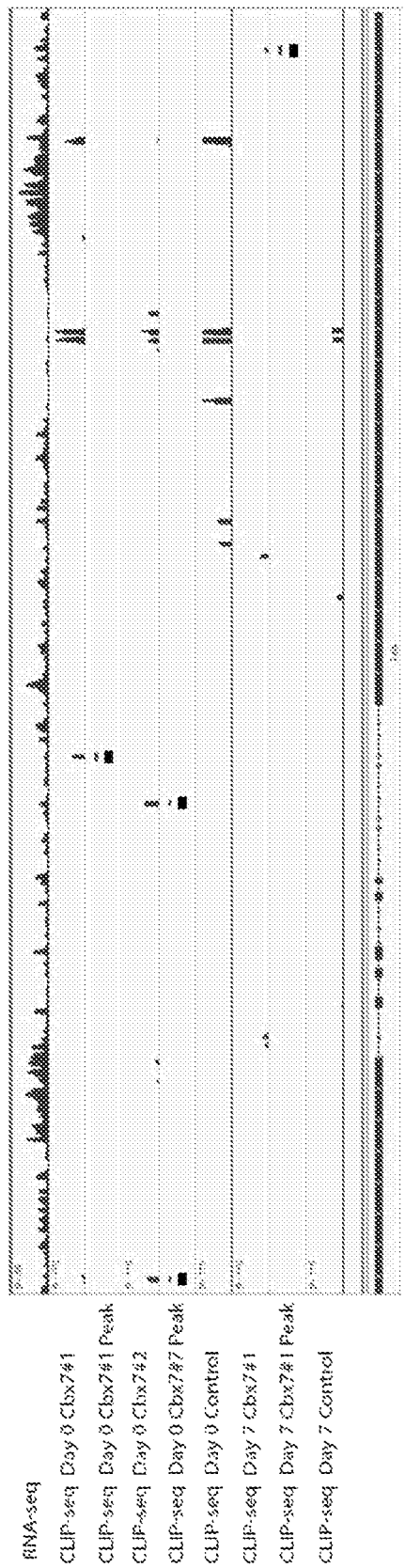
FIGS. 4A-B shows the test gene, Tsix, and results of knocking off PRC1 from Tsix RNA. (4A) The RNA-seq profile shows the Fragments Per Kilobase of transcript per Million mapped reads (FPKM) expression values of each gene. CLIP-seq profiles are then shown for two biological replicates (Cbx7 #1, #2), with corresponding statistically significant peaks ("Peak", as called by PeakRanger software) shown as bars under each replicate's track. Two control (tag-only libraries) are shown for each gene. Antisense oligonucleotide (ASO) LNA mixmers used for knockoff ananlysis are shown as black bars. The mixmers were pooled for the transfections. Only the Watson strand is shown in the figure. (4B) Tsix RNA is a repressor of Xist expression. Here we hypothesized that Tsix recruits PRC1 to repress Xist expression. The RT-qPCR analysis performed 6 hours after administering Tsix LNAs support this interaction. Xist upregulation was achieved specifically.
Figure 4B:
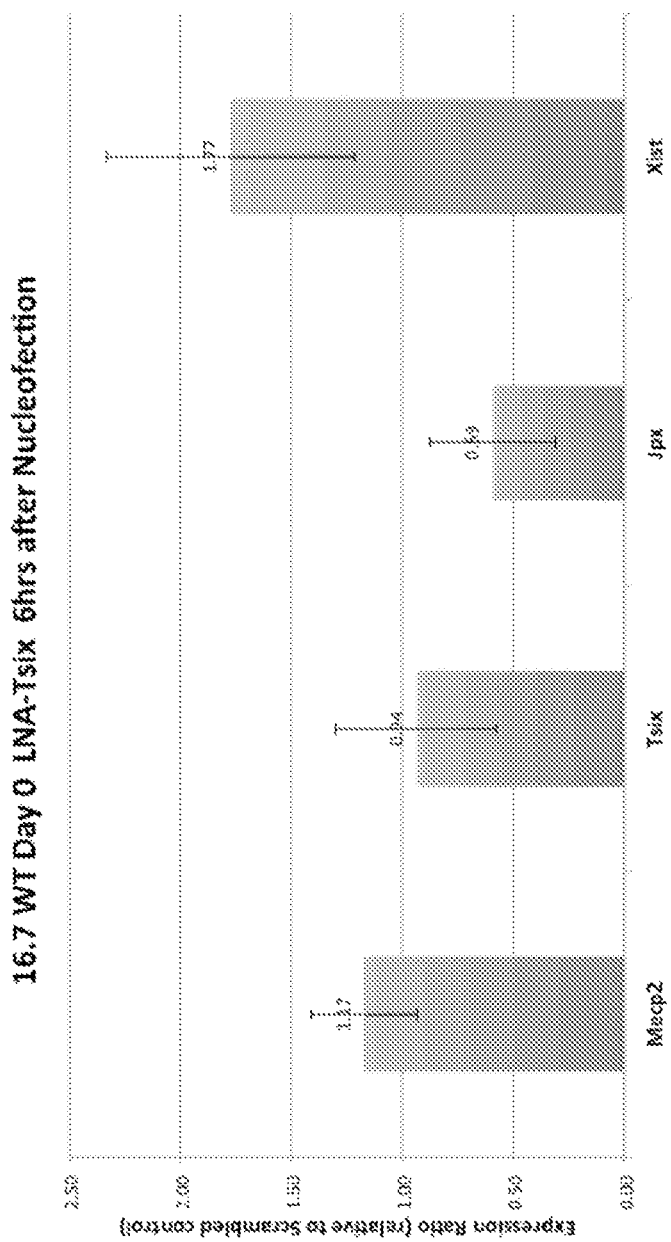

Second, we examined the effects of disrupting PRC1-antisense RNA interactions. As an example, Tsix RNA is antisense to Xist and binds PRC1 via CBX7 at both Tsix's 5' and 3' ends. Tsix RNA is a known repressor of Xist expression but the mechanisms of repression have not be fully elucidated. Here we hypothesized that Tsix in part recruits PRC1 to repress Xist expression. Targeting Tsix RNA with ASO mixmers led to increased Xist expression even after just 6 hours of treatment (FIG. 4A,B), consistent with a derepression of Xist when PRC1 cannot be recruited.

Furthermore, ANRIL is antisense to INK4a and interacts with CBX7. Targeting ANRIL is expected to lead to derepression of the linked coding gene INK4a, consistent with loss of ANRIL-PRC1 interactions. Thus, antisense RNAs interact with PRC1 and serve as recruiting tools for PRC1 in cis.

Third, we examined the effects of disrupting PRC1-intergenic RNA interactions. Genes can either be turned up or down. For example, Xist is a CBX7 target. Xist recruits PRC1 via CBX7 to the rest of the X-chromosome. Targeting Xist binding sites is expected to prevent PRC1 recruitment and leads to failure of X-inactivation or higher likelihood of X-reactivation. As an opposite example, Pvt1 is a long noncoding RNA located next to c-Myc and is a frequent site of translocations in B-cell lymphomas (e.g., Burkitt's). Pvt1 and cMyc are both associated with oncogenesis. Pvt1 appears to be a positive regulator of cMyc expression. Our analysis shows that Pvt1 is a PRC1 target. Pvt1 may recruit PRC1 and result in upregulation of cMyc.

These data indicate that PRC1-RNA interactions may serve different functions within cells and genes may be up- or down-regulated by disrupting these CBX7-RNA interactions.

Lengthy table referenced here

US10900036-20210126-T00001

Please refer to the end of the specification for access instructions.

Lengthy table referenced here

US10900036-20210126-T00002

Please refer to the end of the specification for access instructions.

Lengthy table referenced here

US10900036-20210126-T00003

Please refer to the end of the specification for access instructions.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

LENGTHY TABLES

The patent contains a lengthy table section. A copy of the table is available in electronic form from the USPTO web site (https://seqdata.uspto.gov/?pageRequest=docDetail&DocID=US10900036B2). An electronic copy of the table will also be available from the USPTO upon request and payment of the fee set forth in 37 CFR 1.19(b)(3).

SEQUENCE LISTING (36404 sequences)

SEQ ID NO: 1 - DNA, 1171 bp, Homo sapiens
actccgccaccagggggcgccacagctcctcgcgccgccgcctcccgcaaacacaaagagccgcgcggccacgacggccgcgtgcccggagcgccggggtctttcctgggctccaaagtcaagagctcacgttccgggaggatctgtccgcggaaattcggttctgagcgtcgccggactccgccgcggggaggcgggtgaggggagggggccggagggtcgggggtgccggggggtgcgggaaggctgcgggggaggctgttggggacgttcgtggcgggggaggctgttggggacgttcgtggcgggggaggctgttggggacgttcgtggcgggggaggctgttgggtcccctccccgccccaccgcgtcccagggaaccccggcagggcacccagtgaggggggcccgggcgtccgcccattcctcactgctgtccccgcctgtgcccgaaacccccgttcacgttcaccgagaaaacagacataaacccagccaggcacatccactagaatggctgtgatttcagaaaagcggacgtaagtgctgccgaggagatggaggcgttggaccccctcgcgcattgtcggggcgggtgcagccgcggtgcaaaaggaccttcctcagaaagttgagcacgaagttcccacaggcccggaagttcccctcccgggcgctccccagagagctgaagactgggcgcgtgccggcggcaaatgttcacagcaaagggcggcccagtgcgcagctggaacatcagccccaggcggtcgctgcgacagggacgagcctgggaaacgtgaaaatgtccagaacagggaatccacagataaagaaaagacatcgtggttgccagagctcgcgggagggggcaacagggaccgactgcttaacgtgtatggttccccttcagggtgaggacgtgttctgggacgaggtcgaggtcagggttgcaggacaagatgaaagcgctaaatgccactgaattgtttgctttaacgtcattaattttgttatgtgaatttcatctcaatagaataaataggtcaagctggctgcagggcccaccccaccgcggcctggagcagggtcttctggggtgtaccacctctgccctcacccaggctccaccacgaccagcttcgtccaccccccaggagaccatgaagg

SEQ ID NO: 2 - DNA, 1099 bp, Homo sapiens
ccactgtgctccccagagggcagggtgagtgcgtggcatccttttggcgggcgtgggtgcctctgtggacctggcgtgaggcttctctgtttctgagtctcctatggaccatctgtcttctgtgtggctgctgaggaatcacactggggtggccgtgccggtggctgaatgagaacaggacccccatgctgcacagccctgcttaacgcgggggtggccccagaagcgggtgggcgaggctgggcagcagggattggctgaaatcatatgcagagcccaagaggcaggggaaaggcggcaatttcagggtccctttgttcgccaggtacctggggcccagcccgggcggcaggagggactcagcccctcgcccaggcaggaagggtcccaagcagaggcccctccctcaggcactccccagcccacacctgcagcactgggaccaagactaataaaacaccagcctcacggaagacagctttatcttgttgatcggaagtctgccagcccaatttatgatggaacataagatctctaaatctgaatttacgctctgtagcgtaacgagaggtcaataagattaaacgggggctcaggagaggaccagcgtcaggctcactgcgaggtgctgcacagaaaacccacagccagagcccctgggcccagcccaggcaagaccagaaaaggagggggcaggtgggagaccagcctggggctcccgggaagcccacgggatggaggcgggagagccaggaggcctggggcaaccctgggacggttcctggatcgaggagagcaggggggtgatgagggttccctcagggctggggagccttctcctggtctcagacccaccccccttcagctcccaagccctgggtgcccctggctctgaggacagttgggaatcttccctgaggcaggttcaaggacagagctctgaccctggcccagggctgctttgggtgcctatgaactcggcttctggctcagagcagttccctgcaccccttcctgagccctctgtcctctggaacccgtgggcagggtgagggacgggtgttccttctgggtgggggcctgggcgcccagccagcac

SEQ ID NO: 3 - DNA, 1196 bp, Homo sapiens
caaagtacgggtgggattggcaggcagatacacggagggaacgtgcgcatttgagtgcacgtccaccagcaccagccccaggccacaggcagatcccaggagacacgcaggggccctaagaagggagctgggaatgaggggccacacaagcccgggacggaggcctgtcgcacatggggtggccccgactcaggccctggagttggccaggaccctctagcatcctcaagggctgggccaaccaggctggcgtggggtggggcaggggagggctgagccagtgggcgtcgtctgtagggggatgcccaactgcggccccgtctctcggctctcctctgggtctctggccagctgtggctcctgctggccccaggcgcatcccagaggcaggtagagggaggatggctgctctgagggcacctctgccgtgcttggggctcggcctggggtgcgagaccagggcagacccccgggagatggaacggcccggtccagccccaccttcctctcctcctgccccaccttcctctcctcctgccccaccttcctctcctcctgccccaccagaaccgggggcggctggcagacaagaggacagtcgccctgcctgccgcccggaacctgaagaaggagcgaactcccagcttctctgccagcgatggtgacagcgacgggagtggccccacctgtgggcggcggccaggcttgaagcaggaggatggtccgcacatccgtatcatgaagagaaggtacttggaccagggccggacaggaaggcgcaaggctcagatggggctggagcttcaggccttcagctgctcagatgagagtgtccacaccggcctcccacaccttccctcagatgctggtctttttggggtcctgtgtgggtcgcaggcaggagctgtttcctcatctgccccctgtctggcgtcccctcccacctctgctctgcggcgctcactggcagaggcaggttggcagcagttgggacccagaggtctgcaccttcctgggccgacgctccagctacccttgctgaccgggtcccagtctggccagagagcagctctagcaacagggagctccattcaggctcgtgactggctgtgcagaagcagcctcggcccccacctgcggtacaacaggagggctcctctgagtgcacggcaacaagcaagagggagaaggggcct

SEQ ID NO: 4 - DNA, 1178 bp, Homo sapiens
ggagggcgaggaggacagcagcaactcggagggtgaatggtcttggggtgagagggtgtggccctgtgagcccatctggcgggagggcagagccacgtgggcggggggcgtggggctctgggccaggcttttccctccctgggaaggccaggccaaatgctctgttctctggcagccagcaacagggataaattaattagtgccgtgattaattagtgatgagtaacctctaaggctggcttcttcctgataaagcaaaatttatgtagcctccatctctccccgcagatggagacccagacgcagaggcggggctggcccctggggagctgcagcagctggcccaggggccggaggacgagctggaggatctgcagctctcagaggacgactgaggcagcccatctggggggcctgtaggggctgccgggctggtggccagtgtttccacctccctggcagtcaggcctagaggctggcgtctgtgcagttgggggaggcagtagacacgggacaggctttattatttatttttcagcatgaaagaccaaacgtatcgagagctgggctgggctgggctggtgtggctgctgaagccccacagctgtgggctgctgaagtcagctccgcgggggagctgaccctgacgtcagcagaccgagaccagtcccagttccagggggaggcctgcaggcccctggccccttccaccacctctgccctccgtctgcagacctcgtccatctgcaccaggctctgccttcactcccccaagtctttgaaaatttgttcctttcctttgaagtcacattttcttttaaaattttttgttttgcatccgaaaccgaaagaaataaagcggtgggaggcagggccattgtgttgagtggtggctcctggagatttgtgtggccccacccctacccccggcaacctcaacacagaggctgggaagggtcgggggcccctggaagtagagccaaggtcccattctcctgcttgggtgaagtttgaccggcaagggcgtggccccctccatagggggacgtggccgtcgtgggggacaagggctgctctcctgtgccgagttctcgctccggggcccgcagggttggtggctgcagtggcagagccacggggaagctggccacgtagaaaactcggcccaggcgcctggc

SEQ ID NO: 5 - DNA, 1137 bp, Homo sapiens
cacgcgaacgcgccctcccgccctgaggccgccggcgttgcggtcggagaaccatagagccactcggctgggcgtggcgcggcggggcggggaaaggggcggggcctgggcggcggaagtgcgcagccgcgcggcattctggggccggaagtggggtgcacgcttcgggttggtgtcatggcagctgcggggagccgcaagaggtaagccgcgggtccgagggccgatttggcctcccggtgggtgtctgtatccaagggggcttttcttgctcctctcagcggggctggggcgagctgggcgtgcgggcagctgtgactcctgcgtgacccgcaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccaggttagtggggacatgcgtgagcagaacctcttgctcgtcctgtcccaccccggttgggttgctgacctcgcctggggtctcagggccaaggcctaaggatcgccgacctctgccccccagtcctttcagcttaacttactctttcatccgatgtttactgagctcctgttccgtgccaaactctgtcctaggcagggagcgtatgttggtgagttgtgcaaaaatctcttcccgatctaggagaactctcacgttcttgggtgaaatcaccgcctgcagttcggtagaagagagataagtgctggggagggaaaggaaggacagaggggctgaagagagagttgcaggggagccgagttgctctgttagaaggagcggaggctgtgctcggtggctcacgcctgtaatgccagcactttgggaggccgaggcgggcagattacctgaggtcaggaattcgagaccagcctgaccaacacggaaaaatcatgtctctactaaaaatataaaaattagccgggcgtggtgggcacctgtaatcccaactactcgggaggctgaggcaggagaatcgcttgaacttgggaggcggaggttgcagtgagccgagatggcaccattgcattccagcctgggtgagagagtgag

SEQ ID NO: 6 - DNA, 1176 bp, Homo sapiens
agaaggcggacatcctggagatgaccgtgagacacctgcggagcctgcgtcgcgtgcaggtgacgggtgaggcgcgggcggcggcggcttggaggcggggggagggcgcgggacccccgggacccggcaccgacctctcctcctgtgtcgctcccgcagccgcgctcagcgccgaccccgccgttctgggcaagtaccgcgccggcttccacgagtgtctggcggaggtgaaccgcttcctggccggctgcgagggcgtcccggccgacgtgcgctcccgcctgctgggccacctggcagcctgcctgcgccagctgggaccctcccgccgcccggcctcgctgtccccggctgcccccgcagaggccccagcgcccgaggtctacgcgggccgcccgctgctgccatcgctcggcggccccttccctctgctcgcgccgccgctgctgccgggtctgacccgggcgctgcccgccgcccccagggcggggccgcagggcccgggtgggccctggaggccgtggctgcgctgaggctgtggccctgagactgcatcggaggcggcgccccgttctagggccgtggcctttgccgagactgtagcagagaaaacgtatttattattccagagtctgcgtcacgagttttctttctttgtcttggtgaagagttgactttgggagcgccccgcagccacgccgcgccggggtcccgccctcctcccagggccgcggtctgcaggtggctgggggcgtcgggcgggcccgggggggcgggctgggggcgggaccgaggactgagggcgacccctccgctccgcgccctccgctccgcgccctcccctccgcatccctgcagccccgcatgcgcacccgccctctgcccccgcgttgggtttgcctcgctctgcggtggcggttgtgaggggtccccccggaggctcaggtgggaagctcaacgtccctgagtgcccagaatcttcccggtgctggaaggcggtcgcgcagcatcgccgggcaagttacttttcggaggcccctttcccgactcccagtccccggaccgcggaaggcggaggctgcggtcctgagcggcgctgggatgagggcggccgcccttggccctgaagacccccgctgggttctcctgttaagtgcagagctgcccgtgcccacc

SEQ ID NO: 7 - DNA, 1143 bp, Homo sapiens
gcgcagagctgttcctgggtgtttgctgggattgtagtgacagaaggccagggctgcaggaatccaggctgccagagagagaccaggactcaggcagaagcagcagcaccaggctggtgccactgccaccccacctgcatgccttctcagcagcggtgggagctgtgtctccaagcaggatggtactggagtctccccaccctgcctgtctgggatgccctcccagcctgttcctgctcccggcaggcgctgcttttctctctgctgtaccaggacgaggtgggtgcccttgtccctcctcactggcactcccagactgctttccttttccaccaaaaccacccccgctttgtgaccagacctcactgtgttgaagtcatcggcacccctttcctgcaggaggggacacctgctccctgtcactctcccggccatgccttcaaaatccacaccagcaattctccaactttgacttcctctctttcaggggtcctgtcccctccccacttaccccactgggtcctttctcccaactgcacccctccacggtccagcctctccactctctctgcccccctcccagctcccgcctctgctgtccgccagccctgagatctcgggcagatgcacagcctgcatctgcggcttcctcctcccctgtctgttctctccttatcaagagaagcctatctggccggccattgtgtctgcccctcaccctccctccttcctgttcatgtgggcagaccacagcccgtgtggaatccctaccttcttggtggcttaagcaccacctgcctattctttccgtagtggggatcagggcagtgccagtggcttcctggggcctctcacagcctgcggccctgggccaaggtcagctgggtgggaagggcccaagggtagccatgctggacacctggggctgctgtccctcagctgccgggctctctgccagagccgtgcagcctggagtcctacccactctcagtcagcttcctcctaacacatggccagcgttccaggagggcgaagtggaagcctagggactcttgaggccaggatccagaacgcacatagtaaaatctccaccacactccatcggccaaagcaagtcacagcagccagattccagaggagtcg

SEQ ID NO: 8 - DNA, 1144 bp, Homo sapiens
gtgtaatcagcccagcctcggacgtcaacaatccatgtttcttaggaaaggcggccaacccagggtctccagtgacacgtttccgggtcatcatccggtggccacagggaatcacaggctcggtgtgactttctcagagcgccatggtgcccctgtggggtttcccagcccatcctgtcctgtgggacaggcagaggcccagccgtgtcatcggagtgacctttgagctctaaccaaagtccacgtgtcatcaggagccatgagtcactcaggtgccatccagggcggcggctgaggagtggtgactggccagatgggaaggcggggaagggtctggatttgaatgagagcgagggagtgggctgcaggctggtagactcctccagatggatgaggccagacccctgcaacagccatcccgagcaaggctcaagcctccctgagagtccagggcgccaagtcagccctgcacctggcccgggcctcggaccccgacggggctcacccacctgagatcaccctggctctgcgggaaggcaggaagctttggcatgatcctccacgggcgaggatcacgtagagacgtgtagagacgcgacgaagcacgaagacccgtgtttgacgggttgccaggtgcctacatcagagctcattaaattacacattaaatagatgcacgtgtgtgtgtcaagctcccctaattcaagttgtagaaaatcagactcagagttcttacactcgggggtgttttagcagctgcgcctcaagattctaaattcaaacgcacacggaataaaacatttcggtttatcgccaggcgcggcggctcacacctgccatcccagccctttgggaggccggggtgggtggatcacctgaggtcaggagttggagaccagcctggccaacatggtgaaaccccgtctctactaaaaatacaaagattagctgggtgtggtggtgggcgtctgtaatcccagctactcgggaggctgaggcaggagaatcgcttgaacccgggaggtaaaggttatggtgagccaagatcatgccactgcactctagcctgggcaacaagagcaaactctgtctcaaaaagaaaaagaaaagaaaaaagaaaaagtttattcccagtaaaacacgt

SEQ ID NO: 9 - DNA, 1794 bp, Homo sapiens
ctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaactttaaaagcattgcttttgtccatcctcaccagcgcgctggcccgttggcttcttgctccgctttgtggtgggagcacggacttggagctcccttgggtggccctggatggagccaggccctgcacagggatccttgtggctgatgaggccctgagtggggagcacacactgctgagcactgtgggaggcggggccgtggaggcaggaggctctctggcgtgcacgtgtgggtgcgtgtacgtgtgggggtgtgtgtgtgtgggtgcgggtacgtgtgggtgcatgtgcctgctctctggcgtgcacgtgtgggtgcgggtacgtgtgggtgcgggtacgtgtgggtgcatgtgcgtgtgggtgcgtgtgcctgctctctggcgtgcacgtgtgggtacgtgtgggtgtgggtgcgtgtgcctgctctccggcgtgcatgtatgggtgcatgtacgtgtgtgtgggtgcgtgtgcctgctctccggcgtgtatgtgtgggtgcgtgtgcgtgt

SEQ ID NO: 10 - DNA, 1151 bp, Homo sapiens
aggaaaggaggacccaccacgacagggcagacccccaatacctgctcctccttgaagtccagctccacccgaggacagacgcagccggcctccgccaggccctcctgagcagccatcgcttcagtggtgctgggtcaggcggacccaagagtcagcccggttaggacccattttatgtgcggggccacagacacaggctgagtgaccggcgcacagccacacagctccaaggccatgagcagggctcacccggcctccgtccccctgtgcagaagtctgtcatgggggcaggtgaccgtgcctttaggggacagaccgttctccatcaaggctggacgtgccccgtccctaaagcagccctgtctgcaagtgcccagcagaccccacggtgcccgagtgccccggggctgccagcttcaacagcagacctttaatctgactatcctagagttcagaagtccaaaaccaaggggcaaacaaggccacacgcttcccgaggctccggggaggacgctgtctgccttcccagcccctgccggctcaggcatctgtggctgcgttgcccgtctctgtcccctggtcccacggcgtctcccccacctctgcgtcttctctctctgcctctctctcaggtgggccctggccgttgtttcagggcctgcccggggaaccctgggcgatcacacctgagaccctgacgtaaccccctgcaaagccccttcttctaaataaggtcacattcgaggtcttgggactacggcctgcttgtcgccccctgaggtgcatgatactctgggacccacatctctgtcttcggggatcgcctggcccttgtccaggccccggggcccagggtgtaaatgagaggacacagccgggcaggaggaagccgtccctttcccgagctggagctctgagggcgccttaggggcagggggcatctgggttcccacctggtcagagtaaacagccccgggcgcctgtgccatatgcccactcccgagagcctccggtgagggctgaggcctgcactgtccctgctgtccaggtcccactctgacctcgcctgtctctgacccgtttcagtacggaagccgcgctacgtcaggcgggagcggcccctggacagggccacggatcccgctgccttc

SEQ ID NO: 11 - DNA, 1214 bp, Homo sapiens
gtgccgagacatggtggctgtggtgaacggtgctgccgagacatggtggctgtggtggacggtgctgctgagacatggtggccgtggtggatggtgctgagacatggtggctgtggtgaacggtgctgccgagacatggtggctgtggtggacggtgctgctgagacatggtggctgtggtgaacggtgccgagacatggtggctgtggtggacggtgccgagacatggtggctgtggtgaatggtgccgagacatggtggctgtggtggacggtgctgccgagacatggtggctgtggtggacggtgctgctgagacatggtggctgtggtgaacggtgtcgagacatggtggctgtggtggacggtgctgctgagacatggtggctgtggtgaacggtgccgagacatggtggctgtggtgaacagtgccaagacatggtggctgtggtggacggtgctgctgagacatggtggctgtggtgaacggtgccgagacatggtggctgtggtggacggtgctgctgagacatggtggctgtggtgaacggtgctgctgagacatggtggctgtggtgaacggtgctgctgagacatggtggctgtggtgaacggtgctgagacatggtggctgtggtggacggtgctgctgagacatggtggctgtggtgaacagtgctgagacatggggctgtggtgaatggtgctgccgagacatggtggctgtggtgaatggtgctgctaatgtgtctagaattggtggattcttggtctcactgacttcaagaatgaagccgcagaccctcgcagtgagtgttacagttcttaaagatggtgtgtccggagtttgttccttctgatgttcagatgtgtttggagtttcttccttctggtgggttcgtggtctcactggcttcaggagtgaagctgcagacctttgcagtgagtgttacagctcataaaggcagtgcagacccaaagagtgagcagcagcaagatttattgcaaagagcgaaagaacaaagcttccatagtgtggaaggggacccgagtgggttgctgctgctggctccggcagcctgcttttattcccttatctgaccccacccacatcctgttgattggcccattttacagacagctgattggtccattttatagagagctgattggtctgttttgacagggtgctgattagtgcgtttacgatccctg

SEQ ID NO: 12 - DNA, 1180 bp, Homo sapiens
aaaaacatatattttgtagacacaaggtctccccatgttgcctaggtaggtctcaaactcttggatttcagagggttcaagtgacccgctcggcctccccccgtcctggggttgcaggcgcgagtgacccgcctgccttggcctctccccatcctggggttgcaggcatgagcccctgtgcctggccttgaccttctagaatgacgcggagacttttgagcctgttggctctgcctgctcttttcccagttcacgtactcttatctggagtttggtcctgtccgttctaaatcctgcaaattggacattaaaaaaactaaaagtaagaggatctccctgtgttgcccaggctggtctcaaagtcctgggctaaagggatctgcctgccgcagcctcccagcatgccgggattacaggcacaagccccagtgcccggccaaattggacgttattacttcctttccaaaagagtggtttacattttcctccccacacacggttcgtgcctccaccccggtcccgcgttccctgctgtcctgactgcgtctttaagcttcatcccgttggtccggcctgttggcgatgtgcttggggcaggaggccttgcccgtgcccgccccccaactctgattgtgtctgtctttccttggtgccactttatttgggtcttttctgcccaggacatggcccacctggacctagagctctgtgacatttctgtgaagcctccgtctacctttgggactcagcagaggtgtgtttagaattcactctgcgttttgggggtccccatgcatgctgaggtgctgttccctgcccacccgtgtccgatccgtcttggcctccccgacctcagggtgcctaggaccccccgacctctttgggtatttggtttctggctcaggaagagcagctgccgggtcctggaggaggggcctgggaagcgctggcaggcgtcactcctgcgacctcccacccctccctgcatggctcctgcgagggtcaccgcgtgagtccgggggctgctgtcctcgcgcctcagacctgattctggggaccgcggtgaaggcgtggcaggcgggcatcactcccttcccccgcctccatcgctgcctctctctgggtctgcgtcctcttctcacagggacagcagtcgttgactctccctgatccaggaggg

SEQ ID NO: 13 - DNA, 1197 bp, Homo sapiens
gtgggaggggctgcgagcgggctgggctccggggccgacctcaccggcagccacggcctccaactccagctctgggtccagctcaccccactgggcgtcccgagtaggggaggcactgctgtcccgacagcacacactgggatgctggggccagtgtgaggccccgggccggcaactctgactccagggccctgcgtcccaggccgagtccggtcctccgccatctggagctgctggacgagtttgccagggagaacattgactccctgtacaacgtcaacctcagcaaaggcagagccgccctctccgccactgtcccccgccacgagccccccttccacctggaccgggagatccgtctgcagaggctgagccactcgggcagccgggtcagagtggggttcagactggtgagtgtcccagccggggcctgcagccatcagggccttgagctgggagcacggccctgcgctgctggtacctcgagtggggagcggggcctgggctgtagccacagagctgaccctccctcccctctcccagtgcaacagcacgggcggcgactgcttttaccgaggctacacgtcaggcgtggcggctgtccaggactggtaccacttccactatgtggatatcctggccctgctgcccgcggcatgggaggacagccacgggagccaggacggccacttcgtcctctcctgcagttacgatggcctggactgccaggcccggtgagtgtggcgggcgggggccactccttccgtcccaccccacagagcgtggccgcacccctggggtccctctggctgtatgctgggagccacccaaggctggccggaggaactttccgcagacacagggcaggccatggcccctcaggccagcgtgacgggcgcgggcagccgacattcaaggtctgagcttggcttctcattccagacagttccggaccttccaccaccccacctacggcagctgctacacggtcgatggcgtctggacagctcagcgccccggcatcacccacggtgggtgccagcccctggccggtgcgggggcaggggtgcaggtcaggtggcctcacaccagcccttggcctcccaggagtcggcctggtcctcagggttgagcagcagcctcacctccctctgctgtccacgctggccggcatcagggtcatggttcacggccgta

SEQ ID NO: 14 - DNA, 1107 bp, Homo sapiens
catgtgtgcttgattgtgtatgtgtgggtgtgcacgcgcgcgctgggtctcttgggatctgctggcaagtcagcatgtgtgtggaggcacggggagcctctgtatccctggagccctcaccaggaggctcaggagccttggagtgggaggctcagggccagccaggagagtggccgccagccctgggcagaggaactggggccatcctctgctctcccatcttctgttgctgacctgggaaaaggggttgaataacttgagcaccctaggatcctgcattgaggacccgggctgtggggaggtgtgggcatggcctccctgctgggggctggaccctggctgaagcacccaccttctccctggcccctccgtcagaagcctaatggacctcctcctccacgcagacggccctgtactgccctcttccagtcgtgtgggggtgctggaacccactcacctctgggccttctctctggtaaccggctctcatgggagcctgttacaggagccagttatgggggctgtggggctgcagtaggtgccgtagagtgactgccctgggaaagtgcctcacccctgtggggcatggactggagtggggagatgagaatggcctggcccagtgggttttggggttaggctgtgatttaactggggttcgaggggctccctgaggctgtcctgggggcaggccctaagggcgtaacttgagtttcctggcctaccgccaggttggggggccaggcagggtgggcgggaagatgtggtctgtaacgtggagcctggtcgccccagcccgggagagggggaccctgcccgcaccctcctggtctggggagggcctagtggcagcccaggtgcagtgggccggaggccaggggagcccgtgtaggggaaccgcctggcctctgttcagtgtgcccctcccctgggtggggcttcaggcgctgagtcatggctttggttggggggcagcctcaccctcctccccgtcctccaagctgctgaggaaatcctgggctgagcacagcagaggaggcctaggtccccaggactgaggaagggagagctgaggggctcccagcagtgggagcggctctcggggcc

SEQ ID NO: 15 - DNA, 1100 bp, Homo sapiens
cccctccagctgtccaggtcctgaggactcccggctgcctgcctcccgcctcaccttgccttaaaactgggggaggtgctggagctaaaatcagcacgtgacttgagggcagggccacagcccaggggcccttcctcacctgctctcctcgggggtgaccaaggggctggcttggcctggggaaacggagacccggcgcagcgttcgcacggggctcggcaccgggctgccagcggactggaaggcgctgaagtcgtgtgtgccgaggaggtgctgggcggcttcctgcatggcgaccatatccaggcagcttcagggaccagggtgaccgtcaggagggtggggccggcctgcccgccccctccccgctgtcagggccacactcactctgccgggagagtccagcataggttgcgttcaaacaccggcagctcatcacgccggtgacagccagtggccaggcggtacaggtaggtccgggacgtggctgcgtgacgagcgtggaagtcgctgggcactcggaaggcccgcaggaccctatggcggcaggtaaagctcaccggaggaacgaccccgcccgcccgcggtgtcacattggctctccttccccctcgagctccgaccagacaaggaagtctgtccagatctccagcctccgcccgcgacagatggagtcgggaaggcacagccccagggctgcttaggtcgcgggctcacctgatggccgggtgccgcaggtgtgtgttgagggcctcggccaggacctcgggcgggaagggcggccggcctgagcggcgctggacgtccaggtgcgccgcgttgctcagggcgtggaccccggcgtccgtgcggctggagatggtgaacctgaccggctccacggaattcagccgctcggcggcctcctgcaggaccgagccgcggggcgggcgggtgagcgaggccggaccccggggacgcgcgggcgggagcctcccccttacccctcaccgggcgtcccgtgaccggctgagcgcacctccaggtagttctggaccccgacggcgcgctgagtgcccctgacggccgcgaccccgctgcgggcagaagcgggcggaggt

SEQ ID NO: 16 - DNA, 1173 bp, Homo sapiens
ccgccatagggtcctgcgggccttccgagtgcccagcgacttccacgctcgtcacgcagccacgtcccggacctacctgtaccgcctggccactggctgtcaccggcgtgatgagctgccggtgtttgaacgcaacctatgctggactctcccggcagagtgagtgtggccctgacagcggggagggggcgggcaggccggccccaccctcctgacggtcaccctggtccctgaagctgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggtgaggaagggcccctgggctgtggccctgccctcaagtcacgtgctgattttagctccagcacctcccccagttttaaggcaaggtgaggcgggaggcaggcagccgggagtcctcaggacctggacagctggaggggattcgcccggacgccccccagcctccagctgtgccctccccccaggctggggagcggagaacagggaaggctgcttgtctctgaaaaacccctgccatgcctgatggaagaatgttggcagctactggaaaggtctcactggtgccagtggttctggtggggtggtttctgctgcccccagcactgtcccgagggccacccaccaggtggcagcttctgaccagaacctcccctattggggtgagccctgaaggggggaagaacttctgccagccccagacttctgtggcagagcagcaggtacaggactgggggtctctggcacccgcaccagccacgttcccagaccctgcaccaggaccctaggtgagggcccagggcaagcccctctgggatggccaggctacctgcccagcctccagggtcctgctgcctccttgcccaagcattgtttctctggttttaagcccctccaatgggcctcactgggggcaggagatcagccagggcccctggtggccaagctagtgggaaccaggctcgtctttaggcccaccctgtcactctcccgtccaaggccacatagtaggctgaggatggcaaacactgccccacagacacctacag

SEQ ID NO: 17 - DNA, 1172 bp, Homo sapiens
cacaatctcagctcactgcaatctccgcctcccgggttcaagtaattctgccttagcctactgagtagctgggattacaagcacccaccaccatgcccagctaacttttgtatttttagtagagacagggtttcaccgtgtcggccaggatggtcttgaactcctgacttcagatgatctgcccaccttggtctccccaagtgctgggattaaaggtgtgagccactgtgcccagcccagtatttttttgtttgtttttaccgagatggagtcccgccccattgcccaggctagagtgcagtggcgtgatctcagtacactgcaacctccacttcccaggttcaagcgattctcctgcctcagcctcctgagcagttgggattacaggcacgcacttccacacctggcttacttttgtatttttagtagagacggggtttcaccatgttggccaggctggtctccaattcctgaccccaagggatccaccttaggcctggccgccaacattctgaaccttgtcttttctctgtcatgtattcaaagtccacgctggaaactccaatttcaggtcccttcagttttttgtccgttgtctttcgttctttgtccacgttgcccgtcccttgtgaactggatgctgtgtgtgagcaacagggactgaaaagctcagtgcagtgccctcgctccccgccccgcctccctccctgcccccgcccccctcactccctgcccctgcctccctcgctgcccgcctccctccctccctccccgcccccacctccctcgctcccgcccccgccccctcgctccccttcccccacgctccccacccccgcctcccgcgcttcccgtcccccgcctccctcactccccgcccctctgctgtgaggacacagcctgagcgcagccctgtcctccacaggtagatgatgagctggagatcaaggcctactatgcaggccacgtgctgggggcagccatgttccagattaaagtgggctcagagtctgtggtctacacggtcagtggaagggcttgaggcttgggaggggctgctggggtgggaggcaccctcctcatggcatccttgatcgttcaccagggtgattataacatgaccccagaccgacacttagggtaagtaggctgaggtgtctttttgtcccgtg

SEQ ID NO: 18 - DNA, 1212 bp, Homo sapiens
atttcccgtttgcttattgccttgctagactttgagactgaaagttccagggagacagttttgtgtttgctcattactgactcttcggtactcgggatgaggcctggcgcacagcaggcgaatgaaggggccagtgacccacaagcccagagcgggggtgaaggctggggcagggtgggcccaggctgacctgtgctgcgtccccctagccacttccacctggaccactgcggggcactcccctacttcagcgagatggtgggctacgacgggcccatctacatgactcaccccacccaggccatctgccccatcttgctggaggactaccgcaagatcgccgtagacaagaagggcgaggccaacttcttcacctcccagatgatcaaagactgcatgaagaaggtggtggctgtccacctccaccagacggtccaggtcaggttcccagggccacagctggcacagtcactgcccacccccacaccaaccatgccctccgcccgttctacacagtttctggaaggctggggcctcagggtgagcccaccccacctcactcttgcgtccagcaccgtggggacaccaggaggcgtcagcgcgaggatgcgggtcccagaccagactgggcgccgacccgggagagcacgtgcagggtgggggtatgcaccggcttatgaacccaccaggctctgtccgagcggcattgaaatggccagagtgggacaggctggtgccctcagagcgcttggagcggccagagactcgctggagctcccggggtgttgccgggcagggaggcaggggctggaggggagatgggccagctctggagggtgcctggttctgggtgtgggtcagggaagaagtgaaggttaaatcagcgagtgacaggtgaaattccatttctgacaaagattatgggtttgtctgtgtctcactcgaatctctgggtattgcttttatatttcttgaaactatattaggtacctatgtattttggaacatttaattttctgattgaacttgtcaaaatgaagtatgtttatcttttttgttgtgaaactttaatttttttttttttttgacagtgtctcactttgttacccaggctggagtgtgatcttggctcactgcagcctcggcctcccgggttgaggtgatctcccacctcggcctcccaagtagctgggactacaagcatgtgcccat

SEQ ID NO: 19 - DNA, 1118 bp, Homo sapiens
ctgcaatcacagcactttggaaggcagaggtgggaggatcgcttgagcccaggagttcaagaccaacctagccaacatggcaagaccccatcactccaaaaaaaaaaaatgctaaaattggcagggcgtggtggtgtgtgcctgtggttcaagctacttgggaggctgagttgtgaggattgcttgagcccaggaggttgaggctgcagtgagccatgattgtgccactgcactccagcctgggtgacagcaaaaccatgtctcaaaagaaagtcaaagtcgtaacagtatagaacgatgtgaagaaggaaaaaattagtcaaaatccagggtctcagaaacagctggagggacatggtgttggtggccagtcatcctgatgtccttagcgttttccacaggtgcctgccctgtgctgtcctggaacctggtccttccaccgggcagggggtcgagggcaccttccagcacagacaccaggacgggattccatgtcctcccccatggcgtgagcgcttcctcggagggtgccccccgccccggtgtggacactgtgctgtgaacacccctggcctgtgcacaccccatggcattttgcagctgtttgcatgggccccactgccctcccctgctctctgggtcctccgtggggtcctcccagcctgcccctttcccatttggcctcttggctgcctgttctgcccactctctggacatctgatctttctgatctttcatgtggcttcaattacccgcaatctgtacctgggtatattctcaaggtcacctcagccaaggtatcatcaaagccgaagtcctgtttcaccgcttccctgcaccagggactgcctcgggctccgtgtccgcgctcactggaccactgctgtgtccttggggtcactcccacgccttggcctgtgtgtggctaccccccccgccgccggtccccctacccaccctgcccatccctccccaccgccggtccccccacccaccctgcccgtccctccccctgctggtcccttccctcccccctgcctgtccctccctgctgcctgtcctccctccgcccgccccgcttcttctcctcccctggaccatcccttccccaccccgtc

SEQ ID NO: 20 - DNA, 1152 bp, Homo sapiens
atggctgccccacccacccgtcctgcacgggccaccgttcctgcccggtcacctggcgggggcggttgttctggacgtggccgggcctggtgctgacaggctccttccccatcctgttctcactcccagggagcaaaagcagtgggtccacccggagcagccgccgggccccgggccgtgagaaggagcgtcgggcggcgggagctgggggcagtggcagtgaatcggatcacacggcaccgagtggggtggggagcagctggcgagagcgtccggccggccagctcagccgtggcagcagcccacgcagtcaggcctcggctaccgccccggggctccccccgccccaccccacgaccaaggcctatacagtggtgggggggccacccgggggaccccctgtccgggagctggctgccgtccccccggaattgacaggcagccgccagtccttccagaaggctatggggaacccctgcgagttcttcgtggacatcatgtgactcgtggcgcatgccccagccctgcctgaggtggggagctggcggtcctgccgcatgcagagctcgcgtgggcttgccttcgtgggggccaggacgggaggcagggtggggggcaggctggaccaccaccatctgccctggcagcctggctgctccagctcctgacagcacctgtgtctgagcagccgtgttgggggcgctccctctctgcccctcagcgagagcctcggacctcccaaccccttgtgtctggtggggatccctcctgggatgaggaagaccccctcgggctctcggctgacccccacctcctgcacagctgtgcccaggcccccagggtggtccatgcggggcaaccccctgcggtgcacaggccccctgtctggagtagggatctaatttatttatttattgcctggccggtgactcgggggaggaggcgaccctgtcatctgtcccacctgctgctgccccttggagcagcctgcaccttctctcctcccatccggcaacagtctgaaagtacgtggaggacgggaccggaagacgagagagggctggacatcctgcccaccgtgtcccagccagggcagggagggaccatggcccgcagggtcaaggggccccgatgtgcacagctgccacaggg

SEQ ID NO: 21 - DNA, 1193 bp, Homo sapiens
cagccccctccaccttcccgcagcccttctcttccccagaggtcagaagccaggcaggaagacctaagaggggctatctgttgaggccccagggagggaggaagcctgtccctgccctgagggcctgaccccaggctaggtctcaagagaggctggaagccagaggcctgaggccagtcccgttgctgacgcggatgtggtccagctggggccctgacaggtgtggccactggtgaggccagaggtaaccgggctgggaggggggtgcatcttcaagccacacctccccagaccagcctccctccctccccatccatgcttgtgtggggtccttgtgggcaactgtcaccctttcccacccccactgtcctgggaggactggaggatggggttgggtggtgacgccagcttcaagaagcagcagttagtcgctggtctgtgctgccaggaccccgggccacgggccttcctgctcccgccactcctcccaccgcctgaacttgtgctgagatcctgcacccaaccagctgatgcctgagcgggaaaggattctagggccagatccgtgctggcctggccaagactcttggaaccaccctgctgtcccgggctgtctctgctggagcctctttgctcccgccccctttgcaagtgtctgacccgcatcccactactcccgctcctcgtccctctgcctctccaagagctgtgctcccacggccttccctctggcctcacagccaccaccacgtcccccctcctcacgtccaggtcagccctcaagggaatctgaactcctccacgaccagaagccacacagaactagctcaaaggtccccttcccaggacaccgactcccagaggacccagacccagacctttcagcccaaggaatgggatgatgtcaggggttccaggtggagacgaggactcccaggcccagactcatgccttgcccagccccaggagacggagtttcagaagcatacctgggacaagtctaaaaatcagatggggactttattgtgatggtggcaggtccaccagcagatgcaaatgtggggtgctgagagtggcaacacaggccaccccaaaccaacttcactccctcccctgtcctcagccagtacagaagccaaatgtagccccagccctagactccagcccaggcagagtccaagggaggggtgtca

SEQ ID NO: 22 - DNA, 1288 bp, Homo sapiens
aagcctggacttcctgtgtcccccaccctgaagagagcagtcagtgggcttcctctgggagctgttgacttggcgcagggggaccttttcctggggagggtggagggacaggctagtgcagacttggtctgtttctccactgacattgcatcccatgggagaggggcagagaaggttctggggccgattttagcaatgcatgtgctagaaaggaaccctaaagtgcaatgtagtatttgggggattctggggattctggtgaattttttcccatggagttaagtctgtaagggtcatatttttgctgactgaattgtctggtgctatgacatgtttaatagagaacctattttgacttttcttttctgtactctttcaatcaaagggtagcctctgagggtaagtgactaagacttctcctctgctgtccaagcgctttggtgcagggacagcggcatcttcagccaatccagtgcaggctctccaccgaaggctggctctagactggtggtacgcacatagcatagccatggccgactcctgctgtggttctctgacgattgtgcttcttgttaatcctctgtcgtgctttggtaatcgtattgattagagttggtaactgtcttgacttgaattttgtccctttaaaactgctgtacctgtatgataaagatgcagtacctttctcttaaaaaaaaatgctatggaaagctgtgagaattgaagagacaaattggctgtgtcagtgtggggttatgtcatgatttctagaagccctgaagttgctcttttgagcagctttgcatgacacgctctggtaaaaggtgtgcatctttaaattatttcatggatactttgaaaaatattgtatcacttcaaatacagcaataagtttatatgttctcaagatttcatttgtttttaagaattttaagttcgtggattaatatcactacttgaatactgacagttgttgattagacaccgaaaggttactgattgttgaatgtatctgtgttagagctgtgcactggcacgcttgcatcaggggctggggccacacggccgccacacagattcccccgtgatgcctggagctgcttccagagccgggtgtctccaagaggcacctgtaggacttcccatttagaaatctcttgagtgggtttgtatgttaccttctccaaggtttatttaggacagagatattgctggaaggtcatgggtcagattccctcacaacccacctcgtctgcgggtgcagccccactccaaggctccccgttat

SEQ ID NO: 23 - DNA, 1213 bp, Homo sapiens
gtgtgagccaccgcgcccagctgggagtttatttcttagatgtgtgttaacttcagctgaggctcctgtgtgcctctgtttcatggccttcgggtgttggccgccctctactgaacgtggtccctgaggccgcagggactgtgcaaagccggatgtccaggccctgggagtccaatgggggcagtcgattctatggatggcacatcctctttgcctgccctgccctgggccctctcttggcccacttttctgggtacgtttcaggccctcatgcccagttggggccctagcatgggtcaggccctccgcctggtgtcgccttcttgcccgggctgagtctttggtttctttctttgtgggttcaatgtcgaacgctttgcgtcagtgggacttctgcaggacctgggcggcgcaggtgtccggaagatgggacaggtttctgttccgatggcgcctctctccccttcctcccgcccggcagtacttaggttcttccttcagaaaggatttccccatgacttgaagagcaggctctcgcacgcaggcccgaaacctgctcagcctccccgtggccctgagcctgtctattgaaggccccgcctcacccgccagcggctcctgtcctctcgccttgctctgagcctttgcctcgtggcactcactggcaccgtggttttgctgccggaattcaggtgggatcttgcgtccctgtgagctcatggcttggtctgtggtccctttggtcctcctcaggtcctcacagcctctggtggggcttgcaggtctagccctctgggcggggcctcacctcgcatctcctcgccaggagatccagaagggtggctgctcgctcatccttgtgtagctgaggaggctgctgctttgtccctgaagtagacatttctccttaactgaatgattcttaatttattgcctcatctacataaatagttgagaatgacgtaaaggaggaaaggacttagaactgtccaggcctcagggaagagctggccttgaacgtccatgagctctgccagccagtgacaccagtcccatccccaggagcccccacggcctcacccccggctgtgtcttgctcagggatgtgcagggagggtgatccctgtgcccaccatgaagctgccactggacccctgcaccctgaccccggttcctctccgtgagccggtccctgcacctgcccctctgcatg

SEQ ID NO: 24 - DNA, 1149 bp, Homo sapiens
caggcgtgagccaccatgctcagccctactcttgtatttttttttttttttttttttgagatggagtcagagtctcaccctgttgcccaaggtggagtgtagcggcttgatctcagctcactgcaacctccccctcccaagttcaagcgattctctgcctcagcctcccgaatagctgggattacaggcatccgctgtcatgcctggctaatttttgtatttttagtagagacgggggtttcaccatcttgaccaaactggtcttgaactcttgacctcgtgatccagctgcctcggcctctcagagtgttgggattacaggcgtgagccaccatgcctggcctcttggaatatttaataagctaaaaaattcttatacacaggtagattaattaggtagccaggagtggcccctgaaagtatgtctggcaaaacctagaactgcatcctagccatcactgtaccttctgccctccctgctgtctcctctgccagttacagttaaaaggttgtgggtgaggacgctgggcagagtcccaggcgtctgctgtcagctccccagcccggcctgcctgccgagccatctgggcgtcccacggtggagagtgtggtgcttgtgacgcggtggtgctgggagccatcctggtggcagatgtgggctctcactgcaagtcagtgtaagtccccagggactgtcagcagcacgtcctgctgcccctctctctgcagaagccctggtaacctgcgtttggaaaaatctctaaggatttctgaggagctgtcaggccatgtccttgtccaccctgtgtggggcacggcttcgacatggctctgctcccgtcgtgggctgagaaggagcaggtggggctgtgccttggaaaggaggccctcccgacatgcctttgtgcgaggtccctgtccatgctgtctccatcccggagccttacggcgatgggtggccacagagcctattccaagagtctggtttagggctgggtcttcccatcttcacctctgagtcttaggcgatgcgtgaccacgcagccccttccaggagtctggtttagggctgggtcttcccatcttcacctctgagtcttaggcggtgcatgaccacgcagccccttcccggagtctggtttagggctg

SEQ ID NO: 25 - DNA, 1204 bp, Homo sapiens
tgcccggcctagattaaaaatttgaagacatattctctactatgagccaatgaaattactcattttgtttctatcccatttgctgtcccttgcttttggaattttgtgtcttagtgtgactgtgattctttctctccttttgtctttcagcaaacggggattcagcgtccgatcctttggaacagggactcacgtgaagcttccaggaccagctcccgacaagcccaatgtttatgatttcaaaaccacatatgaccagatgtacaatgatcttcttaggaaagacaaagaactgtatcccagcgggttgccctttaaaaaccccccgtgtggtcctccctggaaggtgttacgtgtggctcgggcacaggaggcgtgtcaccctgtgcagtgcacacactggctcctctgtctttgcgagagcttggtttctattcctggtgcacgtcggatcgtccacgggttagttccagtgccacccatggcagtaggcgtggtgaggcgcacagacacggtgtggggttcaccctgacgtggttcagcagagggtcgtgacatagcgtagaccagggatgcttaggtgaggaggtggaacccacaaaatcccattgcttttcacactgcagggctgccccgttatttcctttgcaggttggtgtgcgtgcgtgtgtgcgtgcgtgcctgatacacatggagccgggctgcttcacacatctggtgaggtcgttagaaggtcagataaagaagagggcggagcttgctaaccaagctgttagaagaaataatgggagagaacattccttcatttcaggaggacacagagcaggctaggtctgccgcgaagactcctatagagagaagagtattcttaaactagattctgatggacgcaacaccagttgcataatggttatgacaatcagtgcccgggtttttgaccaggcatttcatggtcacccccacgctaatggaaagtttctggatcttattttgttatagtgagtgatttgtagttttcagaacggaggccaggccaaacgtattccaaatgaaaagagaataggtgtcaaatgctaaaccttttatcttcgtgttggcactgttgccatccccgccctctcccgacatccccgcccttgaccagcatctctggccttgcccagcattgtctatgtattggcactcttgccatccccgccctttc

SEQ ID NO: 26 - DNA, 1101 bp, Homo sapiens
tctccattctctccctctccttcccatgtatctctctgtctctgtctctggctctctctctctctctctgtttctctctctctgtttctctgtctctcttcatctctctctctccctatctctctgtccctgtctccatctccctccatctctctctgcctctctgtctccatctctctgcctctctctgtatctgtctctgtctctctccatctctctctgtccctatctctctgcctctttccctctctctgtgtctgtctctgtctccatctctttgtctctctgcctctctatctgcctctctctctccatctctctctgcctctctctgtctctgtctctctatctgcctctctctctccatctctctctgcctcactctgtctctgtctctgcctctctccatctctgtctctgcctctctttctgtctctctccatgtctctctgtccctctctgtgtctttctctatctctgtctttgtctctctgtctctgtctgtctctgtctctctgtctctccccgccctgctctctctctccgtctctgtctgcctctctctgtctctgtctctgtctctgtgtctctccccattctgctctctctgtgtctgtctgtctctctctctgtctctgtttgcctctctgtctctgtgtctctctctgtctctccctgttctgctctctctgtctgtctgtctctctgtctgcctctctctgtctctgtctctgtttctctctgtctctctgtctctccccgttctgctctctctgtgtctgtctgtctctctctgtctctgtctgcctctctctgtgtctgtctctctcgctctctgtctctgtttctccctgttctgctctctctgtgtctgtctctctctctctctctgtctgcctctctctgtctctctctctctctgtctctccctgttctgctctgtgtctgtctctctctctgtctctgtctgcctctctctgtctctctctctctgtctctccctgttctgctctgtgtctgtctgtctctctctctgtctctgtctgcctctctctgtctctgtctctgtctctgtgtctctccccattctgctctctctgt

SEQ ID NO: 27 - DNA, 1145 bp, Homo sapiens
cgtcctgcgcaaccgcagcgtcctcctgcagtggcgcctggccccggccgccgcgcgccgcgtgcgcgccttcgcgctcaactgctcgtggcgcggcgcctacacgcgcttcccgtgcgagcgcgtgctcctcggggcctcctgccgcgactacctgctgcccgacgtgcacgacagcgtcctctaccgcctgtgcctgcagccgctgccgctgcgcgctgggcccgccgccgccgcgccagagacccccgagccggccgagtgcgtggagttcaccgccgagccggccggcatgcaggacatcgtggtggccatgacggcggtgggcggctccatctgcgtcatgctggtggtcatctgcctgctggtggcctacatcaccgagaacctcatgcgcccggccctcgcgcgccccggcctgcgcagacacccctgaagcgcgaggccgcccgcccatctttgcgccacctgcctgagggcgcctgagctcccaggtcctccgcccgctctcctctcctcattcctgctgcctccttaagatccccgcggaggaggacctgccggcgacggctccggcactttggcatcatcacacgccctttccagccgggcgtcagactcccagactctggccccggattggcccctgggcttgcgctgctgtgccagccgcatccagggctctccccgctctccgcaggcctttatagaggcggccagggcatggagccccttccagcaagagccatgggcactccggctcaccccgcacctccatcctgtgccgaattgtcccagacagaccgtcgccattgctcggtcactgtgctttgcaggcctggggcgcagctctccaagcctgtcctgccccgccccaccccactgggcttaggttagcttcgtgccttagtatctcgggcccactgcaggagccaacaccctctgctgtccagggggggtctgtggccctaagattggccggcctctccatgcatctggccagcgtccccttggagacaccttcaccctcaagcgctgcagaagcatgaggtgagggcctgcagcgctctgtaccgtttagggtgttggaccagccgggagcctggcaggcctggcccagcggccagggtgagtgttctcagacc

SEQ ID NO: 28 - DNA, 1210 bp, Homo sapiens
caggtcttgggtgactgctggccctggggcaatggtgagaaagccaggcaggcagctgcaggaaggagctgaggagaaaggcggcagagcctcaaaagctgctggcggccgggcacagtggctcacacctggaatcccagcactttgggaggccgaggcgggcggatcacgaggtcaggagatcgagaccatcctggctaacacggtgaaacccccgtctctactaaaaaatagaaaaaatgagccaggtgtggtggcagacgcctgtagtcccagctactcgggaggctgaggtaggagaatggcgtgaacttgggaggcggagcttgcagtgagctgagattgcgccactgcgctccagcctgggcgacagagcgagattacgtctcaaaaaaaccaaaactgctggcccctccagagggtccaggatactgagctcctgagcctgggatccacgcgcatgtggtctgtctgcacactggcaccgcagaagggttggcaggcgggcaggcatggctggagaccccgctcagatgaggcggccactccagggcagtgccatgctggacagaagggactgccttggaagtgggacagaccccagacccttggggtgggggccctgcaggggaggccttgaggaggcgccgggtctacaggcccctgtgtgctcacatcccagcccccggggagaggtgggagtgggtgggcgcacccagctcccctgtccaggctcgtcccccttgttggggcagccctcagcaagtggggggctggttccaggcacaagaagtgaggccagggaggaagccctgcctgtgttcagcccagttgtgccccaactcaggtgggcttccatgagggacagcctctgggagggtgggggtttgtgggccagggctggagagctgcctggctgtgctaaaaataccgggcatgctgcagacaggtgccagtctggggcacaggctaccctgtctcaggctgatggccttggcactccaccccactgcccctgtgacgcgggggccgccaaggcttggtcttgattcccagaggccctgctggtgacctccccgacatctctgccctctgcccatccccccaagggcaagatttgccaaagcacaggacacattggctcacacatggggcaccctgcccctgtctttttggaaaggtccaatggcatatggccagcgggtcgggc

SEQ ID NO: 29 - DNA, 1286 bp, Homo sapiens
tgcctcttttcacatttctttaaactctgtttaaaacagcatgtggatgccatggagactggaagaccattccaacttggacgcgttaccatgagagcatatcctatccaaccgtactaacgtggacaccctacacctcccctcagaacttcaaaagggcaagatcttttttccttcacttattgctgaaaccaagagcacaattcccattgagagaaagatctctgtgctgtaaactaaaacaaattgtgcattccttccggggccatcgtctttgttttcttttttgtcttgaatgaattttaaaaggaaatatataataaaaatgttaaccagaaggtaaacttgagtgtaattgtcagacagacacacttttccaccagtgtatttgaattttagaccagtgaccctgttttgtggcattcatgcaaaacatgctgagggctttgttcatctggtcatcgtgtccaaatttcagtcatgtttgtagcaagattttggaagcattcatatttcctttttaaaatgtattcctttgtgttcaacagttaatcaaaaccagagagtctagggcagcctctctgatgttgtcaatgatgtaaattcagtccctggtttttaattttctgtctgatgtcacagatcattgttgcacacaaacgtggcatagaaaagaacatgttcagaagccatggggccaagcacatgcggggacggtctcaaatgcgtgatcagagaatccttcacctttgctgaaaagtgagctcagatccagcaccatgttcctcctgacccatcctgtctatcttctcagttgagtttttaatctcactttgggtttccttgtgaagttggagggaagtttataatagcctaacactaccccacccccaactaggaggaacctctgttttcaagagagatgcctgtcctgtgcttggatagtcagtcaattatttgtgtatgaaacaatgtacaaatcaatgttttgaaaataatgatctcagactttctaagttaaattttaaaaattttgattgtttgccatattgggtgggtttactcttagaatcgcatgctgtagaaatgctcaaaagtgcatatgggactcagtccttaggtgttctttttcttttaagaaataacctcttacagttgtaaccattgcggctctgtccacttctcgttgctgctctgtggcacatatcggaagcagtacagcgcgcggctctacacgcttgggtagcgggataagtcactgttttctttatttctttaaaaaaaaa

SEQ ID NO: 30 - DNA, 1121 bp, Homo sapiens
tgaaagcggaggaaagagactcctcccttgcctcccccttgcccaggatgcctgtgaggagcattcgggagcctcattaccactccctggtttctatttcaggatattgactgggtacagacagagaagcacgtgtttgagcaggcatccagcaaccccttcctggtcggattacactcctgcttccagacgacaagtcggtaagaaaaagaagggtatttctgatattctgcagatttcagatgtgaactgcacagaagctaagtctggtgtgatgtgtcaactgtcacctgtaaggttctcccagttgctgtacgggtgttttcaggccagcagactctctttgttgttctccttggttggtgtcatattaagtacatttcatgatctgaagttatttaattccatttacgaaatacttactggaggtatcccactgagtgcaggcattgggtcaggtgctggggctacaaaagtaagcaaaagaggtggatttctgtgcttattaaaatatgtacagcttcaccttcaagctttatatatactggaattctgtggctttgaatacatttgaaagctgatgatctaggatattaaatgtatgccctgtttaaaattttgggggccagttgactttgacctacctgatttgtttatttgaagagttattaagtatgttctgcattgagtcctcaagaccatccccaggttcgatgattggctaggaggactgctgggatcaatcatggccgcactgggggccacagctggcatactgcactggggagataaaggagacttggccaaggaaaaaggcacatggggaaaattccagaagaaaccagtcacaagctcccaagagccctctcccagttcctccagcaatgaattgtgacaactcatggtttttgtcaagggctggtcatgcaggctgcacacgaaccaaaattccagactcccagtggagagcaggtgttcagcattgcgttagtcagggttctcctgagaaacagaaccagttgtgtgcacgtgtgtgtgtgtgtgtaaagagatttattataagatactggttcatgggattatggaggctgagaaatcctataatccgccatctgcaggct

SEQ ID NO: 31 - DNA, 1127 bp, Homo sapiens
gtccatggcataccaaaagctgaatgatgacagccagtgtccccatcctgtcctccccaactttccacaggcagggacgctccccattcttgctgcatagtcttctgttgaccccatgtacctgagtgacccccacgtacctgagtgtgacaagcactatggtgcttgacctcagtccagctgcttagacctgtacctgccacagccccacgtgctgacaccttgcgtcttgagttttgataaatctatcctttggctgattaatatgactgagtggtgtcttctgaccccatttcttatctggaacactgtgtcctgacttcatttcctgtctggagcacactgtcctgacctcatttcctgtctggaacacactgtgtcctgacctcatttcctgcctggagctctctgtgtcctgacctcatttcctgtctgtgccgctctgtcctgacctcattttctgtctgtgccaccctttgtcctgacctcatttcctgtctggaacatgctgtgtcctaactgcatttcctgtctggagctctctctgtcctgacctcatttcctgtctggatctctctatgtcctgacctcatttcctgtctggaacatgctgtatcctgatatcatttcctgtctgtgccactttgtccggacctcattttctgtctggagcactctgtatcctgacctcatttcctgtttgtgccaccctttgtcctgacctcatttcctgtctggaacatgctgtgtccggattgcatttcctctctggagctctctctgtcctgacctcatttcctgtctggagccagtgacctcatttcctgtctgtgtcactctgtcctgacctcatttcctgtctgtgccactctttgtcctgacctcatttcctgtatgcaacacactgtgcccggactgcatttcctgtctggagctctctctgtcctgatctcatttcctgtcaggagcactctgtgtactgacctcatttcctgtctgtgccactcttgtgtcctgacctcttttccagtctgtgccactctgtgtcctgacctcatttcttatctgtgccactctgtgtcctgacctcatttcctgtctggagcactctgtcctgacctcatttc

SEQ ID NO: 32 - DNA, 1190 bp, Homo sapiens
atctggcctgggaagatgcagtaagggggttgccaagaccaggagctcatgcggggacgccgaggcgcgatgcggggccttgggaaagcggccctcacccgtcagggcggccaattcggccaatgggccattctggtcaccgccagaggcacaggcaagaggagggagccgggcgcagcaccttgttagccttgcagaggtggtgccgcctgcccgccgcgcctgcccctcctcgtggccctccccctgtgccgcctcgtccaccccatctcctgtctgtgcttctaaaagccgcacgggccactcgcagccgtccacagcctctgggcctggtgacagcgatggagcctctgcagcctggacaccgcccactgtgtttcagtgtttctgtgtgtttctgtgtttctctgtgtctgtgtgtctgtgtctctgtgtttgtttctgtgtttctgtttctgtgtgtttctgtgtttctgtgtttgtgttgctgtgtttctgcgtcgctgtgtttctgtgtctctgtgtctctgtgtttgtttctgtgtttctgtgtgtttctgtatttctgtgtctctgtgtttctgtgtttgtttctgtctgtgtgtttctgtgtgtttctgtgtctctgtgtttgtttctgtgtttctgtgtgtttctgtgtctctgtgtttgtttctgtgtttctgtgtgtttctgtgtgtttctgtgtctctgtgtttgtttctgtgtttctgtgtgtttctgtgtctctgtgtctctgtgtttgtttctgtctgtgtgtttctgtttctgtgtctctgtgtttctgtgtttgtttctgtgtttctgtgtgtttctgtgtgtttctgtgtctctgtgtttgtttctgtgtttctgtatttctgtgtctctgtgtttctgtcttcgtttctgtctttctgtgtgtttctgtgtgtttctgtgtctctgtgtgggcgccagtgtgtccacagcgcgcgtctgtggggacgacacaggcctcagacgtccagcgctgcagaacagccacacacagaccctgggtgaggcccgggtcgctgtgtcttcaccctgatccccagacaccaaccccgacggggaggccgagactgccaggccgatgccaggccaggcctccgaaagtcaggagggagcaggatgtgtctgcgcggtggtggcagctgctgcctcag

SEQ ID NO: 33 - DNA, 1155 bp, Homo sapiens
agcccaactgctgccagactgggtctttgtaaatgaaatcaaatacaagccacatacaatttcacgtcctgaaaccatttttaagtgtagagttcagtggcattgggtacattcacaaagttgtgcagccgtcatcatcctcatttccagtcgctccccatagcccctccccagcccctggcacccccctttctgctttcagtctctatggacgtagccactccagggacttcgtagaagtgtagtcacacaggatttgtccttttgtgaccggctgatctcacttggctcatgtcctcaaggttcagccgtgttgtcacacatgtcagagtttcccgccttttaaagactgagtcatcctgcgtcgcatggctggcccatgtctcccttgtctgttcctccgtggacagtcccagctgcttctgcctctgccacgctctctccagcagtgccctcgctctgagccttgcttctgtgctgcctgtgactcatctgcccaggggctacgggcctctttgggggttcaggacaccctctttgacctgtcttctctgtcccctcctgctgcggggctcccggcggggctgtgtggggtctgatctgatttcttccctgttccccagcagatgtgcactgggtgccttcttcgaagatccacgtgagtcagtaatggacaatgttgcctttttgttagattttactcacttttcatttgaggcttaagccccaagggatttccagggctgcagcaattcctgggtcactgtccccaccttgtccctgattggatgaggaagcagggggtggggtgagaacttcaccagcgggattgggggctctttgctgagtacttgaggacagtgactggcctccactcacacccctaaaattgggtatgtcccctgagagagccagggacatggctcctgcagatcctggggagacacgctgaggggcagcaacctagcccccagccccactcgctcctgaccctcagcctccaggcagcctcaaggggaggatggctacaccccggaccccagagctcccaagaaagaacggatccttgaaaatatccgcaaaacaaggccttttctgaaaacaaatggtggcagtgtttggaaatgagaggatggctggaggagtttctgcccc

SEQ ID NO: 34 - DNA, 1132 bp, Homo sapiens
cgggccctcccttctggtggtggagcaggtccgggtggtggatctggaagggagcctgaaggtggtgtacccgtccaaggccgacctggccactgcccctccccacgtgactgtcgtgcgctgacgccagggccgcctgtccgcgtttgtttggccggttttgcggaggtttctatgcggcaatgctgaattatccgttagattttcaccccagtttttttgttggtttttttttttgagatggagtctcgctctgtcgccaggctggagtgcagtggcgtgatctcgagtcactgcagcctgtgtctcctgggttcaagcgattctcctgcctcagcctcccaagtagctgggactacaggtgtgtgccactaagctcagctaatttttgtatttttagtagagacggggtttcaccattttgaccaggatggtcttgatctcttgacctcatgatctgtccacctctgcccctcaaagtgctgggattacgtgatccacccgcctcagcctcccaaagtgctgggattacaggcgtgagctgtgcctggcccaccccagcattttttaagatgtatgtattcgttgttctgtttttccagatgattctgtcgtaaagtgatgctatgttgtcgttacaacatcaaagtgattttacggtttttgatgggattattcaagtgtcagaattaactgttcaaaatgttctgaatcatgtagatacatggcaggtaactgtttatgggagaaaagtacagtgctgttacgtggcactgtacagtcatgtgccacgtaacagcgtctgggtcagtgacggacacttacctgacagcggatccacaatattctcgtgcagtgtgtttggaatcctggtctgggctctcgtcgttggccttgtagatcaagtaggggaagtgagtgatgttcagtcatgctgctgggacacttggttttccagatgaaaacacataaataaaactacatgcaccatcgaggcttgtgtaaagactctgtgatcacacagcagcggctaagcacacgtttctcatgtgtcactgagcgacacgtgactgtcactggttcggagacccgaaaacttgggaagccaaccgatgtgcgtttccttgaacgg

SEQ ID NO: 35 - DNA, 1224 bp, Homo sapiens
cgcgtctcacatgcataataaattgtgcagtcagcgaaaggctgaacaaagactcaaaagaatgcaccctccggtctcttctctacctgtgacctgaaagccctctcctggaattgtccagcctttctgggctgaaccaaggtacactcgcacgtgttgattgatgtctcacgtctccccaaaatgtacaaaaccaagctgcatcccaacttccctgggcaccatcgtcacgatctcctagggttgtgacactggcgtgtccttaaccttggcaaaataaactttttacatttcattgagtcctgtctcagatatttttgggttcataacccccaccctcacccctacccgcggagagagcgagccgctctccagcccctccccggctctacgcaggagaggccactctcctctatggcacgcgcggcggcactctagcagccaggtggcttctctatgggcttttccggcacaggtcggaagtggcgcgcgctgccccggaagcaccctggtgggtgggtgcctgccagcagctgaggcgccatggcggcggcagcggtgtcagagtcttggccggagctggagctggctgagcgcgagcggcggcgggagctgctgctgacggggcccgggctggaggagcgagtgcgggcggcgggtgggcagctgccgccgcggcttttcaccctgccgctgctgcactacttggaagtgagcggctgcgggagcttgcgcgcgccggggcctggcctggcgcagggcctgccgcagctgcacagcctcgtgctgcggcgcaacgcgctggggcccggcctgagccccgagctcgggccgctgcctgcccttcgggtgctcgacctgtcgggcaacgcgctggaggcgctgccgccgggccaaggcctgggccccgccgagccgccgggccttccgcagctgcagagcctcaacctcagcggcaaccggctgcgcgagctgccagccgacctggcgcgctgcgccccgcgcctgcagagcctcaacctcaccggcaattgcctagactcctttcccgccgagctctttcgccccggcgcgctgcccctgctcagtgaactggcggctgctgacaactgcctccgagaactcagccccgacatcgcccacctggcctcgctcaaggtcagcgggggctgcccgggcggggcgggatggggccttggagtagccctggagaaggaacccctc

SEQ ID NO: 36 - DNA, 1196 bp, Homo sapiens
ctgctggccactgggaggggctgcagggaggaggagcaccagccacactcccttccctgccctgcccttgcaggggaagagggaagccaagcccaggctctgcattagcaagaggcagagaaaggtgagtatcctggagaaggtttcacaaagctacttttttctttttgcagggagagtccctataacataattggacatcaaacaattatgatgtttgatatgagaaggaagcagagtccctcccatcctctgacacgtgcttgttacctgcaggcatatccacggggacagcttcaccctacccttccggctggggagacatcgcatttggaggtgacttcatcctgggaaatgctgtaccgcatgataggggccatttgctggaggagcaggggggctttcagacagcaaagagctctctgttggtgccctctgcaccttgggcacaaatcgagattggattcctggggaaactctttggaatatataaaacataacttactttttaaaccaatgacaggtagttgtatcgttatctgactggaaaacagatggtacattcaaattgcgtatttgaaaaggacttgggaaagagactattgacagagaaatgggcagtgtttggagaattactgggattcagcagccagcgtctggccctgaaaagacagaggagagagcagtttctagaacccggagatacagacagaagaatggagaaggtgcctagcggggagctgagattctcattcaggggtctctgccagcctccaggagcgccaggagggagccggtgggataaattccccagcctctctctttcccctgtttcctgcaagtgtgctctgttggccaaacccagcgggaaaggcaagaaccataaatgcggggcaacctccccaggcacacagcagagtggatgagtgggaggctcagcagaaggcatccagcaagatgaggtcttcaggttctcccaaccctggaccatctcttctcagattccttggtggagttttcttcctctaaagagctgacgttctcaggaccccaacctccgcccttctttcactctgcaggttctgattttgtcttagattttacatcaacacaaacacccaggcaacccctaagtctgtgtctcccacttaaccccctcctgagtcagaataccctactttttttctttttttttt

SEQ ID NO: 37 - DNA, 1274 bp, Homo sapiens
gaatagtgcttccagatgtggtctcccgtgtggggcccagcaatgggggcccctgatgccaagagctctggaggttcttgaaagaggggacacgaaggaggagtgactgggaagcctcccatgccaaggaggtgggaggtgccctggaaatagctgcctcatgccacttaggccatgactggatttaatgtcagtggtgtgccacagtgcagaggctagacaactgaaaggggctaccaaggctgggaaaaaaatgcaattgttgctgtgagtgactttgaaagactctggtgccttgtggtgcccttctgaaattcaaacagtaatgcaaaagtgtctgcattagaatttacggtgtctaaaattcatgtttttaaaagagcttgcctacagatggtttccacacttgaaattgtgccctgcgagttgcatagctggaagttcaatgctcagtcctaccttggctcccattaaacatttggtgctctgtggattgagttgaacgtgttgaggctttgcaatttcacttgtgttaaaggctctggcatttttccatttctatgcaaatttctttgaagcagaattgcttgcatatttcttctctgccgtcacagaaagcagagtttctttcaaacttcactgaggcatcagttgctctttggcaatgtcccttaaccatgattattaactaagtttgtggcttgagtttacaaattctacttgttgcattgatgttcccatgtagtaagtcatttttagtttggttgtgaaaaaaccctgggctgaagttggcatttcagttaaaagaaaaaaagaaactagtcccagatttgaaaacttgtaataaaattgaaactcactggttttctatgtctttttgaactcttgtaatcgagttttgatcatattttctattaaagtggctaacacctggctactcttactgtacgaggctttgttttttttaaggactggcatgtgaagaaaagctttgtcctcacgaattagttgctgtaccaacagttacgttggtctttattaggcttagaagaaaagatgtcctttatttccacttttcttcccttagttgtgctgttttgccgcagtgagattcaggggttggctgtcactgaactctgtgtagaatttctccagatccagagtctggggatcaactttgccagcaaatgccgttttctgatggggaataggtagtgtcaacttgaattccatcacaaccatgacaccagctgcgcccaaagcacactgtagac

SEQ ID NO: 38 - DNA, 1149 bp, Homo sapiens
agtgttgtaataagattctaggttttagccttaaccttgtccaagctggagtggacaggcacctagaatactttgcaactcccttcatgagaaggtggatgagacaggattaagggagatgagctaagacggatcaggaccctactctgaacatgtaggacaaggattgatttcatatgaaaattgtgggtatgcaaggcattttgtatgcctgcactctaattttggaaaaatagtatttttttgaaattgggaatgttagggcaaacaaaaggaagtgttcattttattgtggttcataaactaagagaccttcatgcctgtagagattggggagactggaaagtttgagtgagtcaagagtgctagaatgatttccccatcaaaagggcatgaccccaggccccaagcttgtacagcagcatctgccccattatacctctggcactcaggcagtgatgcctcttggccctctggcaaagggagcacacttccgttagttttgtatttgtatggacttttatacctatgacgtttctggttctgttaatcttgtttttccgactgactgaaacttcatctctgttatcatttgtgtattttcttagaaaaagcttgtggtgaaggggggcaaaaaaaagaagcaagttctgaagttcactcttgattgcacccaccctgtagaagatggaatcatggatgctgccaattttgtaagttacatccttattgccactcgggtggtcacgaacattttgagatactgttgagaaaacctactggggtacatttctgttttcaggcttataggcagcttcacaggtctggctgtatcatctcaccctgggaatgtgggcagattacttgtttgtttccaagtcttgtttcttcttgtgtgtgcaacagttgtgaggagtaaaaggagatgggcttagaataagcaagaagggctctagcacagaggtgttagaggactatcttgtttttctcctttagtttccacaaatgattttacttaaaagttacccagaaacaagccaggcacggtggctcacgcccgtaatcccaacactttaggaggctgaggcgggcagatcatgaggtcaggagttcgagaccagtctggccaacatagtgaaaccccgtctc

SEQ ID NO: 39 - DNA, 1122 bp, Homo sapiens
gggtattcctagctcaatgcttggtgttctagttcaacttttatcctgcagcaagtaagcctagataactctacacgatttggctgagtggctttgtgtgaccgtggccccaggccaaggggatcatggccctggctggctttcccgggggtctcagctcctgttgtcagtgataggcggctcaaaggagcatcagtttcttttgatccaagaagtgcttactgaatgcctgccctgtgcgtggccttaaacattgagaagtgctgctctccgtttatttgggatttgattctcattttaccatagcttatattctcaatttcaatgccagtctcagaactcttgttttctgtgttctgttctcaaaattacattgtccctcatgtcatttcaaactgttttccaaagggatttgagcatatacaactacaaatccaagcagattgactctcaaaaataatcttaaatactgcaaatagtcccaactaagattcagtcagtatgtttgttttgcaagtttgggagagtaagttggctttgagtcacacatcgaagctttaagaggtgagacgctggcttcattctggactagacaggaacttggcctcagcgtgagatcctgccatgcagtgttgcggtggcactgaagaagtgtgaatgtgaaggcggcgtcggcgcggggccagagcaccactctgctgccccaccacgcggcctgtgaggagccactaaacctttccgtgcctagacctccccatctgtggaatggggtcaataccacctacctcacaggggtgttgtgaggactgagaagaacaatgtcaaatgtttttaatactcagatgtgggagcgacatcaatgaaatctgtactgtatgaaagctacacaaaaatgggcagacatttggttaattgtgccagatacctaaaatgtatgttcagaaaagcattttatcaactcagaaatatgacttatttctagatttcatggcttaatgaattttttcattgttatatataccaaagaggcttacgggttcattgattggtttgaaaaccagacagacggccgggcgcggtggctcacgcctgtaatcccagcaatttgggaggccaaggcgg

SEQ ID NO: 40 - DNA, 1153 bp, Homo sapiens
aaaaaaaaaagttacatagctttagctcttaccatttaggtgtttgacctatcttgagttaattgttatgtgtgatgtgcggtaggggtccagctccatttgcacgtgtggacacacctctttataggctggggagcaggcattagaggtggagctacttgcttgccgtcacagctggcaagtggaggccaaagacagccgctgcatcctttctttgaactcttatacctgagggtcatttatctctgacctggaggacagaaacagaaagcccttgagcaggctgagcgcagtggctcacgcctgtaatcccagctctttgggagaccgaggtgggcggatcatgaagtcaggagatcgggaccatcctggctaacacggtgaaacccctctctactaaaaatacaaaatattagccaggcgtgatggcgggcgcctgtagtcccagctacttgggaggctgaggcaggagaatggtgtgaacccgggaggcggagcttgcagtgagccgagattgcgccactgcactccagcctgggcaacagagcaagactccgtctcaaagaaaaaaaaaagtccttgagcaataataaaactaggactctagggacattacttctcaggggcaggccacgccgtgcacctgtccacatctgtttccctccccttgctgaacaccagcccctgccctcgccagcctttctgtcctccttccctcctcctccccctaaatgttcatctgtggcttttgcctgtcccatggcacatgataggctctcgctgtctgggcctccctgggggtaggtccccacaggagaccttaccagggccatgccagacagctcagatgtctctgtgccctgccttgaatcctttggcctcagggctggaggttcagctatggcaggtcaggggctggcagctgagctgtgtgaggctgggagcttctctgagccttgggagagtaaaggaaaccaagtccctgattcaggagggccagagcattcctcttgctggctgtgtgcccatgagcccgggactgggagaaggcccaacggtacctgcccccatgggacttgttggctgggacctgggaaggcccgtggtctgtgtgctttgctgtaaaatgtatcactgggggactggaccatct

SEQ ID NO: 41 - DNA, 1194 bp, Homo sapiens
gacagagtaagaccttatcttttaaaaaagaaaagaaaaatttaaacgggtttgatagatataaatttggacccaagagcccttccttttttttaatcctgaggttttatgctgaggaaatttctttcaaatctggaaaacctcggggccaggcgcagtggctcacgcctgtaattccagcactttgggaggccaaggcaggcggttcacgaggtcaggagattgagaccatcctggctaacacagtgaaactccgtctctactaaaaatacaaaaaactagctgggcgtggtggtgggcgcctatagtcccagctactcaggaggctgaggcaggagaatggcatgaacccaggaggcggagcttgcagtgagccgaggtcacgccactgcactccagcctgggcaacaagagcaagactccatctcaaaaaaaaaaaataataatctggaaaacctcttctgggggctcttataaaagtagatttgtccaaattgacttctgatctgaggccagagacaaccacagggcagagctggagactgggctgttttgaaggaagaaggactggcagaccagctcttgggaaagctccattattgcctgtgggaggctggacctgaacttgcacctatgaacaaccctgccatttagagctttttcctgggggtgccggcggctggtgaccagactgccattctccacgttctccctggtgcttccgactctgtcctctaggttggaagtggtttgtgtaaacgggtgatgggaccaggtcacatcatttctgcatttaagacagcaggatacttcctggggctgaggttcaaactggtattgtgaccaccgctttgacagaattccatcttcccagcatgatcacattgtaagactattaggatgtgtgggttttaacacttatatacacttatacaactgttggttatcattgtctttagtattttacagtggcccctcagcacctcttagacccaacagcaaaggacttaaaataagcacaggaaaccttgctatggtgattagttttgatacctttgagacaattgagtctagcttcttagttgccccttatttatgttgaaatctggctcattcatatgatgttttactgtgctggccttgtaaagaattttaagacaatccatcaccatcaatgttttgcctttctccact

SEQ ID NO: 42 - DNA, 1134 bp, Homo sapiens
tatctaattttgttagatattcttgatttgccctcagtgattgataattgcacacagtgtagaatggttggttcaacagacttttttctcaaattgttgaaggccttgttctgttgttttctaagatccagcattgccgataggaagcctcacactaggctgcttctcttttttttttttttttttttttttgagacacagacacagtctccctctgtcgcccaggttggagtgcagtgccacagtcttgactcactgcaacctccacctcctgggttcaagcgattcttgtgcttcagcctcccaagtagctgggattacaggcgtgcaccactgcgcccagcctgcttcacatttctttatggtatctttattttcagtgttgatgaattgcaagaggacggggcccttccttcatcctcttctgtggtgagctggttccaactgagccttacctgcctcagcaagggcctgctcttcctttccttgggttgctttcccagtcctggacttcacagacctgtcttctccctcctttcaactctgtttgcatatgttctgtccgtgtgtttttgctttatgttttcagaggttgccttgacttgattctacatcactcacctggtctagagccagggcctcctgctgaatgtttcctgtgcagtcatgtcttaccaggcattttctttttctctggagtctcctgcggaggcagtgaaggctcgagagaaagcagaaactgaaaatagacgtggataacttcaggaatacagttggcaacacttgttgatgggttggattttggggcaggagacaaagggaggaaacaatttatcttctctggctcacaactgtgtgaggcttgattaatttagtactgaagaaaaaaatatgcattttttcaccttaaagtttaaattgttgatttcagagtccaactccccagattaaacctgaatatttagccttgaggtctgttggcatcagaagagagaaaaaaaggaaaggccttcagttaactgagagtaccctttcagccctggaagagttagtcaatgtttcctgtggtgagtaatacacattgatcaccctgaatgtctgtccaccagacccccagaggaagattagtcataa

SEQ ID NO: 43 - DNA, 1081 bp, Homo sapiens
tttagagaagagggcatttagactgcattttcctggttaaagaaggttaaagcaaatgtttattgccttttctagtgaactaactcgtagagatgttctcagcaggaagacagtcttagcactgtcacttagcagattgcacttaagtcccttgtgctggccagatggcgtggctggttgccttaatatgtcccaggacccctgacagggctgcctggcctctccctcgtgctcctcaagagcccagtccatacactgtggatgtcattgctgtcgggttaggaagtcttgtcctagaacgccctggctggtatgaccacagttcatggcggctcttctcgcttgggtcatggtcatcttccagcacctgctgtgctgggaaggccgaggatgggggcccagcactgtccaggcctgctggggcctggctgggagtcctgtgggcagcatggaacatgcagctgggcttcctgtgaccaggcaccctctggcactgttgcttgccctgtgccctggaccttttcctgcccttctccttcctctgctcccttggggctaccccttggcccctcctggtctgtgcaaactccctcagggagcccccctgccctgtagctctcgcttaacttcctaggggctgctgagcccacccagaggttgttggagttcagcggggcagcttgtctcccttgtcagcaggggcgtaagggctgggtttggccatacaaggttggctacgccctcaatccctgaccgttccaggcactgagctgggcacccacggaaggacatgctgtccagactgtgatgactgccagcacagggcatctcgggcttggctggtctgcgaggccttgcccctgtggaactctgggttcctgttttctcagtcttttttgcggctttgctgtggttggcagctgccgtactccaggcttgtgtcggccactcagatgagggctgtggtgcgagccagtgcaggagagctgcgcttgggattgtgccctctcctgtgtctgtcctccggacctacccaggtctccaccatcaggaccctgtctttgggtttagaagaccaagt

SEQ ID NO: 44 - DNA, 1101 bp, Homo sapiens
taacgggggcggggacctcgaagcggctgctcagtgtgtgggctgccagccaccttccaccttcctcagctgcccacctgggagcagagacgccaactagcccttgacccatgattcactcagagcccatgatttgtgccctaaaaggggggctggggccctttcacaggtagaattagagtgagcgcgttggaaactgcggcttgagtggcgggggatgaaagcagacctctacgttccagcagcagttgattttcagcagcgggtgctctgcctcgcctgggcccagccagctgctggtccgggtgactgctgagccccatcagtagaaaggtgcatgggaatggccaccttctgatcacctgcgtctgtcttttcctttacagcccacaggatcgatacagatggataaactgccaagaaccagatttttaaaaggccgcaaaaaatcttttcctgggagtctacaaatttggaaatgaaaaaacccagacatcagatgtttttattttatattattattatagaaggtggtaccattatcaattatgtgaagggacatgcagacaccccagcttttgagggtgctgggggtaggactgaggcagccccactgggaaccagactgcagcctggcccatggctgttttcccaaggatcagttcctggagggaagggctctggccctgactccgctgtgtcccgagcacacgtgctgaccgcagcccgccgccctgtagttcttggctgggtctggaggtgtctgtggagcaccctgccctcaccacaggagcgtgagccacttctgcagtccacgctgaacatgggaaacaacctgaaaagcaggcaggcctcccggtcagggagcctctgctgtgctggcttcccatgaccacctcctcttgctgaaatattactgcttgaatctggagcagattgcgggtttataaaactgctttttatctgagaacaaacgggtttggaaattagtcgtcttttttccccactcccagagctgctcaagtcattccaccggccccctcggcttgggacagggtagtgtaactcccgatcccagggcctagccctgacacaggtggc

SEQ ID NO: 45 - DNA, 1170 bp, Homo sapiens
atgtcacactcctagaactgtatatccctgtcccttctagaacgacagcagtgtcttcatttcctatatggtgggtgcagtgatgtctgtgtgagctcagataaaagaattggtggagggtaaataatacctctttcttccagaggaagatatagctgaaggagtcctagaatggagcacatggagtttattttatttatttatttattttggagacagggtcttgctctgtcttgcccagcctggagtgcggtggtgtgatctcggctcactgcagcctctgcctcctgggttcaagctattctcctgtctcaaccttccgagtagctgggactacaggcgtgtgccaccacacccagctatttttgtatttttaatagagatggggtttcaccatgttggtcaggctggtctcgaactcctgacctcaggtgatccacctgcctcggcctcccaaagtggtgagattacaggcgtgagccaccacgcctggcctattttattttactttatttttgttagagacgaggttttgttctgttgcctaggctagagtgcaatagtccgatcatagtccactgcagccttgaactcctggggtcaagcagtcctcctccctcagcctcccgaaaaactaggactacaggcgtgtgccaacatgcctggctcattgtttagttttttttagggataagttatctctatgttgcctaggctggtctcaagctcctggattcaagcagtcctcccaccttggcctcccaaagcactgagattagaagcatgagccacttcagcaagcctggagtatatgttttttgttttgagacaggtctcactttgtcaccccggctggagaatagtgatgcaatcttggctcactgcaccctcaacctcccaggctcaggtgaccctcctgagtagctgggactacaggtgtgcaccaccatgcctgactaatttttgtagagttggggtttctccttgttggccaggctggtctcttaactcctgacctcaggtgatcctcccaccttggcctcccaaagtgctggcattacaggtgtgagccactgtgcccaggcacagtggcatgaataactttcttatcaaacatgtattgtaggctgtacaaacatgtacaaacatgtacaggagttcgagaccagc

SEQ ID NO: 46 - DNA, 1217 bp, Homo sapiens
cgggaccccacgcgccagcagcggcttccccgggaacgtccttcagccccgggagcacgcgggaaaagccccagcgtgccaatgagggagcgccttcctcatgacggtcacgctcgggggcggggcttcccttcgccgctcccgagttccgggaaccccctttgattggtctggacggcctgggaaacactgtagtgacgcccaatcaaaacgccacgtctcggcctcgaggaaatattccgtgtcgggcccgtcctgattggacagttctttcgggttctggccactaggaagctttgtttaggtccggaaggcgggctttcctgggagtgggtggggagggggcgttgattcttgaccaatcctttcagtccgttgggtggtgaccagccaatgggccggatggataggacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaaggtaagagccggagcgcgaggggctggggggcggcgcggcgggcggcgggacccggccccgccggacatcccgggcatcggcggcgccgggcgggagcgcgggggcgcggcgggcgggcgggcgggcgacccggccggggagggggccggcggggtgggggggcggagcgcggccgagtcctgaggtgactcgcggggccggcggagcgcggcgccccacaccccacccccgggggcgggctggggccggagggggcggggggctcgcggggcggggaccgggcccagcgaggaggaggagccggcggagggccggcgcctcccccacccggaccgggcatccccgccgctcccgagcccgctgcgcggcccccgcacccccggcgctgggtccacggtgggggccgcggggcggaaagtttatccgcctcgggtcctcctggccccgcgccccactgctccgggccggtccccgtcgggcggcagcggccggcgctcagccctcgccggccccctgctctccggcgggcagggccagatgtactctctccggcac

SEQ ID NO: 47 - DNA, 1197 bp, Homo sapiens
cttagttatcaatgtactgtataaaaatcaatactggttgggtgcagtggctcaggcctactctcaacacttcgggaggctaagccaggaggattgcttgagttcaggagtttgaaaccagcttgggtgaacagtgagaccccatctctaaaaacataagattaaataaataaataactctagcttgtctatataaaatacttgccttgttacagaataaaatggaagaaaaaaattccatttaaaatagcaactggggctgggcgtggtggctcatgcctgtaaccccagcactttgagaggctgaagtgggtgaatcacttgaggtcaggcgttcaagaccagcctggccaacatgacaaaatcccatctctactaaaaatacaaaaaattagcctggcatgtggtgcgcacctgtagtcccagctactcgggaggctgaggcaggagaattgcttgaacccgggaggtggaggttgcagtgagccgagatcgtgccactgcactccagcctgagcaacagagtgagacttcatctcaaaataaataaattaaaataaaataaaatagcaattggctgggccgaaggtagtgagttatctcgattgattgcccacagtcagttacagatggaactccttcctctactctttccccaaccctcactgctgcacttgactagtcttgaaaaagaaacagatattggaacaatgtttaaaaatcaagggaaaagcctaatgagacattaggccttcattacaggacccgaatgaagaggctgggtcacccagtggttaggggctcgggctctgggagctgaaagtccacgtggcgcaaatggctctacttccacaagcctcggtcgcatctcctggaaaatgttgccgcttctcttcctctttccacacgtgcgctgctgtgggcgagggaacttctaaaggggccatgccgggcgagtgctgggcttggcagagaggaagaaggacgtcggtttttaccttacgcccgtctatgagaatgcaccactttgatcattcaagaaaattagctagtaaagttcatctgggccgggcgtggtggctcatgcatgtactcccagcactttgggagaccaaggcaggcggatcacctgaggtcaggagttcaagaccagcttggccaacatggtgaaaccccatctctactaaacatacaaaa

SEQ ID NO: 48 - DNA, 1147 bp, Homo sapiens
ctcccagactcctgcatccaggcccccaccttctcggcttctggtttttctttctttttggtagaacacaacatctaccattcagttaaaccttctttatctcctcctttggcatccatttttccaaagaagagtcgagtcctctgaggtctgtgcttgaaagccgtccgaaggcattcttgttagctttgcttttctccccatatcccaaggcgaagcgctgagattcttccatctaaaaaaccctcgacccgaaaccctcaccagataaactacagtttgtttaggaggccctgaccttcatggtgtctttgaagcccaaccactcggtttccttcggattttcctccctttgttcggggtttggtttggctcctctgtgtgtgtccgtatcttgttcggtgtcctcgaggttgagcttcactccactgcggcagaggcagcgtgcacactcggatttgctacgtttctatatatcttgaagctaaatgtatatatgagtagtttgccatgagataacacagtgtaaacagtagacacccagaaatcgtgacttctgtgttctctccatttgagtattttgtaatttttttgaaatatttgtggacataaataaaaccaagctacactacaacccttgggtgtctcccgtgcactgtctcattcctggagagtgggcggggatcctggctgttaccccaggtggggaagggacagagggagagtcggctgttccctgctgctcgggaccctgtttgcatcccagagtggcttccagaaacatcctctgtctgggaagaggctttccctggtgagggtgctgtctttctttggaggctccccaagcagcgggatgggccctaagcaggcactggcattgggactaagagcatcttcccccaccccttgccattcaccccacacctctaatccgtgggcgttaccagcatgtatgggcatgtggcaccctgcctgctcaggagacacatcggaaccaccccatcctagcggcctcctgcctggcccccatctgcctccccgtggcctaccagtgcccccacaccccacccccagccacccagctctagagctgcactccaggtggaggatgcatcccaggcctaaggggctctaaccctccaaaggg

SEQ ID NO: 49 - DNA, 1240 bp, Homo sapiens
tgagccaccaggcctggcctcaactatattttttaatgtttacttaatactcatctagttttggtattgaccatgacttatattgctattgactgtcttaagagtaacactattctaataggatagctcacttaattttttagcaaatatccttaggtgaggtatcatttgcatatgtcttctttgtcaacttgttatattggaaatgtatgtgtgtttccttctttatcaatagctgttatcatctaaagacattattttgtttttttgtttattttatgcatatgtgtgtgcttcagttttactcttggtatcatgctggcactggtttactttgacactgttaagcagatattaagcagtctattgtgaaatcttctatggtgaaatgatcctgacatgtgaaataggtcagtttaaatgactcatggttttgttgttatttttctgctgtccaaggaaagagtctcagtaaaacattgtatatgttcctaaagactgcttattgagatagctctttataattaatacatgccttgattgtgacttactcatccctgtcttacaggccaaacttccagatctgcaaccatttccttctccagatggtgatacagtgacccaacatgaggaactggtctggatgcctggagttaacgactgtgacctccttatgtacttgagggcagcaaggtaataggaatctacccccatcctgctttctgaattagaccatctgaactgattataggcagtaaactttgcatttcccctgagattttatttctatattgggcgttctctgactttaagtttggttacaccctctgtaatcgggaccctggctcttcttaccagagaaaaatagtttgaagtaatttttttcatgatgaagtaatgtttttcttcttggtgtttgccccacatcaaattttggaacttttcaagaggaaaacagcttaggccatacatacagttaccaaaacctctcaatccagttgagtacttcagtcattcagctcatctgaaaaccccactacagaggggtgggggtgaggggagggagagcattaggacaaatagctaatgcattcggggcttaaaacctagatgacgggttgataggtgcagcagagcaccacggcacacatatacctaatgtaacaaaccgacacgttctgcacttgtatcctggaccttaaagtaaaatttaaaacaaaaacaaaaccctctacagatt

SEQ ID NO: 50 - DNA, 1148 bp, Homo sapiens
tcatcttttttccaaaaggggcatcaagccgcatttttagatcacaaatatcaataaacctatgcttttataactgcctacgatttaaatgcctttttgtttccataggcatatattagatttaatgatcctttgcaagttttattgagcttcttgttctttcagggatagtgcattgctctttattacttacaggcactgttaggactttcagccctgcctttcttggggtgtttcatgttttggggtttttttgttgattttacagacagggtctcactctgtcacccaggcaggggtgtagtggcaccattctggctcactgcagccccaacctcctgggctcaggtgattctcctttctcagcttctcatgtagctaggactataggtgtatgctacctaaaatttaaaaattttttaaatttttgtagagacagggtctccctatgttgcccaggctggtcttgaactcctggactcaagggatcctcctgtgtcagtaccccaaagtgctaagattacaaagccacttggcacagcccttgttccgtactagttgattgaaaaaatatctgaacagctgggtgtggtggctcatgcctataatcccagcaccttgggaggctgaggagagaggagtgcttgaggccaggagttcaagaccaggttgaactggtcagaccagtctctgaccagaccctgtctctacagaaagtaaaaaaaacaaaaacaaaaacgttaggctgggtgtggtggctcacacctataatcccagcgctttgggaggccgaggtgggtggatcacttgaagtcaggagttcgaggccaacctggccaacatggcaaaaccttgtctctactaaaaatacaaaaattagccaggcgtggtggcgggcgcctgtaatctcagctacttaggaagttgaggcaggagaatcgcttgaactcaggaggaagaggttccagtgagccgagatcacaccactgcactcaagcctgggcaacagagccagactccatctcaaaaaaaaaaaaaaaaaagccagatatggtgttgtgtggctgtgatagtaccaggctctagtaccagctacttgggaggctgaggcaggaggattacttgaactcagaagttcaaggttacag

SEQ ID NO: 51 - DNA, 1095 bp, Homo sapiens
tggaattttaacaggttttgtgtttgaactcaggagccttttaaattaaacaattggggcctgtaatcccaacattttgggaggccaaggcaggaggatcacttgagctcgggagctcaagaccagcctgggcaacatagcaagtagttgtattctgtgaagagctctgtcagagaacactaatctttctcccatcaagggaggctgaacccagtgtttcaactatgacaggagggctaagaaggtcctgggggtggaagagttcaggggagggtgagggttctcctctgtgctcttgacaaagcccaggcatggagggctttagccattaacagcccctccactgctttcctgctggcaccgaggggtaatggcattgggggttatggaaccagaaaatgggatcatgccatctgggttgttccttggcttccaggtgcaagctggcccaggccaatggttggggcgtcatggtgtctcatcgttcgggggagactgaagataccttcatcgctgacctggttgtggggctgtgcactgggcaggtaagaatgagcgtctcctcctttcttctctgacctcaacttcctaggaagacccaaaaccagtgaggctccatgtctgtccccgttttgctcatgtcccctgagtcagtgctcttgtttctgaggctgaacagaatgggggcatgagcgccctgcctgtatgttgtggcccccactttcctagcatcagatcctctagaaattctctctctgacaccacaccctctccctgccagaaatgcctgcaaagcttgtccgctgtaagcaaatggcctttcttttctcctagatcaagactggtgccccttgccgatctgagcgcttggccaagtacaaccagctcctcaggtaaggagggctcctgagaacaaggggcctgtggttcactaggtgggggcctgcactcagtgtaggcactgccctcccccaggagctcctggctctgggaacatgtacaggtgcaggtgcacagtgcagacagccaggccctgagcaggcttaggtcaggacagagttaggcctagactccccctacccacccactgcagcg

SEQ ID NO: 52 - DNA, 1099 bp, Homo sapiens
agtttggggagccaagtgtctgtccgtctgtcctgctggcagggcagcttagccatggacagcagaccctgagcctgagctctcaacggcacagcctggcgggaggatcctgccatcccgggctgcctccactgggctttctcttggaccccgcttctgctctatttaaggcctgtgccttgggacagctgatctcagctgcttactgtaactgtatcttggccaggacagctgttcctgggcactaaatttgggagcatttgtcagtgagaagggctgctttcttggaaagagagctgaatttcccattttgtatgcaccaagaactctgacccatggtttcttgccccaaagcagaaaaaaagtaactgatgtcagaactactggttggggcctgaacacctgttgatctttgtgttacagtccctgtgtagcagctgttgaagggaagttttctctgtacctacctgttttccaaacctgttgtcaccatctcttcccaggcctggagctgctgaagactgctattgggaaagctggctacactgataaggtggtcatcggcatggacgtagcggcctccgagttcttcaggtctgggaagtatgacctggacttcaagtctcccgatgaccccagcaggtacatctcgcctgaccagctggctgacctgtacaagtccttcatcaaggactacccaggtgagtgttccccgagtgccatctccctttcctgccactgacctgcagcagggcagctggagcatctggctggctggtgatggctgcaaggaggggatggggagggagtgtctgaacttccagctcccgtaggggattcaccactgggtttgcccccagttgtgcatacacagggcttcacagaggttcttgtgtagctaaggagctcgggtgccagcagcgacattgcataataagttgttcacagtcaggagcagaggcagtctgtgctccattagacaggtgagggaaccaagccttcagaatcagaacagccacttggtactgagatgtatcatgcttcctgtgagctgggaatattcattttaggctgtgtgtgtgcacaggatagagactgt

SEQ ID NO: 53 - DNA, 1183 bp, Homo sapiens
aggtcaggagatcgagaccatcctggccaacgtggtgaaaccccgtctccactaaaaaatacaaaaaattagccaggcctggtggtgggcgcctgtagtcccagcaggagaatggtcccgggcggagcttgcagtaagccaagatcctgccgctgcactgcagcctgggcaatagagtgagactctgtctcaaaaaaaaagaaaaaaaaaaattttttttgaatatcaggtgcaaaaccaggtgacaatagcctgtcagtttggttactcagaagagctttgctccttataatgaattcagcaattcctactgttggctggagttgggctctgtcttagaggggaaaagcagtggtgagtccacatagaatgctatttgtatttctagtaacagtgaaatggaggtgtgatgggggaggagatggtgcagaatacaaccctcagggcagtacagcaggagaaaagctggtgaatcagaaatgacttcattccactcggttctcttctgttctagctaagtttggtgcgaacgccattctgggggtgtcccttgccgtctgcaaagctggtgccgttgagaagggggtccccctgtaccgccacatcgctgacttggctggcaactctgaagtcatcctgccagtcccggtgagtggtttattggaacttcccaagcaaggagttgggggtttcagcttgctgttggggacccgagacctcctatgccttgatatcctaacacatgtgactctcccagcacagctctgccccttgttaagtgtgaccttgagcaggtaactcaacttgcctgtgccccaggtcctttatctgcaatggaggctcggggaggaaatgacagcagtactttccttgctaggctgtgagcattacctgacatagtcacaagtgtttctcctggtgatgatgaatttgcagttatcaaaatagacctggcgtgaactggttgcagtagcgcacacctgtagtcccagctaatcaagaggctgaggcaggaggatcacttaaacccaagagtttgagaccagcctctaggcaagaccagtatagtgaaaccctgtctctaaaaacatgagtcagagacctggtgagcatttcacagcaccctggcccctctggtgctcctcaagaagcaagtcttgggctcatctgtgagctagattgg

SEQ ID NO: 54 - DNA, 1197 bp, Homo sapiens
tgggtaagcttcggtaactagttgaatgtggggtgtagagaagggtgaagaattgcaggtgcctcgggttcccagctagtttgggggtcatcgtgaataatgacctacaggctgggggactaggtccatggaggtgctttgaacctgtcctaagtggaagtggtccaagtggacgtgtccagatggcaactgggctcaacgctcaagcaatcctcccacctcagccccccagtagctgggactatcggtgcacaccaccacccccagctaatttttaaatttctcacaaagacggtgtctccctatgttgcccaggctggtctcgaactcctgggttcaagcaatcctcccaaagtgctaggattatgggcatgagccacagcgctcaccctctgctgcttgggtgccgttgccccatcctggcttagaaagctctggccattccctgggcttcacctgcctcctgcgcccagacccatctggcattgccttccctacaggggcctctcccacttctccctctcgcccttgtggcccatctgccccctcaggagagtccctctcctcccttatagcctcagccactgtcacctatattctgctgaccccgtctcacactcttcatgctgcctggtcccgcctcggctggcccgttcctaccggctggcccataccctctcgcttcactttccaaaaccggatcccctcactcctcccctcttcccagggatgtccccttcagcaggtagccctgccatccacggtccaccctgtcacccagacacatgcaccctcagccatgccagggacagctgctgttgtgggcagcccagtgacctgtgggctccaggagggcaggacccggccggccacatggctgttgttcacggctgagtccccagtagttaggtccacagtaggttcttggacacctgtcggatgaaggagtaggtaagaccggtggcgtagtggatcctagcagggtctgggagagctcgatgtgggcccagggtgtgggtgctgggggtggggactccccgtcacggaactaaactgccaggtgttccgttctcagaccagacttccttccatgccccgtgggaggtcaggaactccgaacaagcctctgttctcaggagctgttagtgggccacttgtcattcatgcttttattcaaacatttgctgagcacctact

SEQ ID NO: 55 - DNA, 1172 bp, Homo sapiens
cataggctgggtttgactagacaggattagcgagggggaaaaagactaattacaagcagttgcgtactctggagatgctccccttagcagaagctcggtggactgtctgcagccagacctccgggcctggcggctggcgcgggaggcagaaggcggggctttcctacagggctccgtgccccgccctccccgcgccgccttccacctccggccgcgcgggggcgctccccggccggctctgtcgcttccgccgccgccccgcccacccgggctcacccctcgtcccgattggctgcgcgacgggagcgcgccgagtcagggggcgggcccgcgcccgctacaaagcggcgaaggtcacggcgcgaggaggcgcgcgtcgccgccccgcgtcccgcctgcggcccgcgcccccggcgtcaccgcctcctgcccgcctgcccgcctgcccgcctgcccgcctacccgcctacccgcctacccgcctacccccctgccggcctgccgtccttccacgcggagagccatggagggagtgagcgcgctgctggcccgctgccccacggccggcctggccggcggcctgggggtcacggcgtgcgccgcggccggcgtgttgctctaccggatcgcgcggaggtgagtgcatggttcggccccacgcggccctctgcgccgcccgccaggcccgcccccgcgccgccccggcccgctgcccccctcggccgggacccgggctgcccgcgggcgcgcggagacccccggcgcgcgccgccgccccccgagaccgggttgagactgcagtcgggaagcggctgcggagtcgagtggagcggcggggactccgggaacgtggggcgcgggcgagagcgccgcgcgggggccacaaacttcctccgggagccgcggggggctggagccggtgcgcacgggccgcccctgccctcagccccgtgctgggccccggtgcacggcgatgctggcgatcgcggctggcggttgctgctcggcatgtgacgtcccgggcgtttttctacacgcctcgcatccgcgcgtttcagagccacagcccctgcttacgctagagcagctgagggacagggaggctcagtaacttgctgttaatgagaggaatcatggtttgagccgatggaatctgcagggcagaccccgag

SEQ ID NO: 56 - DNA, 1175 bp, Homo sapiens
gattgagaatgtcttctttcctctgtcgcccaaaggttaatggctagacagatgtaaacttgtttggagcttccaaaatatacagacttccgcatgcttactgtgtaccaggcttgggacacgtgtgtgctatgcctttttgtctgcgcagtgtcttccctattaggagaagaggtgctgttggtccggaacttggtggtgtttatatcgggagcagcattgcagcccaggctcagcctctgtggagtgtcctacttcatagcacggattggggaggggaacgaattccatgtgtgtgctttcattcatcttattttgaatctaacatatgttttggcaaggaggatgtgggaaggtggaacaaaagaagcctggggttgggggtggtaaagtcacttctgggaaaaggtgattaaatacaagcttgcgtccagatgggtacatcccagagcgggatcacgagggaattttctcttcatgttttatagttggttgcttcaaacctggttttcaaggtccggtttgaagaccctaacctctcagtccttttctattgtctttgtcttgcttttccacagagttttcaggagttgaaaatgacaatgaaactgagcctgtgactgtggcctctgcaggttgctggattttttccctacattcactattgtgtttcatttaaagatgagactgattcattccacgtgtcgcatgaaacgccccagttgcattttggtcctggacaccatctgagctgcttccctgcattgcgcttccccattgcttcatggagttcccttattctgcccattctgaccccagctggagtgaggacaaatgacatctcaggcagtgcatgcatgggacttccccccccatccagtttgaccctgaccccactgcatgaggctccctgctttttcagtcttacaggcagggtttgggaggccgcctcgtgactgtcatgtggatgaaccacgagacaggaaaagacttgtttctagatattctgtcctgattgacagtaaattttaaatagacgtctctcttttttttttgttttgagatggagtcccgctctgttgtctgggctggagtgcagtggcgcggtcttggctcactgcaacctccacctcctgggtgcaagcaattctcctgcttcagcctcccaagtagct

SEQ ID NO: 57 - DNA, 1197 bp, Homo sapiens
agagcttgccccttacccttacatactgaagaaagattatgtgaggactagcaagaaggtggccatgtacaagacaggaacagagctgccaccagagaccaaattggccaaaaccttgatcttgggcttctagtctccagaatggtgacaaagtaaatttctgttgtttaagtcacccagtctgtggtattttagtatgacagcccaagcagacaaatacaccatctatatgcagatacatccaaatctctagtctgttgtatgtctgtacctctcccctgaacttggctttgttctccacttgcctacttattgtcaccacttggatatataatagatgtctcaaacttcacttctctgtaaactgaactcctgatagtcccctcaagcctactccatagacatctttctcttctcttttttttggagacagggtcttgctgtgtcgcccaggctggagtgcaatggcgtgatcatggttcactgcagccttgaactcctagacttaggtgatcctcccacctccgcctcccaagtaggatgtgagggcaacctggctgtgacatctctcaccccgttgatcaccagggttgatccggctgatctggctggctaggccggtgtctccttcctccctcactgctccatgtatatccctcccgaagctgcacactcaagtcgaagagaacgaccatccccaatagaggaggactaatcttcggtcaagggtatataagtagctgcgttcccctgctagaacctccaaacaagctctcaaggtcccaggtagctaggattacaggcacacgccatcatgcttcactatcattctcttctcaattaaaggtaatactgttcttttagctgcttaggccaaaaacttttggagtcatgcttgacttttctttctttcacagcccacatcccatccattgcaaatcacattggctgtatgttccaaatacacccagaattgagtgacatcttatcactttgctaccaccatcagggccaggtcagcatcacctgtcacctggattattgcagtagcctcccatcttatgtcttcacttgtacccttgcctctccctacattctgttttcagcttcaactgctagagagatccttaaaaatatgtcagatcatgtcactcctctgctcaaagccctgcagtggttgatgaggtctagagaatg

SEQ ID NO: 58 - DNA, 1226 bp, Homo sapiens
gtgtgaatagtcactgtaggctgggtgcaatggctcatgcctgtaatcccagcactttgggaggccaaggtgggcaaatcacgaggtcaaaagatcaagaccatcctggccaacatggtgaaaccccatctctactaaaaatacaaaagttagctgggcatggtggcaggcacctgtagtcccagctactcaggaggctgaggcaggagaatcgcttgaactttggaggcggaggtttcagtgagccgagattgtgccactgcactccagcctgggcaacacagcgaggctccatctcaagaaaaaaaaaaaaaaataggctgggcgcagtggctcatgcctgtaatcccaccattttgggaggtcgaggcgggcggatcacgaggtcaggagatcgagaccatcctggctaacatggtgaaaccccatctctactaaaaatacaaaaaaaattagccgggcatggtggcaggtgcctgtagtcccagctactcgggaggctgaggcaggagaatggcgtgaacctgggaggcggagcttgcagtgagccgagatcgcgccactgcactccagcctgggcgacagagcgagactctgtctcaaaaaaaaaaaaaagtcactgtaaactgaatgagttcaagggcactcccaaacctacttatcctgccttcccctcctcacttactgacaccagccttcacccaagatgagtttctcagcagtttctcagcggtctctttcttgctcttcttgcctctgttcagatactctccccaggcgctttatgagccctgtactcaggatattgtgatgttccttgttgtgatgttgtgcaaccagaactacatccgaaacccatatttggtggccaaactggtagaagtcatgtttatgaccaaccctgctgttcagccacgaacccagaagttttttgaaatgattgagaaccatcctctctccaccaagttgttggtaccttccctgatgaagttttatacaggtaggttgctggaacacagtgtagcacatggcaggccaacttaggtaaggtcatctaaagctagtggacgacgttgctctaagcctgttacctaatatcctgctacctgtgtgtatagcctactaacctgtggcctgcagaggatgtacttttggttcttcttgccctgagtagttaggaataggacaaccattccacctactggtctctgatgattcagcaggaa

SEQ ID NO: 59 - DNA, 1195 bp, Homo sapiens
gtatggtgaaaccccatctctactaaaaatagaaaaaaaaattaaattagccgggcatggttgcaggtgcctgtagtcccagggcggttgagggaggagaattgcttgaacccgggaggcagaagttgcagtgagccgagatcccgccactgtattccagcctgggcaagagaacaagactccgtctcaaataataataataataataataataataataataataccacttttcacctgtcaaatttatttcttaagttgaaaatacctggtacaaacatggttgtggagaagtaagctaacctgcaaaaaaacctgcttaatctaccctatagccagtgtgcagatttagtgctatgaaactctcatgagaatgcaaatttaaagcctttctgaaaggcagtttagcagcccacaccaagagccttaaaaatgcttttatcggggccaggtgcggtggctcatacctgtaatcccagcactttgggaggccgaggcgggtggatcacctgagatcaggaatttgtgaccagcctggccaacatggagaaaccccgtctctactaaaaatacaaaaattagctgggtgtggcgggcggcgcctgtcatcccagctactcaggaggccgaggcacgagaatcgagtgaacctaggaggcagaggttgcattgaactgagatcacaccagtgtgctccagcctaggagaaagggcaagactccgtctcaaaaaagaaaaaaaaaaagcactgggataacaaatagtaggtgcaggaagtagccatcttctatccctcagtctggggacccaagggaagagcctggggatctcagaacccagctgccctgatgagggcttggacggagctaggacccagtcctctgtggaaggcccttggccagtaggtgctggtgtctctctcgggggttgtgcacggttgctagctctgggggtacgagacaaagctgaaaattggaaccaactgctactgctgacagtaagtgcaaggtcctaagtcccttgtttctccttcagttttccagttctcctgcagcaccccctattggcaaccctagagagggcgggctgccaaaggaaagattctgcagtgccagccccagaatcacaaagccaactacaaagagtgcatgtgggctgggcacggtgactccagctaataatcctagcactttag

SEQ ID NO: 60 - DNA, 1134 bp, Homo sapiens
tctgtgaagcaaactttttaactttttgtttccataaactgctcttatggtcagaattgtgttccagctaaagcctggcacgaggcaggcccatggcttggtctgaatggtgctgattggagcgcttgtcctgaacttgccatgttcctgagatcgaggcctcctgcacttgttcacaggaacttctcttctccagcatgggcttaccaccccgtagttgcacagttgtagaccctgaagtgtagcttctttttttctctacgaatctggcatctccagagtctaacagaggtaggccaagctatttcagttcaccagcaagttctcattataacacgatctgcagaacagttccttagattggaggcttccagttttaaagtaagttaatatcccactttatcaatattacaggttccaatttttcttccatgcgtcagtctttgtgataaggaataactatatcagttgttttcttatctgttgtatgtggttaattatttgcattttcttggtatattggtgagtatatgcgtttttcctgttctagtctggaagaagtgttttctctccttaaaaacattgagggagtgagctaggggtgtgctggtaagcctgctctgggaagcagggtgggggagtcagcatttgctggttttccatggtgtgactgtttcctctgttgcccaatttaaggtgccaggggaatctggttataaaattctggaatatttagcacttgactgtcatcagccgtgcaaggtggctccaaataccactggaatgagcttatcataaacaatttaaaagaataacaaaatccaggccaggtgtggtggctcatctctgtaatcccaacattttgaggggctgaggtgggaggaacgcttgagcccaggagtttgagaccagccctggcaacataacaagtccctgtctctacaaaaaatacaaaagctgggcgtggtggtgtgtgcctgtagttccagctacttaggaggctgaggcaggaagattgcttgagccctggaggtcgaggatgcagtgagctgtgattgtgccactgcattccaggctgggcgacagagtgagaccctgtctcaaaaagaaacaagattaacataatctaaagag

SEQ ID NO: 61 - DNA, 1113 bp, Homo sapiens
aagacaacatactttttttttcttttctctgtttgtgatatcactttaatttttcttgggtggcttagagactaagggaggagacatctggcctttttagaacctgagaggaaaaaaagagtctttttttcccctctgtctctttttgccatggctaatccctgcatttccattcagggaaaaggtggtagtgagcatagaactgcaacagttatattctgagtcaaagttggggctttttacggcataattatggaatttttatttactggtagagaggagacgagaggctttttcagtgggcctgggacagtggctgctcttgactttgtgtgaagggaaatgccaaggatgcttctggtggacttcaggggaccccagggtttggccgtgggccgtgatggcagcaggcggtgggatgcttgtagctcctcacagcaggattcctgcccactgttttttctctgttgggagggaagctcttttctaggagtgtctcagttctgcttttggcattagtgatggtggtggtacagttggaattagtgccatgtcatacacaaatgttccacaaggcgggagtgtttcactttctggtgataaacttgatggtcattgttatgattaagataatgccgggcaggccgggcacagtggctcacgcctgtaatccaagcacttggggaggccgaggcgggcagatcacgagatcaggagttcaagaccagcctggccaatatgatgaaaccccgtctctactaaaaatacaaaattagtcgggtatggtggcacatgcctgtaattccagctgcttgggagcctgaggcaggagaactgcttgaacccaggaggcagaggttgcagtgagccaagatcgcgctattgcactccagcctgggtgacagagcaagactctgcctcagaaaaaaaaaaaaataataatgctgggtagtgaccttgtgattgttacagctccctttgatcaaagaaatatagctttcaggcataaacctggaagtctccctctgaatccagcagttgttttcattgatgcttgtcaggttgaagatgctttcagtgatgctctctatactcataaataagcaaatgtgg

SEQ ID NO: 62 - DNA, 1183 bp, Homo sapiens
cttttttatagcttattttgtaatgcctccttaattatcctttaatagaagccaccgctgataagctacctacactcatacagaagcattaatataatgccccagatgtactgtttcagggcaaaaaggaaaataatttccaacaaagtggtgtgtgtttcactgtcagatgcttgcacttacacacggaatcgctgtgcatccgacagaggctgattggcacatggggcacggggattgtcagctcaaacaccgtcagcagcgttgcccttggaaatgggatttcccagaacagtaaacgtgtctgtccttgatttacagagtagctacattcctaggaaatccagggtacattaaaactcaccatgttacccaggctggtctcaaactccaggcctcaagcaatcctcccacatcagcttcccagaattttgggattacaggcatgagccaccacacccagccagaatattttatttctgttagacacacagagcgttcgttgactcgtctgggcgttagtgttaatattctgtacttgaagcaagcccaccaagcggctgaactgggtggataatggaaaatgtcctgtggatttgggagtgagacaaaccggcttgagtctaacctctcagttagtctaaggctccaagcttgaaagggttaaatgaagtactatatttgttttgtttcgttttcgttttgtttgaggctttgctctgttgcccaggctggagtgtagtggcacaatctctgctcactgcaacctccatctcccaggttcaggcgattctcttgcctcagcctccagagtagctgggattacaggtgcccgccaccacacccggctaagttttttttggtatttttagtagacacagggtttcaccatgttggctagactggtctcaaactcctgacctcaagtgatccacctgccttggcctcccaaagtgctgggagtataggtggtgagccaccacgcctggcctaaatgaagtaccacatgaccgacagaccgacctggggaacatagcaagaccccatctctacaaaaatgtaaaaaataaaaattagccgggtgtagtggtacatgcctgtaatcctagatactcgggaggctaaggcagaaggatcacttgagcccaggagttcgaggctacaatgagctgtgatcgtgcca

SEQ ID NO: 63 - DNA, 1245 bp, Homo sapiens
ctctactaaaaatacaaaaaaaattagccagccatggtggcgggcgcctgtaatcccagctacttgggaggctgaggcaggagaatggcatgaacctgggaggcagagcttgcagtgagctgagattgcgccactgcactccagcctgggcaacagagcgagactccgtctcaaaaaaaaaaaaaaaaaaagtaattggcagtgactatgggcgcactgcctaacatttagccctgccccatatggaacatgttaaaaaaaaaaaaagccaggccgagcgtgttggctcacgcttgtaatcccagcactttgggaggccgaggcgggtggatcacgaggtcaggagatcgagaccatcctggctaacacagtgaaacgtgtttttactaaaagtacaaaaaactagctgggcgtggtggcaggagcctgtagtcccagctactcgggaggctgaggcaggagaattgcttgaaccggggaggcagaagttgcagtgagccgagattatgccactgtactccagcctgggtgacagagtgacactctgtctcaaaaaaaaaaaaaaaaaggacaggcacgacagtggctcacacctttgatcccagcactttggaggccgatgcaggcggatcacatgaggtcaggagttcaagaccaacctggccaatatggtgaaaccccgtctctactaaaaatacaaaaattagctgggcatgatggcgggtgcctgtaatcccagctactcggtaggcagaggttgcagtgagctgagagcgcaccactgcactccagcctgggtgacagagctagactccgtatctcaagaaaaaaaaaaagttttgttttgtttttttgagacagagtctcactctgtcacctagtctggagtgcagtggcacattctcggctcactgcaacccccacctcccaggttcaagcgattctcctgtttcagcctcctgagcagctgggattacaggcacgtgccaccatgcccggctaatttttgtatttttagtagagacagggttttgtcacattggccaggctggtctcaaactcctgacctcaggtgatccacccacctcagcctcccaaagtgctgggattacaggtgtgagccaccacccctggccagaaaaaaaagcttttaaataaagtaattgtcagcttaggcaacatagcaagaccctgtctctacaaaaaaaaaatttaagttagccaggcatggtggcactgacctat

SEQ ID NO: 64 - DNA, 1200 bp, Homo sapiens
aagttttgttacatgaaaggttgaaatattgagtggttgaaagtgaactgctgtttgcctgattggtaaaccaacacactacaattgatatcaaaaggtttctcctgtaatattttatccctggacttgtcaagtgaattctttgcatgttcaaaacggaaaccattgattagaactacattctttaccccttgttttaatttgaaccccaccatatggatttttttccttaagaaaatctccttttaggagatcatggtgtcacagtgtttggttcttttgttttgttttttaacacttgtctcccctcatacacaaaagtacaatatgaagccttcatttaatctctgcagttcatctcatttcaaatgtttatggaagaagcacttcattgaaagtagtgctgtaaatattctgccataggaatactgtctacatgctttctcattcaagaattcgtcatcacgcatcacaggccgcgtctttgacggtgggtgtcccatttttatccgctactctttatttcatggagtcgtatcaacgctatgaacgcaaggctgtgatatggaaccagaaggctgtctgaacttttgaaaccttgtgtgggattgatggtggtgccgaggcatgaaaggctagtatgagcgagaaaaggagagagcgcgtgcagagacttggtggtgcataatggatattttttaacttggcgagatgtgtctctcaatcctgtggctttggtgagagagtgtgcagagagcaatgatagcaaataatgtacgaatgttttttgcattcaaaggacatccacatctgttggaagacttttaagtgagtttttgttcttagataacccacattagatgaatgtgttaagtgaaatgatacttgtactccccctacccctttgtcaactgctgtgaatgctgtatggtgtgtgttctcttctgttactgatatgtaagtgtggcaatgtgaactgaagctgatgggctgagaacatggactgagcttgtggtgtgctttgcaggaggacttgaagcagagttcaccagtgagctcaggtgtctcaaagaagggtggaagttctaatgtctgttagctacccataagaatgctgtttgctgcagttctgtgtcctgtgcttggatgctttttataagagttgtcattgttggaaattcttaaataaaactgatttaa

SEQ ID NO: 65 - DNA, 1100 bp, Homo sapiens
gacaggcagtttacagaaatgccaacagccagtatgaaaagagactggctttttaaggtaatgaaatgtaatttgagcagtgacattacactgggtgggcaaagatgactgtcactctcgtggtttatgtccccttgagtcaatgggtaaggctggaattaaactggcaagtggagaaatgacagcagcctcacctggagtctgtttttttgggtggagcaacaactgccatgtccacagtaatgatgaatgcttctcgagccacgtcgctgccaaggtcttcacaggcatttctaaaaatgaagaatccttgactgcagacacgcaagttaaaaatcactaattatgttctcgatccagggaatatagttaataacttttgtgtagactccatactgacctgcttccccacaattcatggaaccccaggacactattcctcccacaaaccacctctctgtttcactatctagaaacaccagtgcccctccgctgtcacctctgcagctgtccttgcccccactttctaagccagcacaaagcatgttagcagttacacttccccttggatagggtggcttttcatatgcagcagtacatttttgatggtcaacaatcggtatgtcgacatacattagatttctagcaagaaaacccctttgggttaatccccatccagatgcagttccaatgtcatctgtcctcataaaggattcagcttcttttcttggcagacaaataggcgtgatgttgctattgattacaactttgttattcaatttaatcagtgctatgtcattgtcaaagccagcatcatgagtataaccttcatgtataaaaacagcttcagaccaggcttgtgtataatgaggtgatagtcttttcagggtgcccattcgaatgtccagggcggatgcatcatgtttttgctcatagacggcatgagcagctgttaggacccagttgtcatataaaagtgcacctgctgctgtggttccacctaatatcaggacttgccaaggaaaatcaccaggttttgccttttgccctccatatatacgccctcctgttgtgcgggctgatagtccacaaactggaga

SEQ ID NO: 66 - DNA, 1172 bp, Homo sapiens
acaaaaaaaaaaaaaattagccgggcgtggtggcgcgtacctgaggctgaggcaggagaatcacttgaacctgggagacagaggttgcagtgagctgagatgacgccactgcactccagcgtggcaacagtgagactccgtctcaaaaaaaaaaaaaaaaaagtgccccccctgatgtgcccctggcccggtccccagagcacgaacttccaggagccggtgcagccgctgacacagcagcaggtggcgcagatgcagctgaagtactacaactccgacgtgcaccgcgccgcctttgtgctgcccgagtttgcccgcaaggtgggtggcctgcggggctgggtggtgggacccagggacccagagcgccctcctgactggcctcatgtccctccaggccctgaatgatgtgagctgagcccaggcgccaccactgatgccacccaggacctcggaccttggagcctgcggggtgcctcggcccctccagccccgggccggacctcctgctggctctcgcccaccaaccaagtgttacaagccccagaatgctgcccggcctgccctgctgggcggactgtctgtgtgtctgtctctctggcgttccacctccaagcctataccagctgtgtacagcgccatctctctgccttctgttgcccctcactcaccaaacacgtgtatttatagcaaagattggagtcctgtgtctcctgaccttggctgggcccaggcagggccacattcaccattgggtgcctctggggtgagggtctgcagaggccttgctggctgacccccaagtgtctgctgcagggctgaggctgcaggcgggccatcgtggatagcctggggcacagagggtcaccgcagtcgtcacgtgggacccagagctgtcctgggaagctgacttagctgtccttttaccaagcccttcacaaggccactggtgacagccccccagggcagtggggtgggtgagatcagggtggggctgcccgggagcattctcagaaaaattggggacactcacaggtgtaagtcaggtcccatccaggtactccagggcaaatacaggaaggggtggcggggctggttaccttcggcctttttaagcacatcaggagcttaacactggcccagtgactgtgccctgactccacccggcattc

SEQ ID NO: 67 - DNA, 1179 bp, Homo sapiens
gtggttcaggagaataggcaaggcttgtttgtttgtgaggggttccttttgggttttgctgtcagtccagtgcagagatacaggaagggcgaaggaaagaaaaagctagagcagtgacagagagaaggagataaaaagacagatttatgatctgggagtctaacctcaagggccactctggggtgtgctttgattaattgcccaaggcatgcttgaaggcagaaacttgagagagcgggcgctggggaagtgtccttgcgggacctcggtgggcattagccttgactggaaatgatgagtgtgtcccatgcaattagctgtgggagagctcagggaataccctagggttgtcagaccttggccttttcattttcaagttatctgtgtaaacctttgaagaagctcaaattattaaaatattccttttctttctgccttcttaggtgccctttctggtaactggaggcccagatgtgcccatcacgttttttctgaggcttttgtactttagtaaatgcttccactaaactgaaaccatggtgagaaagtttgactttgttaaatattttgaaatgtaaatgaaaagaactactgtatattaaaagttggtttgaaccaactttctagctgctgttgaagaatatattgtcagaaacacaaggcttgatttggttcccaggacagtgaaacatagtaataccacgtaaatcaagccattcattttggggaacagaagatccataactttagaaatacgggttttgacttaactcacaagagaactcatcataagtacttgctgatggaagaatgacctagttgctcctctcaacatgggtacagcaaactcagcacagccaagaagcctcaggtcgtggagaacatggattaggatcctagactgtaaagacacagaagatgctgacctcacccctgccacctatcccaagacctcactggtctgtggacagcagcagaaatgtttgcaagataggccaaaatgagtacaaaaggtctgtcttccatcagacccagtgatgctgcgactcacacgcttcaattcaagacctgaccgctagtagggaggtttattcagatcgctggcagcctcggctgagcagatgcacagaggggatcactgtgcagtgggaccaccctcactggccttctgcagcaggg

SEQ ID NO: 68 - DNA, 1164 bp, Homo sapiens
tttccaaatgcctgtccttgctactcccattgtgccttgcagagtacctaggtcttcaggtttgtgcgtgagctcccctaggaggccgggagatcccttgaggcaagagctctctcctgctcctcttgctgtgcccttctcgcagtgcactcatagtacgttatatagttagtgctccacaaagtgagtggatcatgttgaatttagtaaaacagccatttctgagtgtctccttgaagtgtttgctttatggacacacagaacaggcaggagcagctgttcctcagcatcgaccttgcgctcctctgagccctgctgttggtcacagctccagtgtctgtccttgcctttctccccaaccaggcctggcatgcgtgggcagtgatgaacttcgaagctgtgctacactacaaacatcagaaccaagcccgcgatgagaagaagaaactgcgtcatgccagcggggccaacatcaccaacgccaccactgccgccaccacggccgccactgccaccaccactgccagcaccgagggcagcaacagtgagagcgaggccgagagcaccgagaacagccccaccccatcgccgctgcagaagaaggtcactgaggtacccttcccttcttccttattaacaaccaaccaaggtgccaggctctctgagaaatggaatcgttgttaagcttaaaaggaacctgaggctgtatctgaagtgccagatggagctggaaaatactgcctatctaccatccagcactgcctgagatagggctttgtgtgtgaatatttgtgtttggggagctgacgcagcctctatgctgaagagcaagctccttgtcaagcttccctgtggacgagctcattctctacgtgctgcacctgtgtgtgggtggctgtacacagctgcgggtccactctgaggatggggcttgggaggtccatcctctgcctttttctctccacttccacttcttccccttccccttgggctgtcagttcagaatgcgccagggccgctggcaggcccagagatccgggtgttcagagcctcagctccacctcctccctccatcctgttcaggaagccactgtcagcccaagataataacagttatgatacagttgccatttattgagtctttgctatgtgccaggtaatgat

SEQ ID NO: 69 - DNA, 1184 bp, Homo sapiens
gtttagtttctagaggcctcagtttctccatcagcttatgggatccttgtctttactgacaagaatggaatagaaatgtaaaagtactctgaaaagcaattgccctgtaacttatctagaaagaaaagaccctgagactccagaatctgctgttgccatagccccatatgtgtgaattctgcaactagccaaggctagttcctttcaattccatttaaaaaacaaaaaccagcaggtgtggtggctcatggcgtaatgggcctgcccaatgctttgggaggccaaggcaggtagatcgcttgagcccaggagtttgagacaagccctggcaacatagtgagatcccatttctacaaaaaaaaaaaaaaaaaaattagccgggtgtggtggcacacgcctgtagtctcagctactcaggtggctgaggtgggaggatcgtttgagccctggaggttgaggctgcagtgagctgtgatcgcaccactgcactctggcctgggcgacagagtgagacactgtctgagaacaaaaaacgactgaaaaaaaaaatcaccttagctttttctcttagaatcttctctaaaacgtattctttgtggcattctgaaataggattcatgatgatgcctgttgatcttagggacactacctcacctgccagtatctttggggctgtgtccttcaaggacatgtccccagactgctgtgcagtgtcattttttgtgtttggtttggtggtggcttcttcccccttgctaggctatcaacctcttatcaccacttgttggtgtcagaactaactgcttctggtctggagagggactgaccgatgcctttgggtagagagaattatgaaagaaattttggtatttttctactttatattttctgaggtttctgtaataagcatatttcacttttccaataagaaaaaaaaaaacttggcctggcgcggtggctcacacctgtaatcccagcactttgggaagtcgaggtgggaggatcacttgagttcaggagttcgagaccagcttgggcaatatggtgaaaccccgtctctactaaaaatacaaaaattagccaggcgtggtggcgtgcacttgtagtcccagctactcaggaagctgaggcgggagaatcacttgaacccgggaggcagaggttgcagtgagctgagatcactc

SEQ ID NO: 70 - DNA, 1268 bp, Homo sapiens
tcaggcgatcagcctgcctcagccacccaaagtgctgggattacaagggtgagccacggagtccagccaagataattttttttttacttttttttttaagttcaaaaaaattctttacttattaggctaattgtgcaattaaaaaaaaaaaaaaattgcaaaaaccgcaattacttttgcaccgatctaatagctcgcccactgtaagtaaagcaggtaaagtcagcctttttcttctgggaccagactctgctctgccccgcggtggtggcctcaggcgcagcgctaaaacgcatgaaccatttaaggtatttcctgaaactggagcgtgattggtgagactttatttgcatacccacaatgcattgcgcactaaataatgttcgtctttaaaattatttcccctttttccttcaacatatctttctcggaaccgagattgctgtcccagaattgtctgaagaaaaaggctgaagtcaatagctcttttgggccgaaggaaagttaccattacccgtttaggagtagccgttacctgagaactgtagtgtcgacgactgatgttatactctggtttctcttcaaatcgtataaatctttcgccttttactaaagatttccgtggagagaaacgagtgtgagtctgaaaccaattttttgaggccttgcgtttcttagcagggcttattttaagtgttttaaaaacagatgcgattccgttaaatcgcgtgtggagctatgtaaagtgtattatagaacaaatgcgagttacggtttttcagcttttcgctttgttaaggtatgtgatatcaattgtattgcatttctgagcagttataatattaagatgttggggtggcttactgcttttgaccaagaagtagggtttgttggttgattacaccagtggtttttaaccccagccactgagtgatggagggttaccgactcacaagcgagcattaacgcctgaggtccgcctgctgtcagggcagcaaggcatcagattctcctaggagcgggaaccctattgtgaactgcgtatacgaggtatctaggtgcgtgctccttttaagaatctaatggctgatgacgaggggcacagtttcaacctggaactgtccacaccccctacccaccttcccccgcccttggaaaaactgccttccatgaactgggtcccttgtgccagaaaggttggggaccgctggactatccgatcaaatgaagcagggactcggggcgagctcccccgctgctcccgccgg

SEQ ID NO: 71 - DNA, 1236 bp, Homo sapiens
ccccatctctactaaaaatacaaaaattagccgggcatggtggctcacacctgtaatcccagctactcgggaagctgaggcaggagaatcgcttgaacccaggaggcggaggttgcagtgagctgagatcgcaccacagcactccagcctgggtgacaagagcaagactccatctcaaacaaacaaaacctttctcttgtcatgtaacccatacatacacatgctatgtacccacaaacattaaaaatcagaaatttaagacaaaacaaaagcaacagaaaacctttttttgaggagtccctaaggcttcaccagtttgtcaaaattggagcttgattgctgagactttatttgcatacccacaatgcattgtgcaccaaataattttcgtctttaaaattactagtcccctttttccttcaatctatctttcctgaaactgagattgctgttccagaattgtctgaagaaaaaggcagaagtcaatagctcttttgggcagaaagaaatttaccattagcctgttgggagtagccattacctgagaactgagtgccactcatcgaagttcttactctagtttctcttcatatcgcataaatctttcgccttttactaaagatttccgtggagaggaataattctgagttttaaaccaattttttagaggtcttgcattttttagcaaggcttatttgagcgttttaaaagtagatgcccttagccattacgacggttcgtatttactctgaaacaagaaacacactcaaaactcagagaaaacattgttccctagtatttgagtctgaaggaccagagctggcttctggaggagcagctggccttgggggaaaaggacaatttaccctcctacgtagcttgaatggggctttgagtcgcatggcggggcacggcggggcacggcggggcacggcggggcacggcggggctgggctgtgggcggctgcttcagggcctgagcccggggtagatttttttttttttttttttttttttttgagacagagtctcgctctgtcgctcaggatcgagtgcagtggcgcgatctcggttcactgcaacctccgccttccaggttcaagcgattctcctgcctcagcctcccgagtggctgtgattacaggcatgcgccctcctgcccggctaatttttgtatttttagtagagacggggtttctccatgttggccaggccagtctcgaactcctgacctca

SEQ ID NO: 72 - DNA, 1135 bp, Homo sapiens
ggggtgagctgcagtcctcagatctcttccaccacagcaagctggaccccgacatggccttctgtgccaacatccggcagcaggtcagccaggagcgggcagcacaggacgccctctggatggggcaggcgggaaggtgggcctccagctctgaccctcatggtgggccgccttgtcaccgtaggcctgggagctccagagattctagcagggcatctcggaagccaccagggcctgctggaggaatgggggccgtcgggcacgagggctggtcctcaggggtctgcagggaccattttagctgacctggtttttataccatctattttatttacatttttggaatagcccaaagaaaacggaactttccacctaaaggtactccaagtgatgtgcccgagagacacctcaccctgtctctgcgccccaccccatatatttttgtgactttttttttttttttaaacatgcagcaagatgaagttttcccctgtgaccaacatttcaggaccagaacacgctccttttcttttacgcattttttctttcattctgtgttcagtcctctgggaagacttccctgatcacattcttagtgtcaggcctgggctgggccctggggacatagcggtgactgcacttggtctctgatattgggaacttcagttcggcgggtggaggaggctgcactgttgcccgtctgggagcgtgcaggggaggggtgagggcaggggaggggtgggggagcgcctcttccaccgggcctgtcctccccaggatgtgttcatgttcctgaccaaccggcacacccttggccatctgctctccctagacagctaccgcaccacccacctgcacaacgacctctgggaggtgttcagcaaccccgaggtgaggccagggtgggcacataggggctgggagcaaaggggcccagtgatcctgcagtcggagggacttccctctcagagtcttacaacagccaggacccctgtaggccacctgccaccctcccttcaccccaggaggctatagggcaggatttgggtagggagagaagggtgtccagagaggcaacaccatctattggaggagggaccaggactcaagaggcctgggtttgtggcctagatct

SEQ ID NO: 73 - DNA, 1265 bp, Homo sapiens
ggcggtgctgccagccctaagtgccatgtgggctcccccaggggcacgtgtggctcctgccccctggccactgccaagagaatgaagcacccagtctcgtaccattttgagccctccagcactacttattttcccccacctttgcctgctgttgctggaagagctggctcatacccccaaaggacactttcagcgacagctatggacagcatggtaccaaggagttaagttgaggctttttccagctttctctggttcatttgattgcttgataaggcctcaggatctcagcattgcacaatgcctcatggaagcctttgagggtatcacacagacacccccaccttcctccagcctgtgcgcacctgccctccttgcagcccagcacacctgcaggtgtaagggacgattggagtttcttcccagagagtctgtcccagaaggactgtggcttgtgtgtgtccatctcgcctgttggctcagtgcttcatcccatttgcagagcctcagacacgtcttggtggtgaggctcagttacccctgggcttaggctgaggcgggccctgtgctgggggtggtagaaaggatgctgctgaggcagctggaggagtgggagtagctcagaggggagggctgttggatgtatggggagctggcagagcaggtggcagtcactgggacaaggagggacttgcctctcttctcattattgtgtcctttgctttagtgtcagtcctggacttgtgcaggcctgttttgtgtagatctgttttggaagatggcatggtctaggtggttgaaggatgtagtagaaggatggatggtggaaggtggggacgttggtggctggctgaggtgcatgggccccacacaggacagctggagaatgggccgtccacttggcctcgttctgcgaggggctcatgggtctgagagcccccacccactaggcttgattgcatccctgttgtgccctttaagagacatgtttccaccccacccccaaccttgtcccaagtgccctggactaaatttcctgtgccagtgactgcagttggccaagggacaatgtggaaaacccagtgtccatctttccaccctccctgatctccagaaccttcgactgacccccttgtctttatgctgatgttgagttttgggattgttactggttgaagtgggggcagatgcctgtcaccaaggtgttgactgtgtgagaaaagcagtttgggtgacaaatcctgtgtggcacaagttggatcgct

SEQ ID NO: 74 - DNA, 1229 bp, Homo sapiens
tggccaggcactgtagctcatgcctgtaatcccagcactttgggagaccgaggcaggcggatcacaaggtcatgagatcgagaccatcctggctaacacggtgaaaccccgtctctactaaaaatacaaaaaattagctgggcgtggtggcaggcgcctgtagtcccagctactcaggaggctgaggcaggagaatggcgtgaacccgggaggcggagcttgcagtgagccgagattgcgccactgcactccagcctgggcgacagagcaagactccatctcaaaaaaaaaaaacaaaaaaacaaaacaaaaaaaaatgtttctacaaatgttgtccaggcttaacatgctttctttaattctaacaacaatcgtatgaggtagatactgttgtcgtccagcagatgaggaaactgaggcacagagaagttaaataacttgcctgaggcagtacagttaaagagtgtcgaatgggggtctctggcaccacagggcaccctactgagccccgtgtcctgctgtcttgacttcaggtagaagagctgggcctggaacccagccctgaggacatcctgcggcccaggggcaagtgacacctgctgagagaggcccaggatggtggaggctgaggaactggcacagctgcggctgctcaatctggagctcctgaggcagctgtgggtggggcaggatgctgtgcggcggtcagtggccagggcagcctcggaggtgcgtgcccgccttgggaaccccagaggaaggggctacctgaccttcaggccagcatccaggcttctgggctcatcttgttcaatacacccattttactgatgatgggacattgagggctggggagggaagagactggccttggtcactgctgaggccggagcaggatgaggatgcttgccttggtgcctggcgtaggcccggtgggtaggttctggcagccactccctgggtgacccggcccctctctccagtcaagcctggaatccagcagcagctacaactcagagactccatcgaccccagagacgtcctcaacttccttgagcacctcctgcccacggggccggtcctccgtgtggggcccaccagatgcctgtcgaggggacctccgtgatgtggccagatcgggggtggcctctctcccacctgccaaatgccagcaccaggagtccctgggccgaccgagaccccactcagcaccctcgctgggcacctca

SEQ ID NO: 75 - DNA, 1198 bp, Homo sapiens
tggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaaggtgaggagcatcagtcttttgttctattttgtttaatgattgaaaacccagctcacggagtcctttgcgtaaaacagcaacaataaaatccttttcttttagaataatcctcagttaatatttaagaaatcaaagagttttaatagaatgccttgtagtaggttggcatgttttcacccttttccatttaatgtcatatttgacaaaacaggaatttacttacttttatttttatttttttggttttttgagacggagttttgctcttgttgcccaggctggagtgcaatgatgcagtctcagctcactgcaacctctacctcccaggttcaagtgattctcctggctcagcctcccaagtagctgggattacttacaggcacccgcta

SEQ ID NO: 76 - DNA, 1179 bp, Homo sapiens
aagaacagtttggtaactctgcaatctacctactgcaaacaagccatgacttggtttggttttagctctaattatataaaaagtgagtcagggtttttgggtacccccctcccgccgccacacacacacacacggtgtgacaggctgttgtttttgtttgtttgggcccgctcagtgaaaggtataactgttttacccacataaaaatacttgcaaaggccaggagcggtggctcacgcgtgtaatcccagcactttgggaggctgaggtgggtggatcacctgaggtcgggagttcgagaccagcctgaccaacatggagaaaccctgtctctactaaaaatacaaaattagccaggcgtggcggtgcatgcctgtaatcccagctactcgggaggcagaggcaggagaattgcttgaatctgggaggcggaggttgcggtgagccgagatcacgccattgcactccagcctgggcaacaagagcaaacctccgtctcaaaaacaaaaacaaacaaaaaaaaacttgcaaaaaataatagttaacattgtatatatgcagattatggtcaaatcatgacaaataacaatactaggctcaaaaagtgaaacattcagttaagtctcttcccctttaaattcacgtggtgggtgggggcgaaacaagggaaaacaaagggatgtacaatgagccagtctttccccactaggccagctcctcattccagaggcccacctgctaagctccactgacccctccctagtcctgctgctgcacaccccaggctccctcctgctgggactgctccctgtgtgcctcttcttgtccccacctgtctcttgtccacatggcaagcatctccttggacttcaggattgggcaccggcgtgccttcccctgtacagaccttccttgtcctgggtagaagagtccaccccttcctgagatccccctacaggaacccccacagacaccaaactcaaacctggaacactttcccacatgtgtgtgactgcaagtcctcctcccctgctggatggtgaccccaaggggagagggctttgttttgtttatgtctgtgtcccctgtgcctagcacagagcctggcatttctagttgtccatacatagttgtgaacttgctctagagacacaataaatagacctgttaacatgaggt

SEQ ID NO: 77 - DNA, 1197 bp, Homo sapiens
tttaagggttttaaattgtagaatcagattccttttcagtggggctcttggaactgtcgagggctgatctgtctgactcccaccaggacaatctcacaacaatattattatgtaggtcggggtcccctaggtctgttaaaaaaaaaaaagttcagggctaagcgtttaagaggaaaaactatttctttcatttctagctaagtctgatgggccctttcaaacactgctttcatcatgcaccttttatttcacgatttctgcataatgaaaatacaagatcgataactgtggattatcgtaatgccttgagcctttgaaaatgaacattttctagattataaatgttccctttgtaattcatttcaaacttcatcctcccatttgtcctaattcccgaaatttaactgttgccttttgagcctcctaggaaattctgggtatcctttaggcaagggaggtagctcttgggggaatagcattcaggccacaggcaattcatttgcgacttgggctcttcttagaacatatgataagtacaacgcactgtagtgacagattttttaaaaaccctattaaagcccaatatactaatgcagattttttttttttaagttttagagagattcatgggattttattctttttcccaaaggcagtggtggagctgacagagtagcatggagcctcgtcctgatgtattgtgcggaagtggcagcagttcacattcattcagtttgtcagcataggatcagttccttcttgactcaactctctgtgatcaaaataagctattggatgttccctttgggtactggaagcagcttggccccttggcaagagaacaggattgcaaatcacaagagcagagccctgactccagctctgatgctactgtgctttgtgaccttgtgcagacagctttatatccccatctcaggtcattctcccccatacaaagggggagagggtcatccttgccctggtcatgtctgcatggctgaggtgaataactagttgtgtaacttcctggaggagtggcacagaggaagctcccttcctagggctggctctgccatcagggaggaagctggatattagaatgaagaaaaagcccatgcagaatatatggcagcccgataatggattctaaaaataaaaaagcactaggttaatctgcagctgtagtgtacctaaagt

SEQ ID NO: 78 - DNA, 1121 bp, Homo sapiens
tccttcccactcccccacagggctcctgctgagccagccctgactcccagatgcaagagcccagggaggagttgggagagaggaaaacctgctgggacctcagggcatggaaggagccctggacctttctcccagtgatgcctcccctactgtcaagttcctctggccctggagcttccagggacccctgcatcctttccttcctgcagccctgcctttgccaaagctccatgcatttgcctccaagtgggtccccaaccccaggctctgggagctgtgaagaggctcagggttcctgcagtctgcaggaggaaaccttgctctaaatgggcctgtgtgggttctgggatcccttcctgcacagggccacctgcaggtcccacagatgtatcttccctagaagagccagtggtgatgggcgaggacccctaacctgctcccaaaccccacatccaaaggagagagagggatcacctgaagcacagaccaggggttgggtcctggccccactgtctcctcctgatcccagaggccaggggtgtggccacaggcactccaccaactcctcctgcacccccaacccaagctgaacaaactcctccagactccctggcccaccccaacttaaagaaattaggagaattctccaagggggagaagacaccagctgcctctgcagtgctgtgcccaggaggaagatgatcactgttcaaactgccctggcaagttgtttcaaagaaataaagcccttggattctcagtgttctgaatcacattgcacttaataaacattagttttactaatgttttccacttacctgtctgtttatattcagcagtgagagttcttcatcttcaacaaaaagtgattaaaggacataggacatctgtcattttccccatggattattaagatcactctgcacatttcatcttgcacagtcatttttttctgacctgggctgcagtgctgagccacgtgtactgtgttgggttcattttccagattctttgctttttgtttgtctttgtcagtagcaccgagaatagtagatggcacatcccaggcactcagtaaaggtttttgaggggaaaggagggagaggaaggcactgcgtgtt

SEQ ID NO: 79 - DNA, 1191 bp, Homo sapiens
gcccctcagatgagagctgcacccaggccagcaccagtcgctcagccaccagcagcggcaccgccatctacagttggctcttctgctgctgcgccccggcagccaggtctgatggcccagatggcaaccactgcagctggcgtggctgtgggctctgctgtggggcacatactgggtcatgccattactgggggcttcagtggaggaagtaatgctgagcctgcgaggcctgacatcacttaccaggagcctcagggaacccagccggcacagcagcagcagccttgcttctgtgagatcaaacagtttctggagtgtgccgagaaccagggtgacatcaagctctgtgagggtttcaatgaggtgctgaaacagtgccgacttgcaaacggattggcctaatcaagaagttcaacctggagagatggaaaatcagctctcatactaattaatttagtataaaaatagaattggtagtgagggtataaagtgtaagcatcagttaaacttctcctgtcattcctagcttccttgcttcagaattgaaatggaagggagggtgttcctactctgtagaatctgggactgggcaaatgtttgtgtggcctccttaaactagctgttatgattttattctttgtgagttaattagaataaagtcattttcttccaaaaaagaaaaaaaaaatagccaggcatggtggtgcacgcctttaatcccagctactagggagtccgaggcaggagaatcgcttgaacctgggaggcagaggttgcagtgagccgaggtgtgccactgcactccagcctgggcaacaggatgagactccgtctcaaaaaaaaaaataataaatattttcactccacaactgtcttccaatttggagagtctgccgtttactagctatgtgaactcgggtacattaattaaaatccccatgcctcagtttctttatccatgaaatgggaatgattactcacagttcctgtctctgaggacttctagaaggatgaaatgaggtcttacatgtagcaatataaactggtggtgaggactgagcttgagtcagattacctgctttgaatccttgtgccgtcatgtactgcttgtgtatccttagacaagagactgtccctcctctatccttcagtttcatctgtaaaatgaagataatacctcctaggatttct

SEQ ID NO: 80 - DNA, 1168 bp, Homo sapiens
tcggtccacggctcagacagtctgtccctcaactctttcaactccgtcacctccaccaacctggagtgggatgacagtgcgattgccccatctagtgagggtgagtggccccagggcagaaaagctaagcccctgttgtgaaacagacttgaactgcttaagcctggctgggtgatgtcttccttggctagttttggtctggtggctgaaatttgcaattaaacagggctggccatttcccagatcttcatctcctcagagtccctgtggtggctaaaaagtggattctgggcacaaaaagctgaaattatatatatatatatatatataaaatatatattttttaaggttagacccttttccagaaggttctagtcacatgcctgtggcagttttctaagcaaggaaggtttagcagtgggacctggaaaccttgtcgcagggttgagtgttgcctgttctggggagcttgtctgaccccacattctttgcagaaggaggttaagcaacccctagaagaagagagaaccaggcaggtctgaagcgcagggaaaccttgccactgtgtcctgtgtgtccgtccgatttctctgagttccttctgcgctcgctgatgtgtttgggatggtcgcaccctttgcatcagggaccgaggaagaagctgcaggtcattttgttgtcttgacccaatgatttactggaacagcctggtttctttcaaaccttaggccctggtgttcatggataaaactggccattttcccctctttatctcctgtaggagaccagagcccttcatttacttcaccccaccacctcacctccagggaaggggatcccagccccaatttagccctggggcaccctagaattgcctcagcattgagaccttgaccttcccctttctttatttctgctgtaccacgggttatatgtcccaggaagggaggtccctctcaaacttgctgttagcaagacctgcattgctgaccgtgcaagctgaagaaggcggcacagtctccttaggttgggcccatgggccaccttagaggagttggaggggtgggccttgccggaagagccagggcaaggatggatccatggatggaggtgtcccctcagcaatttggagattgtgcaactgcagctgccagggcagtgtctcctt

SEQ ID NO: 81 - DNA, 1199 bp, Homo sapiens
tcccaaagtgctgggatttcaggcataagccaccgtgcctggcgctgggctaagttaaccttttgtagtgacggtttcaccatgttgccccggctggtcttgagcgtctaggctcaagagatcctctcaaagtgttgagcttacaggcgtgagtcaccgcgcctggcctatccttccttttggcggtgagagcttacagaatttttttttaaatgctgtgttttttttcttttttgtctgcacaatgaaaatgaaatagtgtaaaactattagttttagtggaaatttggaatctgttacagtagcctgataactcaggtaaattattatggctctaattagctgggcagtttagattcgaagaatgattgcccagcacttgaacagactagaagggtctgtttaaacactcctaattcctggggttcatttttatttataaaacacatactttgggccaggcgcagtggctcacgcctgtaatcccagccctttgggaagccaaggcgggcggatcacgaggtcaggagatcgagcccatcctggctaacacggtgaaaccctgtctctactaaaaaaaaaaatacaaaaattagccgggcttgggggcgggcgcctgtagtcccagctactcgggaggctgaggcaggagaatggcatgaaccccgggaggcggtgcttgcagtgagccgagatcgtgccactgcactccagcctgggcgacagagcccaaaacagatgctttatacctttaaccattacatttaacacagaaagcacatacttttattgtacaaaaaatggcgttgatttgtattttcttaaagagtgggtggtggctgggcgcggtggctcacgactgtaatcccagcactttgggaggccgaggcaggcggatcacctgaggtcaggagttggagaccagcctcaacatggagaaacccgtctctactaaaaatagaaaattagccaggcgtggtggtgcatgcctgtaatcccagctactccggagcctgaggcaggagaatttcttgaccctgggaggcagaggttgcggtaagccgaggtcgcgccattgtactccagtctgggcaagaagagcgaaactcttgtctcaaaaaaaaaaaaaaaaaaaagagtgggtggtgtttgcacagttaacatctcccttatgaccaatggcgtacatttgcaaaaca

SEQ ID NO: 82 - DNA, 1143 bp, Homo sapiens
agtggaccgcacttcctcttcgttcagtgcctcccctcattcttgtcctttaggggtgtggtggaaattattaccagggttatgggttcttcaaaatacaaaaagccaaaccaaaacgaaaaaaaaccctcttgtgtaatgaacttcccccgcgtgcaaaattcggggaacccgggcggcttgcctctgcctcccgcctgcgcggtctccctagacgaattgcctcccgcctagccgcctccctagacgtattgtcttgtgacgcacccccgagtccctgtaggtgcaaggctttaaaaagggagctttttcgagaagaaagcacatcgggggctcttagaggccagcgtggacgccgcaatcgcggggtgagccgcgcgacgaccctatggctctcggaaggtgctgacttggggcgggtgcgcgtgcaccactgaccgcgccagcccggggtcgggccggggcagcgcgctgggcggagccgctccgtggcccctaacaaagggcgagctcattgcccggtgggaactgtgagttggtgtcagagtcctcctaggaactcagtatatgaaacttatctagagggtgttgaagtaccagcaagcaatagaattctgacaaggctgtaatttgaggcttggaaatgaccaggttaactgtctcttgaattcgtagaatttgttatagattctgtcttaacataatttatgcttaatagagtctttaaaatcggcgttcctacggtaatgataccactgactactaaataagaggaagaaaatttgtggcgtgtatgttttataatttgaaataggcatatcaaagttcttttgtgctgtctaataggatcctggagatggatttatttatttatttatttagagacagagtctctctgtgtcgtctaggctggagtacagtggcacgaacagaactcactgtagcctcgacctcctgggctcaatggattcgcccacctgcaggcgcaccgccacacccggctaatttttaaattttttgtagagacaagggtcttgccttgttgtccaagctggtctggaactcctgggctcaagtgatcctcccacctcagcctcccaaagtgttggggttacaggtgtgacccactggtccaggcctgtt

SEQ ID NO: 83 - DNA, 1182 bp, Homo sapiens
gtgcattgcagcattcgctcgctcctcagtgttatgtgcctagacgtgtcatttctcattatgcagattccagagacattgcatgcttatggctgggagtttggcccctctgcaagatgagggggcagagagaagaaagaggaaatcgtcccaggcagctttggaagggttcttagtggacggtgctgcggtctggcttgtgtgaatgactttctaaaatggcggccaggacccactttatgtgggaatcagcagagccgatctcagaatgcacagagggaggagggggcggaggattcgagctgccttggaaagcggcagtctggaggaacattactgtattaaaaacggcttagctggcagtttgctcacgactgcattcaaaggagtatcttacctattgcagagtaaaagcagatgctactgataaaagcaggttattttaaaactaagcagatcatgtgtccctgaaattcttttattttaaaggtttttttttttcatttttaaacaaatctatttagttgtttaaatagacagtacatttttatgggttcaaagcatgtgaaaggtatacagagaaaaatctccacccctgaccctggaattcccagttgccacacttcctcccctcaccccccaaaatccaggtaatgtctatttctggtttcttgtttatctttctgcatgtacaagaaatgttcctgctgatccagctgtggagctaagtggaccttgtttggaggaactcaaggccttttatccctattgtgggatatattttgtaaaatgtgtgattgctactaggagtaaaagtgaaatctgaataatttaagtgaaaggaataaaaaggtagttgtaccagaacgatggctctgcaagaaaatgaaatggtattcacttctggtgtcttgtacaaatcagaatgagaaaaaccatgcaatacctatattaaaactgaactttaagtgcctactcttatccttttccctagctgattacattaataactgttttacaggattaagaggtgtacactgggaatacattatataaaacgttttcaagatgaatgttctcttaacagtgattaggcttttgtagtaagtgtttgcattttacaaaaagattaaaccagacagctttggggacagcttagagacattttaacagaaaaaagag

SEQ ID NO: 84 - DNA, 1235 bp, Homo sapiens
tcccagctactcgggaggctgaggcaggagaatggcgtgaaccccagaggtggagcttgcagtgagctgagattgtgccactgcactccagcctgggcaacagagcgagactccatctcaaaaaaaaaaaaaaaagaaatgagagtaatgtaataatgcgatacagatattttccccagagagaaaaacgttaagtgtaaaagagagccatttaaaaagtcattttgcaggtcgtccctcctacatacataacgcaaattgtccaaaaaaaatctaaaaactcattttggaaaattattgatatgcagcaataacgttgactttattttttccagatatggccgcgtggaaagtgtcaaaattcttcccaagaggggatctgaaggaggagtggctgcctttgtggattttgtggacatcaaaagtgcacagaaagctcacaactcggtcaacaaaatgggtgacagagacctacgcacggattataatgaaccaggcaccatcccgagtgctgctcggggattggatgatacagtttccatagcatctcgtagtagagaggtttctgggttcagaggaggtggtggagggcctgcttatggtcccccaccgtcacttcatgcacgagaaggacgttatgagcggagacttgatgggtaagttccaaggtttctgtaggcaggtattttgtatttgatatggtgagaaacagaaactcatatttaggggccccagatggatttaaagttttgggcattctcaatgtttcctattttgggttggaaacggaagtgatttatatcccaatggctggtatcttatggaatcgtagaggatatttcctgcagctgattggatatctgttcctgagatataatgtgatggaagatttcctatggaagcttcatttttggagttacctgtcttctagaattacttattccttctcttggataatgttaagtccttccttggatatatcccttctacctgatggagctatttggcttttgtgttcatactatatggaatatttctggaatattagagcctacagattcttttagaagttgatatctgcctctccattttcactacataaagtgtacaaacaaattggattgtaacaaaaaatctggcagaccataatgattcaaccacttggattctacaaacaatactttaacatggaaatgtgtacttggatgaagaagagagaaggcaatgcctgattt

SEQ ID NO: 85 - DNA, 1195 bp, Homo sapiens
aagtccttcctattgttgagacatgcgctgcagcagggctttcatgtctaagttaaaacatagcatggaaatgtggcctaaaagaaatttgtgagtaaataaaatttggtatatactttaatcagatgaaagtgtaaaaactttcatattattaaaatagtctcttgttccgttaacatgaaaaggagattgtatatttatgtatgcaagtcagaaaatctctaataaagtaagcaagtgagctgcagaacactagtcatgaaagcccaatatacaatgaaaacaatgattgctcagctgtgaaaataatttttggagtcaagtaaaatgttaagcttgttagcgtttgcttattaagtaggttaatgctgtttagaaaatgaccagttgcaaagacaaagacaatgctgaagtgaatgtttgcatgacttgcttttagttttgcttgctcctttctgattaaatatttttccccctcctaaatgcagggcttcagataacagggagcgtgcttatgaacatagtgcctatggacaccatgaacgggggacgggaggatttgatcggacaagacattacgatcaggattactatagagatcctcgagagcggactttacaacatgggctctattacgcttctcggagtcgaagtccaaatcgctttgatgctcatgacccccgatatgaacctagggctcgcgagcagtttacactgcccagtgtggtacacagggatatctacagggatgatattacccgggaggtacgaggcagaaggccagagcggaattaccagcacagcaggagtcggtcaccacattcatcccagtctagaaatcagtctcctcagagactggctagccaagcatctagacccacaaggtcccctagcggcagcggctctagaagtagatcctccagtagtgattcaatcagcagcagcagtagtaccagcagtgacaggtaggttaacagccttttgttataacagatgagctagctttaaacaaattctcaacaatcagtgggaatggtttcagcatagtattattttttaaagtaatcttggatcatatatgtatgtaatcagtaaagaaactggcatgtggccattgaattaactgttctaagtactcgaagttaagtgatgatttgcaaagttctgtttcatcctccagatgcacagtattaaa

SEQ ID NO: 86 - DNA, 1197 bp, Homo sapiens
gtcgtaggaaacagcagatggaaatggaaatagccaagtctgagaagtttggcagtcctaaaaaagatgtagatgaatatgaaagacgtagcctcgttcacgaggtaggcaaaccccctcaagatgtcactgatgactctcctcctagcaaaaagaaaaggatggatcatgtcgattttgatatctgcaccaagcgagaacggaattacagaagttcacgccaaatcagcgaagattctgaaaggactggtggttctcccagtgtccgacatggttccttccatgaagatgaggatcccataggctcccctaggctactgtcagtaaaagggtctcctaaagtagatgaaaaagtcctcccctattctaacataacagtcagggaagagtctttaaaatttaatccttatgattctagcaggagagaacagatggcagatatggccaaaataaaactatctgtcttgaattctgaagatgaactaaatcgttgggactctcagatgaaacaggatgctggcagatttgatgtgagtttcccaaacagcataattaagagagatagccttcgaaaaaggtctgtacgagatctggaacctggtgaggtgccttctgattctgacgaagatggtgaacacaaatcccactcacccagagcctctgcattatatgaaagttctcgattgtcttttttattgagggacagagaagacaagctacgtgagcgagatgaaagactctctagttctttagaaaggaacaaattttactcttttgcattggataagacaatcacaccagacactaaagctttgcttgaaagagctaaatccctctcttcatctcgtgaagaaaattggtcttttcttgattgggactcccgatttgcaaattttcgaaacaacaaagataaagaaaaggttgactctgctccaagacctattccatcctggtacatgaaaaagaagaaaattaggactgattcagaagggaaaatggatgataagaaagaggaccataaagaagaagagcaagagaggcaggaattgtttgcttctcgttttttacacagctcaatctttgaacaagattccaagcgattgcagcatctagagagaaaagaggaagattctgacttcatttctggtaggatctatgggaagcagacatctgagggagcaaacagcacaactgatt

SEQ ID NO: 87 - DNA, 1173 bp, Homo sapiens
cccaggaggcaaaggggacccagacgggagtagagcagcctcgcctcccagctggacctgcaaacaggccacctgagcctcacacccaggttcagagggcacaagcagaaacaggcccgacttccttcccctcccctgtgtctgtctccatgaagcctgaccttccagtctctcttcccactcagactgccccaaaacagccgttgtttgtcccaacaacctctggccccagcaccccaccaggactggttctgccacacactgaattccagccagcccccaaacaagattcctctccacacctgacttcccagagacccgtggatatggttcaacttctgaaggtaagcatgagcaggggctgcccttcctggcccccaagttttatgccatgtcaaatgtcctaagattccctagttaacagacccacaagctacagcctctggctgtgtccagcatggctcagcgaggggccatgagctcacttcctgtttgtttccctgtgagcagaagtaccccatcgtgtggcagggcctgctggccctcaagaatgacacagctgctgtgcagctccacttcgtctctggcaacaacgtcctggcccatcggtccctgcccctttctgaaggagggcccccactaaggatcgcccagaggatgcggctggaggcaacgcagctggaaggggttgcccgaaggatgacggtaagactctcaggcccaggtgagcaactgccccacctacagggaggaagacgtaggtagtccctgccagcccatctccctggcctgtcatggaagcattaactgtattcttgttgttgttgaaacagtctctgtcgcctgggctggagtgcagcggtgcgatctctgttcattatagcctctgcctcccgggttcaagccattctcttgcctcagcctcctgagtagctgggattataggcacgcaccaccatggcaccaccatgcccagctaattttttgtatttttagtagagatggggtttcaccatgttggccaggccagccttgaactcctgacctcaagtgatctggctgccttggcctcccaaagtgctgggattacaggcctgagccactgtgcctggccagtaacggtattcttgaagtgagcaatgaagggtccactatgcttctacttggtggggg

SEQ ID NO: 88 - DNA, 1068 bp, Homo sapiens
cgccctgtgagttctctgagagtcacctgtcccgcctggcccctgacctccttgccagcatctccaacatctctccccacctcatgattgtcattgcctccgtgtgagccactgagtggttatcacctcagtgaatcttcccagggctctgcagtaaaaacaaaggacaacccagccaagcagaggaagaagctgccgaaggggacagactccactgccagacggccagccgtttgctgtcctgccgcccggctcagtcggccagacttcctctaggagtggtgctgctaccttgtatgtttacataatgctttagcccaaggacacatcaccaacccatggactcgcagacaccggggctgggtttctctttcctctttttggagaaaaggaacagggcagtggaatgaaaattttttgtttgtttgtttttaagaaacaagaaaacagaactgcctttgcactaaattagtgacttggacttttgcccagtgaagacaggctgtgacactctggatgtcttggtgtgtgtagacacacattgcagactcttaacgcaggaaggacttcaaacttctgctgagaccttggggtcaaggaacatttcattggttttttttgtccacccccatctcccttgctcatttggatgcgtcaccttaattctcctgctgccaccgtctttgattcaccgggatgtacagtttacagttgaagagcaaacagaaaggttttctcttggtgggatatgcagaacttgggatgtgtgtatatataaatatataatatatataaatatatataatactgacttaaaaaatcaaatcccccgacatacgttttttttaatctgtgccaaaaatgtgttttcagaggaaatcttattttcatattcagactttgtattgcccactcatttgtataagtgcgcttcggtacagcacgggtcctgctcccgcgatgtggaagtgtcacacggcacctgtacaaaaagactggctaacccctcttcctattaccttgatctcttcccccaacttcctaacacttattaatttatgaaactgt

SEQ ID NO: 89 - DNA, 1109 bp, Homo sapiens
atttactataacccgtcttagcttcttgaacggagaatgtccaccaaaaccgcaagatcatcttcatatcaagcctgcactaccatgtctggatgaactggctgagaacactacgtgccagccacgtgccaagtcccaggccccaaactggttaggggtcaggaagagcattccaaagagctcacacagaagctcaatcctatctctccaccaaggtaggcgacgccatggggctgcaatgcctgcttttgtgcttttcaggcacctcccccagtgctgccaactgcccttctgaagggcctgtgtttgccaccctccaccttggcactaagttgctatttctaatctgctctgggccaggagaacagataaaactagggccctcaatggtttagagttttacagttcaccaagtgctcaaggcacattatcttctgtgaacctcaccccagcccctagggaaagacagattgggatgagccacgtgactgtgcaggtcatttcagtttccattctcttacctctaaaatgctgaaaataacaggaactactccataggactggtgtgaagattaaatatccacagaatgcttagaacaggtccagcatatagtggcaataacgatattaataaaatgagatctaacattcagtgagcacttagaatgttccaaaaattgttctaagtgctatacataaatcagcttatttgatcctcacaagaaacttatattttaagtatcattacttcccctatcctacagatgagaaaaatgaggcatggagaagtgattttctaaagatcacaaaactgggctgggcacagtggctcagcctgtaatcccagcactttgggtggctgaagcaggtggatcacctgaggtcaggagttcgagaccagcctggccaacgtggtgaaacctctgtctctactaaaattacaaaaattagccaggtatggtggtgcatgcctgtaatgccagctacttgggaggctgaggcaggagaattgcttgaacccaggaagcggaggttgcagtaagctgagatcatgccactgcactccagcctgggcaacagagtgagactccttcttaaaaataaataag

SEQ ID NO: 90 - DNA, 1217 bp, Homo sapiens
ctcagggctcttcaaaggactaaaagctaaaggcgacgatgaattcattccacaagtcctagtcgtgcgccctggtgagtaccagaccctgctccccgcgaggggacccacgagcgaccctcaccaccatccctgccctggtggagcccccgtgcggaacacaggatccgaagatggcagcggaagctcctcagcggcccggaaagcgactgggcagggtgggcacaggctccttcaatgggtgaaggcggcgcaaagaacgggaagaaccatcccaggagcccacagggcgttcagcttcccttggggccccaggcagctcgggctgggtcgcccaccagggagtttctggaagcttctgcagcaggcgaggggcagggcgggcgaaggcaattctgctgttcttctggctccagaatctcctaacacgcaggcgtccaacgtgaccggcgcgactcaccgctctaatctctctggttttccaaggccttgctcagtggtcctgcccggtgggccctgagaatagacggaacggaggaagttcagtgagtgcgcccttcctagatgcccagtagagttggaagcgcttgtctctgtggcgcaatcggttagcgcgttcggctgttaactgaaaggttggtggttcgagcccacccagggacgcttattggaacttttgaagcattcacgcaatgtcaatcactagataaatggggaagattttatcttcccaaagtctcaagccactaatttatgacagatccatgtcaagggccgcccacctccccgaccagattcttagccggctatctcctgaaatgccgggtttacacctgtgtcactaaggaatcctgaaacagagacctaggaacccacttctgatgtgataaaattctaattcagtccgttatacgcttaaacgagtatttacgtgtctccattttttcatattttagtaataggagtccagtattacctccaggatgtgcctgggtttcctgattgctctatcaataatgtgaccagtggaatcattcatcatgaaagtgattctctccatcatttttgaaaatagtatttttcctcagtttatgcatgatttatttaacccttttcaaaatgtttttgttagccaggtatggtggcatgcacctgtaatcccagctactcgggaggctgaggcaggaaaatcgtttgaacttgggaggtggaggctg

SEQ ID NO: 91 - DNA, 1173 bp, Homo sapiens
taatgattacgagactgatcattactcttttgccaaaaaaaccagcgacaaaagactaacttagtggaccaacctttgtttcttcattatctctaccttggttctgtccttttatttcctctttcttctaattctgcttctgctactgatttcctccctggatttgaactttacttacctaaactaccagttaggttaccttcttagaacctctaaggcagcagtttgaggttgacgatggaagatttaggattagaaaaaagaaacgtgaatgaatttctgatgttttattataggggtttgtaatgcaggtagaaagaaagacctttttcagagttaagagtttgatccgacaaatgagctattttgatatttataacgttgtctagtaaaagtttcctgtaaaaacacatttggtttggatgtctttgttagcttttagtcgacacttgaaaaaaccgcttggaacggtttctaagtctttgtggatactgttttctgttatcctgcaggcggttgttacgcagaggcattggtggttcagtggtagaattctcgcctcccacgcgggagacccgggttcaattcccggccaatgcaagagggtctttttcaccccgctgttgctctttatctgtcttttacgctgaaaatcatactgcataacctaatagtgcatttaggggcttggccaccacaaggtaaagtgacgacaacactcacgaaagtagcggcaggagacattcaggagactaactcaggaccccatgcagttgttggactcaaacagcttagcaagctgacaagcatgaagtgtttccggtgagtcactgcagttttcatactggtacctgtgactttcatctattcactggaaggatccctgcaaacccgaagaaccatcaggttcctgattcgcgtgctggaccttgggcttaccgttgagccactatggagaggatcaagaaatgacgctcttggaaggagagaagctgcgggcaggacagtcacctcagaggtccaagaggcgtcagcggcccaaagaaaggggtggtgtgtgggcaagaatctgcgtggagatgaggggagcggcggagactggtccttgcgcagaggcggccagtagaccctcagggctgtaccccagacaccgtgaaccgaatttgctcacat

SEQ ID NO: 92 - DNA, 1254 bp, Homo sapiens
ttcatcttttcacatcacatttccttcaaatgctttatacatcttcaagcagacaaataatagtattataatgattacgagaccgatcattactcttttgccaaaaaaaaccaacgacaaaagactaacttagtggaccaacctttgtttcttcattatctctaccgtggttctgtccttttatttcgtctttcttctaattctgcttctgcttcttatttcctccctggatttgaactttacttacctaaactaccagttaggttaccttctcagaacctctaaggcagcagtttgaggttgatgatggaagatttaggattagaaaaaagaaacatgaatgaatttctgatgttttattataggggtttgtaatgcaggtagaaagacctttttcagagttaagagtttgatccgacaaatgagctattttgatatttataacgttgtctaataaaagtttcctataaaaacacatttggtttggatgtctttgttagcttttagtcgacacttgaaaaaaccgcttagaacagtttctaaatctttgtggttactcttttctgttatcctccagggggtagttccagagaggcgttggtggtttagtggtagaattctcgcctcccatgcgggagacccgggttcaattcccggccactgcacgtggttgtttttcacttcgctatggctctttacttgtcttttacgctgaaaattatactgcataacccaagagtgcatttaggggcttggccaccacaaggtaaagtgacaacaacactcaccaaagtagcggcaggagactaacccaggaccccatgcagttgttggactcaaacagcttagcaagctggcaagcatgaagtgtctctggtgagtcactgcagttttgatactggtacctgttactttcatttattcactggaaggatccctgcaaacccaaagaaccatcagtttcctgattcgcgtgctggaccttgggcttaccgttgagccactatggagaggatcaagaaatgacactcttggaaggagagaagctgcgggcaggacagtcacctcagaggtccaagagttgtcatcggcccaaagaaaggggaggtgtgtgggcaagaatctgcgtggagatgaggggagcggcggagactggtccttgcgcagaggtggccagtgaaccctcagggctgtaccccagacaccgtgaatcgaatttgctcacatcatcagcgaccgcagcccccgcgtgtt

SEQ ID NO: 93 - DNA, 1232 bp, Homo sapiens
tcttttcacaccacatttccttcaaatgctttatacatcttcaagcagacaaataatagtattataatgattacgagaccgatcattactcttttgccaaaaaaaccagcgacaaaagactaacttagtggaccaacctttgtttcttcattatctgtacattgattctgtccttttatttcgtctttcttctaattctgcttctgcttcttgtttcctccctggatttgaactttatttacctaaactaccagttaggttaccttctcagaacctctaaggcagcagtttgagattgacaatggaagatttaagattagaaaaaagaaacatgaatgaatttctgatgttttattataggggtttataatgcaggtagaaagacctttttcagacttaagagtttgatccaccaaatgagctattttgatatttataactttgtctagtaaaagtttcctataaaaacatttggtttggatatgtttgttagcttttagtcgacacttgaaaaaggcggttggaaggttctaagtctttttggatactcttttctcttatcccccaggccgtgggtgtgtagaggccttggtggtgcagtggtagaattctcgcctcccacgtgggagacccgggttcaattcccggccaatgcagcaggtacttcttcatttcattatggccttttacccgtcttttacgctgcaaaattatactgcataacctaatagtgcatttaggggcttggccaccacaaggtaaagtgacaacattactcacgagagtagcggcaagagacattcaggacactaacccaggacccatgcaattgttggactcaaacagcttagcaaagtggcaagcacgaagtctttccggtgagtcactgcagttttgatattggtacctgttactttcatctattcacggggcggatccctgcaaacccgaagaatcatcaggttcctgattcgcgtgctggaccttgggcttactgctgagccactgtagagaggatcaagaaatgacgctcttggaaggagagaagctgcgggcaggacagtcacgtcagaggtccaagaggcttcagcggcccaaagaaagggaaggtgtgtggggaagaatctgcgtggagatgaggggagcggcggggactggtccttgcgcagaggtggccagtggaccctcagggctgtaccccagacaccgtgaaccgaatttgctcacatcgt

SEQ ID NO: 94 - DNA, 1195 bp, Homo sapiens
ggcctacgggagggagggcaaggagagtcctacggttcctgggaggacgagaagagccaagagccccgacggccggcgccggggaaaaggccccgaggcggggtccgcatccctggaagggcggcgtccaccctcctgagaggcacggggcgcccagggctcggacgctcaaagcccgccggctcctgcagcttctgggagccgaagagtgtcagccgggaggatcccgcacacggcgcttagttctggaactgcatacccaggggaggatgcgggagcccgaagcccgggtatgtgtccccgaagcccgggtgtgggtccccatggttttcgtgttgggggtgggcgcggaacgctaagcctgggcctattgggagccatagtcttcttgatggctggtgcttattgggcttttttcagtcgaatttcgaaatgcagttgaatttcttactttggaaacgataatagaaatggctgacctaagattttcatgatgatattttgccttttttggtgtatatgcagtttctgtggtgtagtggttattatgttcgcttcacatatgaaaggtctctggttcgagactgcgtgggaacatcgtgttttgttttgtttttttgtccctaaatttagtgagtttaatcgaggttgggaaacaaacagaaaagtagttgaacctgtggctacactttagacctcctcaatctagacagatcgttgaccaggctacagtttccactggtctgccagcaagaggcctgcttaatattagctttggttccagaaattccttcaggttctcttcattctcttctatcgcctgtattttcacaggctgacactgaaagtggatgacatcttagtgcatttcctaagggtcccgcttggcttcgctttactctggtaagttgcagatctggctgatttgcaagacaacaaaaacaaaatattttttaaaaaggttctaaatctgcatctggaagtcatagagtcaatattcctaaatcacatgaattatgtgtatacatttgcatgcataccccttccccaaataatcctcagaaaaccggttaagttttagcatctgtgactctgagatgcatatgaggcctttgtaaatttagaagttaagagtagaaagtacaggtttgtattttagaaggagatttgggaataaatatagctctggtggata

SEQ ID NO: 95 - DNA, 1230 bp, Homo sapiens
tcaagcagacaaataatagtattataatgattacgagactgatcgttactcttttgccaaaaaaaccagcgacaaaagactaacttagtggaccaacctttatttcttcattttctctaccttggttctgtccttttatttcctctttcttctaattctgcttctgctactgatttcctccctggatttgaactttacttacctaaactaccagttaggttaccttcttagaacctctaaggcagcagtttgaggttgacgatggaagatttaggattagaaaaaagaaacgtgaatgaatttctgatgttttattataggggtttgtaatgcaggtagaaagaaggacctttttcagagttaagagtttgatccgacaaatgagctattttgatatttataacgttgtctagtaaaagtttcctgtaaaaacacatttggtttggatgtctttgttagcttttagtcgacacttgaaaaaaccgcttggaacggtttctaagtctttgtggatactcttttctgttatcctccaggcggtagttacgcagaggcattggtggttcagtggtagaattctcgcctcccacgcgggagacccgggttcaattcccggccaatgcaaaagggtctttttcaccccgctgttgctctttatctgtcttttacgctgaaaatcatactgcataacctaatagtgcatttaggggcttggccaccacaaggtaaagtgacgacaacactcacgaaagtagcggcaggagacattcaggagactaactcaggaccccatgcagttgttggactcaaacagcttagcaagctgacaagcatgaagtgtttccggtgagtcactgcagttttcatactggtacctgtgactttcatctattcactggaaggatccctgcaaacccgaagaaccatcaggttcctgattcgcgtgctggaccttgggcttaccgttgagccactatggagaggatcaagaaatgacgctcttggaaggagagaagctgcgggcaggacagtcacctcagaggtccaagaggcgtcagcggcccaaagaaaggggtggtgtgtgggcaagagtctgcgtggagatgaggggagcggcggagactggtccttgcgcagaggtggccagtagaccctcagggctgtaccccagacaccgtgaaccgaatttgctaacatcgtcagcgaccgcggcctccgcgtgttttgtgg

SEQ ID NO: 96 - DNA, 1313 bp, Homo sapiens
ctgacccagctccctttagtcacgtttgcttggctctggtaccaaatagttgggattaccgaagagtccccttccttgcgtgtcagcacggatgctgtgactgccacctgcgtcctcgtcaagtgcccgagctcgccgccgtgtgtgctgcgctgagtgagttatgaggtgcctttcccggaaccctcctctcgcctggacccaagagaggcgacagctgtggctggggctcttggtttccagagggtctggactggtttgggtgctttaaaatagatatttagttcagtggtgcttatgggggagatgggactagaacttaagtgtgagacttgggtggatgggaaagttaaatattggtctcttcaagttttttttttcttttgctttgttaccacttgtcactgtctccatgttaaaatgccaaaaatgatgtagttgttgttgcttttttccctattttccaccccagtcgctccttaccgtgactcctgcccttggagggcatgtagcagtgtctgtcctgccagtcccaaggccctgtgggaggagactggcctgcatctctctaagacttagtctgacgccacgcgcatctcttgttctgtgttcaatcagtagtccaggggagaagcttctgctacttcagagctttgctaaactaacctaatttgtccaaatcaccccaaaaccaccatctctgacgtaagcttccatgcgacagcctgatccgtttccctggacaggtctctttcctggaatgcagcccaggcacctgtgctcctggcacccttgaggtctctcctttgagccgtggtcaccgagagggttgaggacgcagcacccgaggtcccagcctttgcaggagcctccctgggcttagctggacttagatcttcggtggcctcatgtaaacgtggcagccagcctcttctagaaccctagcccagggactggagcaggaaagggaccttcaaagtgaagactgccttgtcccgcagctccttctggcttagattgaaaaatgggcttcctaatgggttaaatcctttaaaacaaggagttgtgggggaagggtgtcgtgcactcctagagaaaggtacacagttgcccggttgggaatgtgcttggcgctgaccctgcgggcatctgactggtcttccagctcaggaaaaagaatttgaaagaggcttagcgtgaaggggaatcaaagaggaggttgtgatttggtcgaaggtgcctggtttagtgctgtaattgtcttattattttttttatatatatatttcttggagtaaacattttaaataaac

SEQ ID NO: 97 - DNA, 1206 bp, Homo sapiens
cagtcctggaggtggggctgggcgtgttgtgttgagggtggatctgtgctttgtcaccagggttcctgtggctgagagtccttgaggggcgatccctaggggtgggattggcactgttatgtgagcaccatttacagggtagaaaaaggaagagaaatattgggcagacaccaaatggtcctcagtggatgcccagagcaccaaagtgattaaactctggtgagccaggtgtcaaaatggggtgctgtcttaaaatacatctcagagggtagggacggggtggttgtcttgcaggcactctaagtgggaacggcgtgtttctgcgagcatgcccgcctgtgcatggtgtccctaccacactgagcctctcatttccctttgtagcagagacgtgggaggtgtgcacgggtggtcccgctgctgccccagggaaggaggtccggggagctgcagcaggcgccattccagcgggcagagggccggggcgttctttgctctggatcttggctgttgggaatttggagggtaccttccagagacagatgggcatcatttgagagtgtgtttgtactcgccttctcctggtggtgccgcctggaccaccctctctcttttctactttctctcatgtgatctgcaggtcgaaatgagaaggggcagctgggacatggtgacaccaagagagtagaagcccctagactcatcgagggtcttagccacgaagtgattgtgtctgcagcatgtgggcggaaccacaccttggccttgacgggtaaggaggtggctgctggtgtctcctctcagtttggcaagaggccaggtggtctgccttggggatggggcgtggggtggtggagttccccttgtgactcttggtcaggatcagaaagaggccctgagaaccttggcatggagtggcttcttgagggcattgggagcctccccagtggccataggaggcccatctgggagtaggagacgctgccctctgtttctctgcacacccagtttctgatgtgaaatggctttgctgtgaagcgtctgcactgccagcttttgggcagtctcacttgccttctgcctggcaaatgagctgtttttattattttgatgcctttgattctaaatctagttcaaaacattcaccattatcttcccttttgtgatatttttcctttcttccagaaacgggctccgtgtttgcgt

SEQ ID NO: 98 - DNA, 1176 bp, Homo sapiens
ggctgctgcacatgcctgacccaggacatgtgctgagagagcccgtgtgtacttgccccgccgcgcccggtgagcactcagtgactctagcagtaagaacagacctgcctaggtgatggcaggaccggttggtgcaggcttctggggaaagggagccttggccagagcgtggggcagattgggctgtgccgtggcctccttggcagggacttttggagatagggccagacgccttggaggagtggggtcgggtaggggatgtcctggttggcacagagtctggtggttccaggtgagggacaaccatgctgtagggtagggtggggtgggggttgggggctggtggcgccatcctcatgcatcactgaaacacctcccgggcagggcaacgtggtcctatggaagcccagtgacactgccatgctggccagctatgctgtctaccgcatccttcgggaggctggcctgccccccaacatcatccagtttgtgccagctgatgggcccctatttggggacactgtcaccagctcagagcacctctgtggcatcaacttcacaggcagtgtgccgtaagtccctggggatggtgtaggctgtggtggctaggggacgttcacctgctcacctgctgtctgcctggggatggggctgtgaacccaggggtcatgcacggactctactcccttacttgctgtgtggctatgagtgagccacttcacctctctgagcttccatttcttcacctgtacagggagtgattatccttaatttgcagagtcattgcaaggattaaacatgttaatgaacaggaaagagcttcgcagactggaagtgcaccctacagctgtgggtaatattgatttcagtgctacctctgctactggaaagggcacaggggagcacagaatgaactggaggagtcaggaagccttcctggaggaggtgacatctaagcagaggagttggccaggcagaggggaagaggcaggagaagaatatatatgttgggagagggaatagcacatacaatgttgccaagccaaaaacttgtgctctggggcatggcaggatcctgtgtggctggagtgtggagtttgggggcgacagggcaagagagtgagggcagggcatggtttgagttgaggtaggggaggcaggccactacctgatctc

SEQ ID NO: 99 - DNA, 1181 bp, Homo sapiens
cgctcatctggaagaggctgttctaacgaaggcgggaggatcctagatcagaagaagacaaaccggaagagggagcctaggaaaggaaccacatgcacatttagtgcaaaccatgtaaacataacataacaagactatgtggagcaagggggagtcaggctgtggacccaccagggaatcttgattcatgtttttggccccatcactcactagcttgctgactttgggcaagtcacttcacttttctgggcctctggagttactagcacagttccatgttggggagattgtgaacgtccctgatatatggtgctcaggaaccagtagttgcttggaattgtattagagctggggtaggagctagacatggggccagggaagaagggaagatgccgcgaagaagggcctggaaggggacgaagggcgtggattatcagaggaagtgggagtagtcggcaaggatgggtggggagtgttgagtcatccaagcgttcagcaaatgtcacaagacaacgacaaattgagcaaattcttcctgctcttgctgccgggtcctgcttccaccctgcttttattttatcatgccgcttttcttctagaacccgagcaacttcccgagaagagaagaacctccaaggctttctggaacagcccaaggagaagtgggtggagagtgcctttgaagtggacgggccctactatttcacagtcttggcccttcacatcctgccccctgagcagtggagagccacacgtgtggaaatcttgcggaggctgttggtgacctcgcaggctcgggcagtggctccaggtggagccaccaggtcagtacctgcttccggaagctgctgctcactatttcccatcatcagttttgaaaagctgcttagtggtacgcacgtgctaggtgaaggcatgctttgtgactgcggtggttgacaccagcccttctcccttctcagtctgtcatgtcaagagtctaagctgatggctggcaggttgcctggtcatttctgggttttctgttccgctactagaaaggtagagccagtcttacctactgtagaaaatgttaggaaggcagccaggcacagggtgataaaaccaatgagatgatcagggctaagaacagtaatcaggttttccacatcttgctggtgttggcataagccaggaaagtt

SEQ ID NO: 100 - DNA, 1178 bp, Homo sapiens
ggccttctcaccttcacacaaaagtgggcacaggcaggacctgcagtggtgtccttggtttccagtcaatggttttacacttcaattctggttcttctcatagtaattacgtagtgtgaaaatctcactgacctagttgttttagaaaaaaatagtgaaataaattctaatctgccatgacagacaaaaggtaaagatcccaatcatatgatttttcctgtcttatccaaggtctcctgagagttagcgtgagtttgggaggcctactggttttagatctctcacctttatggaaatccctttggaatccaagtttgtttccttcaccagctggaacattttatttttgtggggggcaagctgtcgcagccaactccatcttcccagatgctgtaggtccaagaagtaagagaacaaggccaggcatagcaccccggagttctcccgctaaagcccagggtgctagctggtagcttgtcttgggtttttgttgccacctgacttatggcaccatgtgccaagggaggaaagcaagcaccttcaggtgactggggtttctttgactcaggagacaaggatgatgatgacgatgatgatgcagatgagaaaatgcagtcatcagggatcccgaatggtggtcacatccgtcaggaaagccaggaacagagtgaggtggaccatggagattttgagatggtggtgagtctctggcagcaggagaaggggaggaggagcttcacaactctcctctagctcttattcagtggacttccaaaagttaccacttaccatgggacactgacagagctttctctctgcagtctgagtcgatggtcctggagacagctgaaaatgtcaacaatggcaacccctctcccctggaggccctgctggcaggcgcagagggcttcccccccatgctggacatcccacctgatgcagatgacgagaccatggttgaactagccattgccctgagcctgcagcaggaccaacaaggtagaaggccatgccaagaacaaagcggcccattggccttgcacaggaaaagagggtttggcagttactgatatccagctgacttagtttgtccccagatatggggagaggttgatctgggtgagagctgttcagagatacaggtggagagtgagagggatgtggtgggaatttcagtc

SEQ ID NO: 101 - DNA, 1194 bp, Homo sapiens
actcagcttatggaagaggccagcagtgcccagcagggacccttctatgtcactaatgtgttggaaatcaatcatgaggacctgaaggttagagcacatgttgctatttccttctattccggatttaattatttagcaactcctctattcttttttctttgttcttttataacatttttctgtggacttcatctaactggatctttttttctttttctttgtttttccatctaactttctacctaatagcaaactctcttatcctttagggctaaattaattcaacttcaagttccatttttctcagggtctttgtaagatttacccacagggatctcatgcttagagtatgagagcacctgatcatgattgaaaataataaccagtataaaccggaagttggtagccaaggcaacatgaattactgcaaatatgtgtctttgtgccagcaggacagtaacagccaggtggcgggcggtggtgtgtccgtgtactactcccacgtgttgcagatgttgttcttcagctattgtcaaggcaaatcattcgcagccaccatcagcaggacaaccctggaggtgttgcaactcttccccatcaacatcaaaaggtgggaatgaacatttaatgttcaacttccgcaatgtccacattcaatgtgggatctccactcccactatctgctatctgttctgagttttgtgaaacttaattttctccagccaacctttttttctcccctgctaggtatctttaaaatcaaggaacatccgggtttggcaggttgggttgtctgcacggtttgtcctccactgtggagaccccaagctgtcagaggtagtttaggggtccactgttactcagaaggaaaacctatagttaatgttataaatgtgattttaatgtgagaagggaacctaaatttctcttagacactcattctgccataatgccctttaagtttttctcctggggagacttactctgttagcaaatagaacgtatcagtaatgggggcatggttggatatgggggaggaagagactttcaacaagtttgcaaataatagaggggtgtgtaaggtagtgagagtttcatttagggaggaggaagaagaggcttatggtgtcttcccttgtttcttatctgccattgatgacccattgtagcactttctctcagacctttctttgg

SEQ ID NO: 102 - DNA, 1100 bp, Homo sapiens
atgtgagtgagtcagatacagttcttgccttcatatatatagcttacagtcaaggatgtggacaaaaaacatttatacaataattcaatttaattttaatagagaagagctaggaattctatatatgtgtaataatcattcatataggcttcaggattgaatatatcagtagtgaattggagccggacaaaggaccttaggagaacaaaagaaatgggtcagtctatttggaaatcctgttttcatacactgttttgtaacatctgttatattaaactggaatgccattttgtgtaagtagaattaggtgggaaagagagactcataatgaaacttaggcccactgtaagtgatttaaaatctgattctttcattcattgtgtttattgcaggatacctatgagcatattttattttctatttgtaatcagagtttataggaacgctgggcttatgaccctgataagagcttttttgtgtgtgttcctttcagttcttaggtctggcttccaacattttgaacttcatcacctcttccatgctgaactctcggaacaattttatccgaaactatctgagtgtatctctttcagaacaccatatggccaccctagccagtatcatcaaggaggtggacaaagatggactcaagggtcagtagacaagatatgtgcctgatggattttttttctcatggagtttggctgttggcagggaggtgtggtgcattcaatagctgcttaaataattggcttttctacttgtctttaaggttcatcagatgaagagtttgctgcagctctctatcacttcaaccactcactggtaacctctgaccttcagtcacctaacctgcaggtttgtgtgtgctgtgaccatctaggcaagagctcatgacaccagcttccataggctgcagctccaattgtttgtttgtttgtttttttgagatggagtcttgctctgttacccaggctggagtgcagtgacacggtcttggctcactgcaacctccacctcccaggttcaagcgattctcctgcctcagcctccagagtagctgggattacaggtgtgtgccaccatggctggctaatttt

SEQ ID NO: 103 - DNA, 1071 bp, Homo sapiens
acaggaaaatttccgatagtgattaagtgcgctgaaacaatacattgtgattgatagtgatctgggccgggtgtggtgactcacacctgtgatcccagtactttgggaggtgggtggatcacctgaggttaggagttcaaaaccagcctggccagcatggtgaaaccctgtctctactaaaaatacaaaaattagctgggtgtggtggtgcatgcctgtaatccccgctactctggaggctgaggcaggagaatcgcttgagcctgggaggtggaggtttcagtgagccgggatcacgccatcgtactccagcctggacaacaagagtgaaactccgtcttaaaaaaaaaaaagtgatctgatgtggagctgggcatgctgcttttgattcggaggagggatggcttctgagaaggtgacatttgatccaaatgaaaagagggagtcagctccatgtgaaggtcaaggaaagtacgatggaatgtatcattgaaaagaggatattgaactcttcaagttaaattgtttgggtaggatttagcatttatgatgaaatctgtcagcttgttcagatttttgtgtctgtttgatattgtacagctcgaaatctatgacatgattggacaagcaatcagcagttctcgccgggctggtggtgaggtaagaagcgtatctgtctctgctgcatacttcctatcttgtcctctctgagatgtaaatatctctatgattatgttttttattttgtgcctttcacaacagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggtatgtgtctacttgattataacttatattttgttttatttcgctaacattttatatttacagggagctagtatgacttcatatcaataggaaaatttgccttcctacctggcttgaa

SEQ ID NO: 104 - DNA, 2214 bp, Homo sapiens
cacctgaggtcaggagttcaagaccagcctggccaacatggtgaaactccatctctactaaaaatacaaaaattagccaggcgtggtggcacacacctgtaatcccaactacttgggaggctgaggcaggagaagcgcttgaacctgggaggcggaggttgctgtgagccgaaatcttgccgcagcactccagcctgggtgacagagtgagactctgtctcaaaaaaaagaaaaaaagaaatatatgtccttattaaaaattacgtgaatgttatagcagcattattcataatagccagaaagtggaaactgcccaaatgtcaatcttaataggtgaatggataaacaaaatatctgtatgtacaatggaacatttttcaaaaaaaaaaaggaattaagtatgaaacatctacaatgtggatgaaccttaaaaacatgttaagtgaaagaagccagtcacaaaaggcctcatattgtatgattccatttatatgaagtatctggaataagcaaatctattagacacagaaagtagatgagtggttgcctaggactgagagggagtttgggaggaaatggagattcactgctactgagtacagagtttcttttggggaggtgataaaaatgctctgaaattgactgtggtggttgtacaattcagaatacactaaacaccattaaattatacactttaagtgggtcagttgtatatagtgcctcaataatatgtaataaaacaatcaattagctcagaaatctgttagagcagggctcagcagggaagcctcatctgttcctcagtgtctcagaggtgatctagcagctggaggctagggttgcctgaagacattcactcaagcatgtggcagttgctgctgagggccagctggaatatcagctgctgtcatcaaccggcacacacgtgacctctgcatgtggcttccaagggagcacatcccaggcaaactaggcagaagccatgtggccttttatgtcccagcctcagaagtccataacatcactcttgtgtcctgggaggagagtcaaagatacctgtgcaaagagcacgtgagagaatggagtggttatctttggaaaataaactgtaacacttggagcaacagtcctgagtggagaaggtgagccccgggacctgccaggagactgtgtcttgactatccccatcagagatgcattttctgctatgtcacatcccatccgttagaatcttccggatactatatctcatagttgatggtctcttgaattcagcaatttcatatctaaagagattcttgaagacaccatgttgtacaccttaaatatatatacaatttttatttgttaattaaaaaataaataagtgaggccaggcgcagtgggtcacgcctggaatcccagcactttgggaggccgaggcaggtggatcacgaggtcaggagttcaagaccagcctggccaatatggtgaaaccccgtctctactaaaaatacaaaaattagccgggcgaggtaacaggtgcctgtagtcccagctactcaggaggctgaggtggaagaattgcttgaacccaggaggccaaggttgcagtgagctgagattgcgccactgcactccagcctgggtgacagagcgagactccgtctcaaaaaaaaataataagtaagtgagaaggaacaaaaaaatctaaagaagcagagctggatctggagagcatctcatatatttaatcatcctcaaactaaggaagctgttctgtgctgtatgaaagactgaaggaggagggggcatcgattttttattttattttatttattttttatttattattatttttttgagacagagtctcactttgttgcccaggctggagtgtagtggcatgatctcggctcactgcaagctccgcctcccaggttcacaccattctcctgcctcagcctcccgagtagctgggactacaggcacccaccaccacacccggctaatttttttgtatttttagtagagatggggtttcactgtgttagccaggatggtctcaatctcctgacctcgtgatccgcctgcctcggcctcccaaagtgctgggattacaggcgtgagccaccatgcctggccgattttttattttaacgttttgttttatcttactgtttttccttaggtgagaaaaatgtacccttccatgcctgtgctttctaaattttg

SEQ ID NO: 105 - DNA, 1524 bp, Homo sapiens
gggaagtttatattatctctgtttttccagcaagaaaagtagctctcaaagaaatttatagaaattgagaagttgatttttaaactctgaaaatgtaaacaatccaaaatagtcaaaccaatttttaaaaagaacaaagttgagattcttgtattagctgattttaaggcttgcagtaaagctacaagacagtgtggtgttggagaagagctggacatataaatcagtagagtaggataaagtccagaaatagacccatacatacatggtcaattcgtttttgacaaggcaatttaatggagaaaggaaaatcttttcaacaaaccatgctaaaacgactaggtttccatatagagaaaaaaatgagcctcgcttaaaagggtcgtagacctaaatataaaagctaaaactataaaacctataagagctttcccgtgtggagtctggagacgacgtgcagaaatggcacctggaaaggggaaggaaaagaaggaagaacaggtcatcaacctcggacctcaggtggctgaaggggagaatgtatttggtgtctgccatatctttgcatccttcaatgacacttttgtccatgtcacggatctttctggcaaacaaaccatctgccgtgtgactggtgggatgaaggtgaaggcagaccgagatgaatcctcgccatatgctgctatgttgaccacccaggatgtggcccagaggtgcaaggagctgggtatcattgccctacacatccaactccgggccacaggaggaaataggaccaagacccttggacctggggcccagtcggccctcagagcccttgcctgctcgggtatgaagatcgggaggattgaggacgtcacccccatcccctctgacagcactctcaggaagggggtcaccgtggtcgccgtctgtgaacaagattcctcaaaatattttctgttaataaattgccttcatgtaaaaaataaataaaaaaagtgaaacctgtaagagaaaatcctttgtgaccttggagtcagaaaagattttggggaatacaaaaagcaagtttcaaagaaaactgatatactggatttgataaaaattaaaaacttttgctctttgaatggcaccattaagaaaacaaaaaggcaagccgcagaatgggaggaaatatttgtaatacacatatctgataaagggcttagaatacataaagatctcttaattttaaggttcccccccacccatagactcagggtctcacatgttgctcaggctactacttctggcctcaagcaatcctcctgccccagtgtccgaaaattctgcaatttaagatgtgagccacttttcccagctttttttttttttttttttttttttttttgagatgggatctcactctgtcgctctggctggagtgcagtggcacagtcacgggagcctcagcctcctggactcatgatcctcccacatcagcctcctaagtagctaggactacaggtgcgtgctaccgcatcaggctaattaaaaaaaaat

SEQ ID NO: 106 - DNA, 1524 bp, Homo sapiens; identical to SEQ ID NO: 105

SEQ ID NO: 107 - DNA, 1194 bp, Homo sapiens
caagcgattctcccacctcagcctcctgagttgggtcctacaggcgcacacgaccacgcccagctaattttttgtatttttagtagagttggggtttcaccatgttagccaggatggtctcgatctcctgacctcgtgatccactcacctcagcctcccaaaatcctggggttacagatgtgagctaccactcacggcccaaatcttcttgatcatatgtttaaatatattttttaatatttggagcatgagttgtcacttcttgtttgccttttttataaggaaatgttggagagttacatcattgctaatgtagaaatgttaagtggaaaaatatacagtttggtaaaataaactagattctacatttatttgtgggtttttttcccctcctttctttccacagcacttttgatatcaagcaagtggcttcctttttgagatattaaaaaaaaaaagaaaaggaaaaaagtaaatgaagcccaactacctaaccctttcttatttgtatttgttttagtattgtgaagttgtgttaaatagtactagctagaaatacaaatttctggttatcatttctcttccctgtggcacttgacattttaattgtcttaaagtttttgaagtacatcttctggccccttgagtactgccagaggcaaaagatgtttgtttcttattcattccacttttgtctcctgggatcccttctgtagcctaaagtatggctgggaaatggacttgagaagattggcttgaattagatcataatcatgtgtgatcccatcatgaattcattggaatttgtgttgcatgtaaggcaatctttcctgttgtaaatcttccttttttaatgtacatatattttgaaaaatatgaataaacatgaaattttaaaagctgctgaaccgtagcttatatttaaaggttttgagtatagtatatcctcagaagtagctaagtgtcgccctcactttaagtcttttctactccttgaaatgaacaccatcattttcctttttaaatacaagctccagttcatgtgttttggaattcttatagagggtaaacgatgtttccagatacattgaatgctaattacttaatgaatcaaaggtttaaaaaatcattttgtattttattaaagactgcttccaagatcatagagtacaatcatgttcaataaatgttcaa

SEQ ID NO: 108 - DNA, 1154 bp, Homo sapiens
gaattggctttgagaatctgaaagtaaaatttgctattgatgtgtatctatataaagtgatggcagttactttttaatttttaatttttttttttttttttttgcaggagagctgatagtattcattccactcttttcataattggtcagaacagttagaaattgcttttaactatagtcatgcattgcttaacaatgggtatacattctgagagatacatctttaggcgatttcatcatcgtgccaacatcataaagtgtacttacacaaacctacgtggtacagcctactacatacctaggctttatgggatagtctgttgcttctaggctacaaacctgtacagcatgttactgtactaaatactgtaggcagttataacacaacggtaagtatttgtgtatttaaacatagaaaaggtacagtaaaaatataatataaaagataaaaaatggtatacctgtgtaggacacctaccatgaatggaccttaaaggattggaagttgtttgggtgagtgagtgagtggtaagtgaatgcaaaggcctaggactactgtgtgcaacttttaaaactaaaaagtttttatttttagcaacttttaaaactaaaaagtttttatttttaaaaacttttaaaactttaccaaaaacaaagacacaagccggacgcaatggtgcacagctgtagccctagctacttaggaagctgaggtggggggattgcttgagtcctgaaatttgaatctagattgggcaacgttgtgagacctcatatttataaaaaaacaaaactaagacacatacacacaccttaacctaggcctgcacaaggtcagggtcatcaatatcactgtcttccacctccagatcttgtcccactcaaggccttcaggggcagcaacacacatggacctgtcatttcctatgataacagtgctgtcttttggaataccttctgaaggacctgcttgaggctgttttacagttaactttttttttgtaggtagaaaacatatactctaatgataaaaagtatagtatagtaaacacataaactagtagcatagctgtttattatcaggtattatgtataattgtaatgtgctttttttttttttttgagatggagtcttactctgtcacccaggttgg

SEQ ID NO: 109 - DNA, 1126 bp, Homo sapiens
gtcctctgcccgccccgattggctgagggctgcgcatgctccgaggcccgccgcggtccggcgtccgcccgcgccctcccctcaccccactccctcagcggttttcggagccggttcgaaagatgccggcggcggtgactggctgcggcgggcccgccccccgggttctccgcccccgccgccgccattacggagctcccagtggtgagtgtgcggagcgccgaggctcgcgttccgccgctgcttccgtcgccggggcgggcgccgcggtgtccctgccgagcgtgagccccgaactgtcaccgcgccgagccccagcctcatccgtcggtgtccgcggtccgagctttccccgcctcgctggcggcccgcgctctcccccgccgtgcgcgttcgccgctgtggcctgtagctacctcgcctcgctgctttgtctccgctgctcttgccgtccttcccgcggccttctgcgggcggggctgtcggctgtcgctttgctgctccgcgacggcggccttgagtctcgctcccccggtgggaaacgtagaactggttactcgccaccttaggcggtggggtttgaatgagagcggtgcctcggtaggtcgtcagaaagttacagtcgcccatctgagcgtttgtaagagatggaggcaggagtggtgaggtgagagccccagatctgagggttggtactgcattaacagctgtgaccggggacagccacttaacctttttgagaaagagttgtctcccgtacggagaccggaccgggtgaactgtgctgccgcatccgcgtgcacgttctctctgttgtttattgtgcttcctgactttgcattgcattaaaaagtgagaatccaattcgaaataacgtctaaaaatcgcctggggctttttgagcacgctgtcttgtcttagagtgaaattagaggtgactagtgtcatttttgaaaggtgctctaattttgtttaacctgacataggcaaaaaacttgttagctttttgatttttcattgctcttctcaaaagtttagtgtaatttgtttcaaaatagaagtaacattttaaagtttgctgggttggttggttttggctttgtttttaagcttgcttggaagattg

SEQ ID NO: 110 - DNA, 1205 bp, Homo sapiens
atttcacttgtagtaaagttgtgcttggaagattaaacatgagatatcaggcaccttaacttcctgtgctccctgcctaacattccaatctctttcttcttattctttattgaatactcacatcccactgcctgtctctagccaacatgaaatttttatgtctgttgatctgttttctgacagtcatgtaaagacactaatgaattaattttgtagtatttgtattttttatttttaaaattaatgggtattgtacaagaagaatgattagaaactgcttattacagttagcaaattcataaaccatcttaaacaggaggacctggatgcattctctagaccaaacagttttttgtggaaactggagtccagggaagtgcttcaggggccacatggatcccagtttaatgagaacagctccaatttctgtttctattaaattggcattccaaacaaatttttgttgctaaaattggttctacttcactgaagaagaaaaaaataaaagaaaaactattcttctagaatatttcctataattgacttgtggtcccttatgttacagcctacaattgatgaaaaaattcagctggtacctaaagcacagctaggcagctggggaaaaggcagcagtggtggagcaaaggcaagtgagactggtaagtgtgtgtgtcccttctcaaacctggctgtggcttgttagcatttgccttacagcgcattcccatagtcatcgaatgatggtttttgggaaagatgtgtagactaatcatgcctaaaattttattggtagccctttcctttcaacatagatcctttctcaggatccttaaataattttaagtatttttttaatttcaattcattcatttagactatttaattaagacctttatttatttatttatttatttatttatttatatatttttgagatgggatcccgctctgtcacccaggctggagtgtagtggcatgatcacaactcaccacagcctcaaccacctaggttcaagcaatcttcctgcctcagtctcctgagtagctgggactacaggtgcacgccatcacacctggctgatttttttttttttttttaattttttgtagagatggagtctcactgtgttgcctaggctagtcttgcactcgtgggctgcagtgatcctcccaccttggcctcctgcgtgctgggattacagtta

SEQ ID NO: 111 - DNA, 1069 bp, Homo sapiens
agacttattgtccactcatagtacattctttactaaccataagtctacagcatcaaaactaaaatgagcagtagcaggattcgtataggcaagtgctctatatcctgatgaatatttttttttaattctaaaatttgaccctagtatagaggatctcaaaatatcttgtcttgtgccattcagttggtcctcagtatctagtgagccagtctgctgattatgtatagcccctacttggaaatttaaggcctaaatcattcccagcgtatcagaaaaccattgttttagcctaatggctctaagagtagcccaggagaagctgccatggatgagattggacttctgcgggttccaaagctggtgcttaccgtttcagctgatgtaacttttcagtaaaaatttttgttatcttttgtggcagggaatgctctggaacatgtattaagctttcttttgctttttcatgcagatcaaccaacccaaattgccaatgcgaactctggatcctcgaattttgcctcgaggaccagactttacaccagcctttgctgattttggaaggcagacacctggtggaagaggcgtacctgtaagtgcaagttccctacaactcacttagttagacactggcacagactccatgaaatcctacctcatggcaagacagcagcttttattcgttgattctagtcaagaagaagaagaagaggcaaagactatcctttccatactcatattaaagcagataaagaatacacttgagttctttttacttggcagaagctagtctgcattaatttggtcttgattttttttttccctattttttcaattgaggtgacctgcaaataggtttaaaaatagtgccaaccatggccagggatggtggctcaggtctgtaatgctagcactttgtggggtcaaggcaggaggatcacttgaggtcaggagttcaaggtcagcctgacaacaaagagagaccctgtctctaccacaaaaaaaaaaaaaaaaagaaaagaaaaaaataggccaggcatgctggcgcatgcttatagtcctagtcccagct

SEQ ID NO: 112 - DNA, 1225 bp, Homo sapiens
aaaaaattataagcaatcggcttgtctgcagggaaacatctgtgctataatttccagcgttaatggatatagtagaaaagttggaaatgatttaaaaagatgaagtccatggaggtttattttggtaaataggatttatgtgttttgatttctctttaaacctgtttttaaagctattttattgaatacgttttcttcctctccacctgaagcaacaaatagcaagattcttttagaggtccattcttaatacaactatttggatgcctggtatttgtagagtacatactgtatgttagatgtaaattgatttatttgggaaagaccaccacacaaagttattattttccttatgaactgccacttgtatatttaagtcatttgtttctctgagaagaatattctaaagtttatgtgactttgtattctaaatttcagaagaattaggagcttagtcctagaatcaagaaattctgcttctgctatttattagttatctggatatactttttattttataggggtgagattgcttgtagaatctctctctgctaacatcctgttactggactttttggcaagtcctttttgttgtcatattttttccttacacactttctttgaactcttcctccatctccttactctgtggaaatttatgtaacactactttccttagaaatccttccacttcaacattgttagtgttcttatattctttatatcttggaaggcaactcagcaacctcctggcccttcaccgctttctgtaggttgtttgcctgcaacccttgtgccgaaaatgcataaacagctctctctccctcttttttttttttttttttgccatcattcctcatttttctggacccattttctcattgtttgagaattttagtgtctggctcataatttacttttctgttttgctttctgccatccacaaagatgacttgtgacattcattgttgtgctgtccaaccattgcctgtgggctcctggatctaccctgtttgttgttgttgttgttgttgtgttttttttttgagacagtctcactctgctgcacaggctggagtgcagtggtgtgatcttggctcactgcggcccacacctcctgggttcaagtgattctcctgcctcagccacccaaatagctgggattacaggcatgtgccacgctgcctggctaatttttgtatttttagtaggggtggagtttcac

SEQ ID NO: 113 - DNA, 1183 bp, Homo sapiens
gacatgtataatattgtcttgagtttagtcaggcaaatgggtatatatgtcttttcagatttattgtagtggacgggagcatgctgattgctgggagagaaatgagaagacaagcttgattcaggactgtttttataagggatcaaatgaaaaaatttacttaaaagtcacaaactataaaatgtagtgtacaaaggctagctatctttatagaactaagaactgtgaatttcagtgactcagcaatcaataaaaagtcaataacacacacatcttgtagatgatggtcattttaaattttctcaatgaatagtaaagagagattaacttagttatatttaaagcaaatagaatcaattaagtataaagaatgaatattataaattgatatatagaacgactattagaaaataaaaatgttgggctgggtgaggtggctcttgcttataatcccagcactttgggaggctgaggtgggcagttcacttgcgctcaggagtttcagaccagtctgggcaatgtggggaaaccccatctctacaaaaattagccgggtatggcggcgtgggcctctcgtctcacctgattgggaggctaaagtgggagcatcccctgagtccagaaggtcaaggctgcagtgagccatgcttgtgccactgcactccagctttggcggcagagtgagaccctgtctccaaaaaaaaaaaaaagaaaagaaaagaaatttgttataatttactcactaaaccaacaaactttttttctcagtgcatacatttatttacgtttttttccctctaatgtctagtcatgcttataatgtaacacgaagggctaagtctgatttccaagcttttcatcagttgatggacccttttctctgtgaagaatgatgaactctcaagctatctaaattctgtctcccttgtgtgtgtgttctctgtaaagtagtttgtttcatagaaaacccctaagtaggtgacatattgcagaaaccatgttgccaacattttgttatacttttcatgtaaaacatatttccatttctcttcactgccagtgtttctccagtttcaagtactacactatattattcaaaattctgtttattactccacatcttactactcttaatcaccatgaaaattgcccatcttcttttatagttcagtttcaaattttc

SEQ ID NO: 114 - DNA, 1217 bp, Homo sapiens
gcctcagcctcctgcgtagctgggactacaggcacatgccaccacacccaggtaatttaaaaaatatttttagtagagatggggttttgccatgttggccagcctggtcccaaactcctggcctcaagtgatttgcccacctcggcctcccaaagtgtataaataaaaatttttgaaaaatattttgtatgtttaataatttgttcattataatgaaatttattttgtgctacagaagaaataaatgtatcttactgtacattatagacataacgttagtaaatggaattccctgtagttgcacacctccttggttaactgtttgaagtctttctccagactttctatgcccattacagcattttaaattttaactaaaatgttgtatactgttttatagtattctttcttagttatccttttatagttttctttcttttccttttcccctttcctttcctttccttctctttctccttcttctccttcttcctttcctttgctctcctttctctttctttctttgtctctctttctctctcccctcccctcctctcctttatttttttcctttctttcttgacgaattctcactttgtcgcccaggcttgagtacagtggcgcaatatcggctcactgcaacctctgcctcccaggttcaagttattctccagcctcaacctccctagtagctgggattacaggcacccaccaccacacctagctaatttttgtatttttagtagagacagggtttcatcatgttggtcaggctggtcttgaactcctaacctcaagtgatctgcctgtctcggcctcccagagtgctgggattacaggcatgagccaccacatttggcctattttttctttttaatgtaatttctttagtaacagttttatgtttcagtaatagatatctatttccattttttggaaatgactagaattacttatggatgctgcttaatttatttttatgcaattctttctaatctacttgagttatttctgtttttcttatattatgaaccatgctgcactcaacatttttatacagcttcttttacttgaatggatatttttggggataaattatagaagcagatcaaaatgtatgaagggaagtatgtcagagtatgaagtgggtaaaaaggttgtggaaattaagtgttagctattatgagttttaaatggtttggttcctgattccattt

SEQ ID NO: 115 - DNA, 1155 bp, Homo sapiens
tcagttcataagggcaccagtgtgaaattagttcatgataaggacaattgtgagaaacctccagttggtcaaatagccttcggaaacttactgctcattattctttctgatttttcttggaatattttgagagaaaagtcattattcccttgtatttcagaatcacgttaatgaggtagcttaactgctattcagctgcaggctcaactgagtgaaaaaggacaactagtaatggtaaactgaaggaaagactagtggaatcttgagaaagaataagagaaaaaagagaaatgttattgttttgatattacagattaagctaaccacagtacctgattcttagcaggtgcacaataattatttagtcaataattaatggagcaaatatttattaagtaacattgtatgtctgtgctgtctattgaagaatatacaaaagaaacctgaggctgggtgtggtggctcacacctgtaatcccagcactttgggaggctagacagaaggagcacttgagcctaggagtaggaagaccaacctgggcaacatagggaaaccctgtctctaccaaaaaaaaaattagccaggtgtagtggtgagcaggagggtcactctagcccaggaggttgaagctgcagtgagttgtgatcataccactgcactccagcctgggtaagaaagagagcaagatcttctcttaaaaaaaaacaaacaaaaaaaaactacaagaaaaaaacagtactctcaaatggaggtacgagatcagaaccttgaaagtcagtgaggactaggggaataggaagtagtatttgggctgacttgaagttgaggggaaggacatctacagttgagggaaatggtatgggcagagtcgtggtcagtggttaggaaatggtgtatggtgtatatggggtagtccgaagatccactgggataaaatagaaagcagcaaatgtgcatctgacaattttggagaacctttggatatctaactgtataatttattattcatttattattattttttgagatagggtcttgctttgttgcctaggctggagtgcagtggtacgatcatggctcactgcagcctcgacctctcaggctcacgcagtacttctgcctcaacctcccaagcagtagggaccacaggtggt

SEQ ID NO: 116 - DNA, 1148 bp, Homo sapiens
ttaagtttctgaattgtgctaccacgtaaattactcattacctgcatctttgagctgttttggcaattgaacagaaataaaaggaaacctgtagtaggtgtccttgatgtacagagtagtaaggaccacagtgctgaatgtgacactgtttggtgaattgggtggctttttgggatacagctgtgtttcaagtatgctttttctcagtgcatttcatagaaggacttataaaagctctgagttggttgcaacattcaagtagttacaaaagctgaaacttaattttcttttgaataaaaagcacttgttaaagagataaatttaagtgtaagttccagtgtagataattttaaaccaattttagtcatatggaacacttacttttgtgtggctttaagtttttactttgcctcatgccattgaagctaaaattaatcttcctcttgatgtgtttcacagctcttattgttttctctttgcttttacacactgaaaggttacaattgctaaaatagaaaattttattatataaacagtaaaggaagtataggttgtagatttcatcagacataccagtggtgaagtgttatcaactggtaatggggtattgattaaaaaaggattgaaatagagcagttctacttttctaccctgagggagtatgggaatttgtatttgacgcaagtggtcattgttcaataagtggataacatttaagcatcttggcaggagtgcatagctggagttagcactgttcatggcttgaatagatctccagaccctcaaagtatgtgggtatagttgtgtttgcattgaattaataagttcagacagttttatttatttatttttgagacagagtcttgctttgtcgcccaggctggagtgcagtggtgtaatctcggctcactgcaacctacgccggctggattccagccattctcatgcctcagcctcctgagtagctgggattacaggcgtgtgccaccaggtccaggtaattttttgtaaggcgtgatcagactgggtttcaccatgttgaccaggctggtctcgaactcctggcttcaggtgatccgcctgcctcagcctcccaaagtgctgggattacaggcattgagccaccgcacctggccctgatctggtga

SEQ ID NO: 117 - DNA, 1178 bp, Homo sapiens
gggcatcctttttacagcacctttaggtagtcatggccatcatgacatttcccctctaaaaataaagacagtgtcctacctaatactaataatgtgctcataaataagaaaactaacgaaaactccctaatgtcctctaatacccatactcagatatgtcttgaacagttttttcctctcaaatcagtatgtaattaggatatgtgttgtttgtatcactttagacttagaatttggaacagttactctgtctccgcacccgctttctttcccttcttcttctctttttgagacagagtttcgctcttgttgcccaggctggagtgcagtggcgcaatctcggctcaccgcagcctccgcctcccaggttcaagcagttctcctgccttggccccctagtagctgggattacaggcatgagccaccatgcccggctaattttgcatttttagtagagaggggggtttctccattttagtcaggctggtctcgaactcctgacctcaggtgatctgcccacttcggcctcccagagtgttgggattacaggcgtgagccaccatgccaggctctttgccttcttgacattgaacttggaccagtttgatttcttttagattgttccatgttctgtatttggctgattgcttctttatgttacttattttaatttatttatatatcccctatattccaatttctgtaaattgaaaggtgggcgtaaatgtttgattacattccagtataacatttttgcaagaatattttatgagtgagtctgtatattttgccattaggacaagtggtaaagtcttgtttttagtcaaactaagtttgatttttttttattaatgttccatattttatttttaaattcacaacagtttatacttagtttccatgtcattctcaagaagagaagaaaatgtttaaaattcaggttgttcatgaactaagttttgtaatcctcaagattttcagtttattatgtttttctgatgtaaggtcttttttataaaagagacagagtctcactctgtcagcagactggagtccagtggtgcgattgtagctcactgcagcctggaaccactgggctcaaatgatcctcctgcctcagcctccaagtagctgggactacaggctcatgccaccacgcctggctaatttttggttga

SEQ ID NO: 118 - DNA, 1126 bp, Homo sapiens
ctccgcctcccgggttcaagcgagccttctgcctcagtctctggagtaggtgggactacaggcgcgtgccaccatgcctggcacatttttgaatttttagtagagaacggggtttcaccatattagccaggctggtctcaaactcctgacctcaagtgatccgcctgcctcgacctcccaaaatgctgggattacaggcatgagctaccacaccccgcccggtctgtcctgtttactgctgccaaagtgtgtccctggcctaaaatcacagcagatgtctgcttagtacgtcataaccaaaccttttggaacctatcctctgcctaacacgttggtgttctcatacagtgcagtcttggaacaaagtacccattaaattatctgaattccttatcgtactatggcattgccattgtgctgttattactcaagtttggtggacctgtgcccagaagtagaattattgaaacaaaaacattgttgtcatttaacatttttgagatgttttctttagttatttttcctgcagggttatatgatattttgatttataagaaatatatgcttagtctttgtactacttctggcacagctcctaaaacctttgggatctctgaagtgactaagtgtctttttgtatgctaatgaaatgactgatggctgggagctcttggtagcctccacatgggctggttgccaggagaaccaaccacgatgagaggtttagaactttttagtctgacctctgggaggggagaggactaaaggttgctaatctccagtggccagtgattcaatcagtcatgcctatgtaatcaagtctttttttttttttttttttgagacggagtgccactctgtcacccaggctggtgtggggtggcacaatcacgatctcggctcactgcaacctccgcctcccgggttcaagcagttctctgcctcagcctccagagtagctgggattacaagcacctgccaccatacctggctaagttttgtatttttagtagagtcagggtttcaccatcttggccaggttggtcttgaactcctgacctcataatccaccagcctcggcctcccactgcgcccaggcttttttttttttttggagacagggtct

SEQ ID NO: 119 - DNA, 1175 bp, Homo sapiens
caggatcaggaggccaagccgcagactgcacctgccttgagaccaggagccccatctcatctcacctcctagccggctattgaccctttgccctctgtccccagcacttggggtcacccccacggtccggatcgagtcatcgtcttcgcaagtggccgaggggcagaccctggacctgaactgcctcgttgctggtcaggcccatgcccaggtcacgtggcacaagcgcgggggcagcctcccggcccggcaccaggtaggaggcaggagctcaggaagcctgaaggaccctgtagctgcagtacaagagcataggcttgaccgggcgcagtggctcacgcctgtaatcccggcactttgggaggccaaggcaggaagatcacgaggtcaggagtttgagaccagcctgaccaacataatgaaaccccatctctactgaaaatccacaaattagccgggcgtggtggtgcgcgcctgtaatcccagctactcgggaggctgaggcaggagaatcgcctgaacccaggaggcggaggttgcagtgagccgagatcgtgccgttgcactccagcctgggcgacagagcaagactccgtctcaaaaaaaaaaaaccacaggctttgaactcaggcatgttcgagttcagacactgttccgctacttgcatgctgtgtgactttaggccagtcacttgtcacttgattctctgaccctcagtgtcctatgattttatgtacctctaagaaaaagcttccatttgtaaggttattcattgtagatgcatcttgattttggagacactgaaatgtgtgtctagaattgatgggatgtggtgtgagtgtgtacccagctcactggggctcctctggtctaccaccccgctgctggacaagagtcccccttccccatgtgaaggacagggacagtgatccagagctgatggccaggccttgggggtcagagtgaggggccaaatgggctcatgctgcctacctcatctcccctgtagcatgtcaacaaacactggtccccacttttctctggtgccaagtctcagtcgtccctggcatgggtgaggtgggacgctagacccagtcctgacactggggcggtagataggaagggagaaggtggttttccctggaagagtttccatcgagttccagctggctggg

SEQ ID NO: 120 - DNA, 1132 bp, Homo sapiens
tagttaattttgagtaattgtattgtcagaaaagtgattagtactatttttttttgttgtttcaaaaaaaaaatttttgtgtgtgtgtgttttttttttttttttttttgttgtttaaaagcaaggcatgcttgtggatgactctgtaacagactaattggaattgttgaagctgctccctggttccactctggagagtaatctgggacatcttagtgttttgttttgtttttttccctcctcttttttttgggggggagtgtgtgtggggtttgttttttagtcttgtttttttaattcattaaccagtggttagcccttaaggggaggaggacggattgattccacattccacttcctagatctagtttagaaaacatgttccccatctggtgctcttaggaaggagtatagtaaatgcctcatttaataacatactcctttttgaaagttgccttttctctccacccttgagtagatccagtatttgatgaaactcatgaaagtgggtggagcccatcttgcccctcctcttttctaggacgcactatatgtgactgtgactttcaaggacatttgtttgccatttgctgatttttttgggaagttaatttctaacttctttcactgataaatgaagaaaagtattgcacctttgaaatgcaccaaatgaattgagtttgtaattaaaaaaatttttttccctttcagtcattgtcttatatgcttagcatagatttgcagctcagtagtatatggtgttcctagaatgcagctgaagacctgttatgtagaggaaatacgaggggtggtgctagaagacagacatctgtggaatgattcacatcctctcaagttaggaggatggaggcctgcttcattaagaagctgggggtagggtgggggtggggagaacacttaacaacatggggaccagtcaggggaatccccttatttctgttttgcatatgaggaaccctagagcagccaggtgaggctctctagtttaataaaaatcatggaaagactcttaatgcagactcttcttaagtgttaatagggattttttcagcttattttggttgcagtttccaatttttaaaaatgttgaggtaatctttcccaccttccc

SEQ ID NO: 121 - DNA, 1168 bp, Homo sapiens
gtccaagaaggggatgggggaggaggcccaggttgcaggaggtgctggaaggaaggaggaggagagatgggagaagagagatccagcaagcaaattctagtgtcacctaaacctgatgagaccaggagcttggaatgccattctccacatgcccagtatatacttccctcactcttaaggaaagagccagtgttctggccagtgactaccgtcagcatccctgatagcccttcccagtccatatagcacttctccatacagtgtttcacttgggcctccagcaaccgtaatggtggaagtgtgaggtcaggaagcctgtgtagagtggaggctttagaattagaactgggtccagtcctggccctgcggtatcttcatctctactttacagatgaggttgagaggtttatgaacttgcttcagattcctcaggctgccagcaatgaggaatgagaccccaggtcttctgatgcctagaaagaggcttcatgaggaaagaagggagaagcaagcatctatagagctctggttaggtgctggttaaagtcctgcttaggaatctgcttgtttctgtgtacttacgatctgtttgttttctttcaatttcctagtaaaagatgtttttgaaaaatacctccctgtttggctgaactgaagggaaaaggactcgtcaactcatctataccttggttcaggcgagatgctctagagccaggtgtgggagcagcccaaaaggggtttggactggattgtcagccccttcctgctgcaggcaggcacctgacagccaatctgacaggcctggagctgggcctgaagttcttctgccacgccagccagggaaaggggtggggggagggctgctgtttccagctatggctttgtcagctctagcaatgtgactccaggcttcctcatcccctgccttaaagagaaaactgtagagcgatgtgtaattctccagcagagtgacagagttcagcttagcccagccagagacagatttcatgctcctgtatggggaggaggggtaggctcaaggctctgaagccctctggccaggaagcaccaagggtaggtctacgccagtagtggagtgagggaagtggagggtctgtgggactgaggaggggctctgataacatattccatcctgaccagcaggctg

SEQ ID NO: 122 - DNA, 1173 bp, Homo sapiens
atcctttctaggtgccatcagagaaggaagggtatgctggtggagcatgcacacaaatgatttaatacattgtagtgcatgttgggatagagcaaaggagggcagattcaaggaagacttccaggagacgagtcctgaactcaatctcttaattcattcaactaagatttaatgtaggagatctagattctgtgggggttcagatgaggtagggattacttctgttttatatgaggtaggatgacaatgggggtaggtggtagtagaaattagaatatttctttgggatgatacttgaagtaagccaggattttagatacagaggtatatgagaagggtgtgttctaagatgataaagcagaaggaactaaaatacagaagtcaaatggcacgacgtataccagctgtatttactgaaatatgcctagaggtgctgtgttaagcctcaggtacacaaaaacataaaacatgaccctgccttcataattagaactcaagtgagatgtttgaagtgtaatacaatgtgatttgtatgaaaaatcacattgtgtgtgtggtaggaggtatagattagtttttaagaaggcgtaattttcttgactggtggttggttctgtttggtttgactcatgggtgcctgaaataaaaggagtaggaaatacagatgtaaaggtaagttgggctgttatttactgttgtttactttggcagaaatggtctaaaaaactaagcatgtgacgagtaatgagaggggagcagcaggagtctgagtttgggttccttttcttccattagttcctgtgtgactctcccttgtgatcattgatctttactggaggtacagagtacctggtctggtcctcagttttaagaaaatgaattacctagtatactccaaggcccaacttctgtaccccatagttggaaattgtcagctttcctacaaagattgatttatgagctgctctttaaagcaacttcttataacattttcaaccttttgactgttcacaattaagagtccttcaatcttttcccatcccaatagatgaaatggcaagacaaaatttccatgagttatattggacaggtttctatgcattacctgttgttgcataacaaattacccccctaaaacttagcagcttaaaacaaacatttattatcctctac

SEQ ID NO: 123 - DNA, 1142 bp, Homo sapiens
acgcacacactttaaaatgtaactggatttgctatataggccagagaaatatggctgttacgatgaaggcgtaacttctctggttcttgattatttacaccattagagaagaatgcaaatatgaatagctcagagtagtttaactttgaagtgagagtttatatgcacctttatatgtgggataactgatgtctttggaatagacttcaaatgaatgataaaaacacctgtaaagtgataggacctctactttttctcatgtccaatgttcagtttcttataaaccaggcatgaagagaaacaaaaagtaattaattctccagatcatgaagttgtcttcaacctaagcacagaggtataataattacatttctcagaagttccccctctgttttgagtctcaagggcaattgagatgtcagtgaggctgtgattaaatgtattggatattagaggattttaaatacaaacaagtattataggtgttaccactgaccccgaaggtaagatttactgtgaaaatttataatgcaaggaagaatgatcaagttggctgtcagaacaacaaaatattacaaaccaggatgtctaagagcagaagtccgtggttgccacctctcaagcctcttagcttaatccaatctaggatgcatttccactctgcaacaaacagtatttatttttgccttatttgcagataacagttttaatgcaggtactgcccatggattagctttgagcagtgtctttttgctttggtttttttatttgtttggtttgttttgagactgagtctcagtcctccaggctggagtgcagtggtgtgactttggctcactgcaacctctgcctcccgggttcaagcgagtctcctgcctcagcctcccaagtagctgagtctacaggcgtgagccaccatccccggccaagcagtatctttttgctttgaaagtgacttacatgtacatttgttttccttgtgaatgtttctttttaactgcaaactaagaaacattgagcccagcattcatatatttgcaaactctgtcttacttaatttctcagtttttttcctcagaaaaaatgaaattccttttcttttttaaatttattttttctttatttttctttataaagtgaag

SEQ ID NO: 124 - DNA, 1167 bp, Homo sapiens
cagattactacggctatgaagattactatgatgattactatggttatgattatcacgactatcgtggaggctatgaagatccctactacggctatgatgatggctatgcagtaagaggaagaggaggaggaaggggagggcgaggtgctccaccaccaccaagggggaggggagcaccacctccaagaggtagagctggctattcacagaggggggcacctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaactatggttacaataatgacaaccaggaattttatcaggatacttatgggcaacagtggaagtagacaagtaagggcttgaaaatgatactggcaagatacgattggctctagatctacattcttcaaaaaaaaaaattggcttaactgtttcatctttaagtagcattttgctgccatttgtattgggctgaagaaatcactattgtgtatatactcaagtctttttatttttcctcttttcataaatgctcttggacattattgggcttgcagagttcccttattctggggattacaatgcttttatcgtttcaggcttcattttagcttcaaaacaagctgggcacactgttaaatcatgattttgcagaacctttggttttggacagtttcatttttttggatttgggatagattacataggagtatggagtatgctgtaaataaaaatacaagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaagatttcaataaaact

SEQ ID NO: 125 - DNA, 1220 bp, Homo sapiens
ttctgactgcagcaaagtggatgctcagataaacaaatgcatttcagtttatctttggtgttcaggagggaaagccttttgacactttttggagagtggaaagaattacttagtaaaatttgttttcagattttcctccacctcttaggtggttagcatcaactgtaaccgtctgtaatttgaaggtttatccttggaaaacgcaatgtattcttatcactctaatataaaccaaaatttgttgtattaatgcataatctgtaatacagtatgtacatcagatttaactttcaagacttatacctttgggggagtgggaaatggatgttaggatttggcgggggaggtttgtggatatggagattgaaattcatgtttttggttgttgacattttatctttattttcatatttgtcctggacctttctatgtagtatttggatagctgcgtatatgcatatagttaaatgaaaatacagtttgttagtgatcatattgaatgtaacaattcttgattaaacgtcagtagagcttagattaccccttttgttgcaataacgttacccctttcaatttaatttttaggattggtagcttatgtcgatcttgatgaaagagcaattgatgctctcagggaatttaatgaagaaggagctctgtctgtactacagcagttcaaggaaagtgacttatcacatgttcaggtaaggtcgttactcagaaatgtctttgaacaattagtaatctgaaattattttactattactttttttcctatggagaagtggtattttttgtttgtgactacctcttcttttaaaaaattagtttaaaggaaaaaaactgcttgtggcagagtttcagaagcccaagtataaagcaaaagttttctcccacccccttgtgcagtaagttattttaaaaacttaaaattaaagccaagttttgatggttgttactataggtttttacatgttactcagctttttaacatttgggggttatttgatcctgttttattatcttggaggaaaatgtaggtgggaggaatagtttccgacatctggcaaagacagtctagatacagtcacatatcaacaagtggaagactgtgttttcccagggtagaaggtaagctccctgaggtctatactgccttactgctgtctgctccaatctctggcacatagtaaccactcggcaaatacttgttgaatgaa

SEQ ID NO: 126 - DNA, 1199 bp, Homo sapiens
tgcattcagctggagttcctcggaacgggaggactcgcagctctccctttccccagccaggatgagggaattagacaatggaagtcgagcactggggaaagcaggcattctgcgtggggaagagctcccagctcgctgtagccttggagagggaagtgatggaaaaagaatatagcagcttattagggactcccaccctcttcaagttataaatatccccagaaccttggctacgtgcccggaagcctgttgtctctaactgtacaggagacttctctgcctgggctgggaaaggggcctttcttttgttttgcagatagatccacccactgaggaacttgaaaatttttttcaaacataactccaggccttgcttttattagtgagtgtcctgttcccagtgcccggttatttatgattaaattactgaagtgtctaaaaagaacagaaggacccaccccagccataatgcagactttcccattccttctctttccacccgcaactgtggggctaagaattcttaagatgtcacagaattataccatcctacctcatctaaagtcgatccgaggctggtccgatggtagtgggttaccagaacttaataacattaataactctaaagttagtatacaaccccccactgctaaatttggctataaaaataaaattgatctgagcaccatataaaatggaatcctggagggtcccctagaggcagtatccccagtggaaagagcgtgggcctcaaggtcagacaagcctggtttggaatccaggctgtgtatcctttggaaagtcattgaatccaggcccatttccttttctctaaaatgagggtcatcatacctaaggatgttgtgaggcgtgagtgagatgattaaagcgttccagagagtgcgctcttggatgatagccgttactttttattaaccctggctttggtggtaagggaaacttccagaaatgcttgtgggtatattggatagctcagaaaatctgggaaatcaaagtggctcaatagctgtgaggaactgtgggtgactttatcctcacatcgtgtttcttccagaaattcagacgcaacagaggttaggccagtttggtgggttccagtgagcggtgtgttgagcctagtagagcataggtacttggggttgccaaaaccccagcaagttgaggcttcacgctcaggg

SEQ ID NO: 127 - DNA, 1201 bp, Homo sapiens
agcgggggcagatggggtgaatggagggttctgaggcaggggggtccgggccttttcctggtcccggggacttgagacttgctcggtgctaggaaaccttagtcggttgctccgcttagggaaggtgccagcctttagacagcttccgaataggatgctggacgtcgcataaccacgtgtttcctgttaactgagcaattaagttctgtttcttcgctcactccccttagttggccttacaatgggggcgctctttgttaccctgagcctcttagggttcgatctcagtgtccgtatcttttaacactcaataactgtcctgagttttctcttcacccgttccgttcgtggaggaaggataggttccgagctgtcttcttcccttgatgtcccctaaacattataccttttaaacattcagggtcttcgttacgatttgggatgagcagaaataaaaatgctgtgcagatagaaagtagtaaaactcagggccctcagctgtgagtgtattgactgctgctcttccctgttgcagcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaaggtgagtagtcacaaggacatacagggtttgcctgcttgggtcgcttggttgtttcttgatttacctgctgtcgagtctgtttagaaagtgacagtcggcatcacttaaagcattaaattcatgagccggccaagaggtgtcttttttttttttttttattcaagatggcgtgtgggattggaacactagattttatttgagcagatcttaagctaagactagcccaagtaaagattttcctaagtaactaggatatgagatagagtggaaatgtcaggaacgaagtaaagatcattagatctgattagcagttagggttatataggctgcattaagaacagggctgtacgggagcatgaggcttcagtggcctatattagtgccactgcactccagcctggttgaccctatctcaaaagttgtatacagattgcctgggtttgagtgatggcttcaccatttgctggtctgactctgggctctctggacctctgcttttttctttgcataaagag

SEQ ID NO: 128 - DNA, 1142 bp, Homo sapiens
gcgagactccgtctcaaaaaaaaaaaaagaaaaaaaagaacaagaccctgtctcaactcaaaaaataagaataataatagtaataaaaagagttgtgaggaaacaagaggaattggcaaaggagaaagagggaccggtaaagtaggagataaaccaagtgcctggtaacctggaagtaaagtcagggtgtgtgaaggaggagggatgatgaactgaggtgagtgctcccaaagagtccggtaaaacgaggactttgaattaggcattggacttcacagcatgaaggcctctcgtggcctctctggagcagtgctgccagggtgatgggccagaaagcctgagtatagtgggcttcagagagaaggtgaggagagtgactggggacaactggtagacaatgcttccaaggagttctgctgtcaaggggaacaaaagtgggaaaaaaactttctatgactgagaaaatccagtagagagaaaaattgatgtgggagaagggagacctgcagtagcaatatccttgagtgggtgagaagggttggcttgtagcacacagagggggtttagacttggatagaagcgtggctggggtgttggtgataagttgggagcctgcctgtgtgagtgcacatgttggctggtggtagatacgggatggagttctgtggatgtgcccggccgcctctcaggcctcttaatgctgaagtaccctaagattcagtcctgggttcagttctcttcagttctcttcgcattgctttcattttctcagtgaagtagaaataaaggtagggatgagtcactgggagagtcctgcgccatgtgtggggaactctacctgagggcaggaccctcaatgcagcctctatgggtaaagaaataggtttgagaggtaaagagccatgcgcaggatcacacagctggttagtagcagagccaagcctaacccagatggcctggtttcctgcctagcatctgacagatccataagagacaaatcatttcaccatcttgacaaggttgaactctcatggctcttcctagtagtgtctcaatctgcaggtctgttctgatacagagatgtcctgcaagcagctctttcctctctgtctgtgctttctgggttctgccttgcctgcctt

SEQ ID NO: 129 - DNA, 1099 bp, Homo sapiens
ctgccttgcgagattcaagctgtgttgtaagactgctggattcaaatctcagttctgcctccaattagctgtgtggcctttgactagtcatgaaccttctgtgccatagtttcctcacaagtaaaatgggcttagtaattgtttctatcccacagggttgaagtgagaatcaaattatttagctcacgtgatacatttaagtgcttagcatattaatatgcttaattaatattagctaagtcagaaattcttgagtttccattcctgttttgccacccattgggcaaatttcttaacttctttatgcctcagtttccaattgtgaatgaacaatgttgatgatagcatcaaccctgtagggttttaaggatttgggataataggatgtcagtatctcactgaagaaactgtccctggccgtagttcctggctccattgcagagttggtaataccagtctctgaattttcttcctgagagtggatcccattaaatctctagccaaggaggagcgtacttctgtgcttctagggctagacagaacggaagatggtgcagcagccccagcgtgggaggccggggctgtagtggggatgtggtgaaagacgtagggctctctctgttgctctcagctgcagccacgtgttgccccatggagactgggccaggagctgctggatcttactgtttctcaagagaagttgtgaaatctcctcattttaaactcttggcaattatttcatttttgtaaacattgggagagcaaacaaaacatgtcggtaggctgtatttagcccacaagctgccagtttgctatctatgttctaggctttctgtgcttgacttagcaaaatatttactaagcgcctgctgtacctgtagctcctcagtacctggtcatgtttactgttctgccacctcaggcgtgctggctcagtcatcctatcaggtactaaatcagtttagtgggcttgaaatggtgtttcaattcaaattaaaatgcaatttgcatttccctgattactgctgagattgaacatttaaaaaaaatacatctatagaactttcttctccctcagtagaatttttgttttaagtct

SEQ ID NO: 130 - DNA, 1161 bp, Homo sapiens
cttacatttcctctaacactgcaggctccattggaactccagcccctttacacctgctgtcacctcaactggagtatccttccactcacttatcatctggcaaattccttcctcctcctccttcaagatctaggtcagatggtccctttctgaaaccttctgtggctctcccggcagagttaggcctcccttctttgtagatattcattaactcacatatttggttagctaccaaaaaatcgtccttgccctagaggagttcataggctagtggggtagacaaacctaaacatttagacagccatgctgactgcattagggaagcactgaggaggagcacttcacctgccttgggggacagatgacagggaaggttccagaaggtggggacacctgaatcctaagagtgtgtgggtatccagataaggaactggcttgggcaaaggcacagaggcaacaaataatgttgcaggtgcacaacaatgacaagcagttggttttgctggaacataggggcctgaaaatgtaggactttctattatattgacccatatgaaactgcttttttttttttgagatcaagtctcactctgtcacccaggctggagtgcagtggcatgatctcagctcactgcaacctccgcctcccaagttcaagtgattttcctgcctcagcctcccatctagctgggactacaggcatgcaccatcatgcctagctaatttttgtatttttatttttatggagacggagtttcaccatgttggccaagctggtcatgaactcctgacctcagatgacccacccgcctcagcctcccaaagtgctgggattacaggtgtgagccaccgcgctggacctaaaactgccatttttttttttccccgagacggagttttcactcttgttgcccaggctgaagtgcagtggcatgatctcagctcactgcaacctccacctcccaggttcaagcgattctcctgcctcagcctcccaagtagctgggattacaggcacccaccacacctggctaattttgtatttttagtagagacagggtttcaccatgttggccaggctggtctcgaactcctgtcctcaggtgatccgcctgccttagcctcccaaagtgctgggattacaggcgtgagccatcatgc

SEQ ID NO: 131 - DNA, 1194 bp, Homo sapiens
tactcttgggggaggggaaaacatctggctctatgcaaacagggctcatcaaaaatctttatgtgccaaaatggatactgacattgctatgaacaaatctgttttttcttccctccctgcctaaagactcctaataagggacattaaatcatacacaactgaatctaagatatgaaaaactagtttcaatgacaaagacttgaacacacagttaagagataaattcaaggtggtagacacctagaaaaagctattctaggcagcagacatctggcacctgacccaaatgttcatttggtttcagttaagaggcttcctaatattagatttgtggggcaggctagggataggggtggaatggtggtacaagtaaccaagagaagtaaagtaatgctttacccattcaaaaatatagcaaattaaaacatagtaacatttgtgtcctgtcacaataggcaccctgcacagcaatacacactgaacaatgtcgagtttctgctgaatagacttcctacgttgctctggaattcgaagttggcctaactgaggtctccagttacagaaaacactggctctgtatcctgggctttgagaaaacttatcaggctgtcacacttaccatcccttcagtctgcttgtcaggttccttaaggacgcatatctcaaatgtatggcatctacctctacctgggtcacaaccaagtgggtttctactagatcggtgttccttgacagccaacaagggagctgacactgccctcctaagttctgatcttgctcctgttcaactggaacttgatggatcccatgtggtttcccccatcctgacgctgtggctcagacactctccctaagctggtccttccctccaaatcctgccttaaacacactcagaaggtagaaaacacttcagcagcaaagtcctcttcccaagccaacagttgtgttcttccaatcacatgatcttaccttttcaataaaaggcaaaacaaaccaatttccaacatagcattacagcctttaaaaccattcacttctcatagtgattcacagagaacaagagattaaagtgctggattttaaatgtctaaagttgccttcagggctacaaaaagccctgccgtgtgtgtttttccttcatggtgttgaggggaaggaaagatagggaagggcagtggggagaaaccctaaaat

SEQ ID NO: 132 - DNA, 1202 bp, Homo sapiens
ttccttcctggccttagccacctggctctgtctgcagcaggggcaggctgctttcttatccatttccctggaggcgggcccccctggcagcagtattggaggggctacaggcagctggagaaaggggcccagccgctgacccactcactcaggacctcactcactagccccgctttgggccccctcctgtgacctcagggtttggcccatggggcccccccaggcccctgccccaactgattctgcccagataatcgtgtctcctgcctccactcagctgcttctcagtcatgaatgtggccatggccccggggtccccttgctgctgtgggctccctgtccctgggcaggagtgctggtgaggaggtggagccttttgaggggggccttccctcagctgtttccccacactggggggctgggccctgcctccccgttaccctccttccctgcaggcctggagcctgtagggctggactgaggttcaggtctccccccagctgtctcacccccactttgtccccactctagagcagggaggcagtgggggaggagttgtgtctcgtcttctgtctccatgtggtttttgggtgtttttcttgttgtgtcctggattccgataaaattaaagaaattgcttcctcaacgctcaggcctggctgattctattccaggggtggatagtgaccatctgtgagaacctgccccagtgtaagaaaacttgtttttatttttaaatactttggaaagctctttcagagcaatataaatgagtgcctgggaggaggaggttttgtgccagagccttgccccctcactcactcttgggggtcctgatgaactcttggaccctgtggaagataagagttagagacctcggcctcctggtcagtggagcccttggcctcatgcctggtgggctaagcgggcccagctggggtttgaggtaggggaggccttggcttggccccagcagctccagggccctgagttcctgccagaggctggagagcaggcagctgctgcttttcctggtccttggtaggggagggtcctcaggcttgcgtgccaaagcctgaaggattctgcttctgccagcgccagagatcctcacctgcaacacggcgaggtgtgtgctcagggcccacggtggaatgcagagcctcccccaccccacagcccgccctgggtgggcatgccca

SEQ ID NO: 133 - DNA, 1224 bp, Homo sapiens
ggtcttaagaccctcccataagagggtcccatcctataccctgaggtaaggaatgctgatgtcatgaagcctccgtgaaaatccacgaggacagggttcaggagcttctggatacttgaaaaagtggagcctcctgaagggtggcacaaccagggaggccatggaagctctgagccccttcccccataccttgccttacatgtcccttcttctgtatccctggcaatatcctatataataaaccagtaaatgtaagtgtttctctgaattctgtgagccgctccagcaaattaattgaactcaaagagggggtcatgggaacctcaacttgaagctggttggtcagaagttctggaggcctggacttatgactgatgtttgtatgtattgttgggggtaggggcagtcttggggactgagccctcaacctgtgggatctggcactgtcttagggtacatagtgttagagccgaattggagaacacccagctggtgtctgctgcttggtgtgtgtgggaaaaaaccgactcatttggtcacagaaatcttttgtgttgacgtggttgttgtggtatgagagtaggggaaaaacacagagttctcggggcgcgggggcgggggggctcacggctgtaatcccaccactttgggaggccgagatgggtggattacctgagttcaggagttagtgaccaccctggccaacgtggtgaaaccccatctctactaaaaatacaaacattagccgggcgtggtggcgggtgcctgtaatcccagctactcaggaggctgaggcaggagaatcgcttgaacccaggaggcagaggttgcagtaagctgagattgcaccaccgcactccagcctgggcaacaaaagcgaaactccatctcaaaaaacaaaaaacaaaagccacagagtttttcctacacagggtctttattttcaaatgggggctcctatgtagatgtaaacatctgtatgctttcctcctgttaatttgcattatgtcaatttaatttgcagacccagttggagaccctaagagggcagagaaaagtcgtgcccccctattcccttctcaggccaggttgcagtacttgtccattcactttacaattggcaaagaaaatcacaaggcacccacatagatcacctgggttccacgtatattcatcccaacccccattctattatttaatgatttatttatttatttattttga

SEQ ID NO: 134 - DNA, 1099 bp, Homo sapiens
ttctttttcctatggggctctggaaaacaatgacaacatttctgagatctacgctcctgccaccctgccagtcatgcaagaagagcacggctccagaagtgcctctggggtcccctaccgagtcctagagcacaccaagaaggaatgagactcgcctccctctatttataactgtcccctccaggctgacagtggttcaaccctgaatcctaaaacttgcctttcaagtctcattttgtttctaactgagaactctatggatgatgatctcaaaaagcctttgtctctgggaaaggatgcgttatcttggtcttggaaatttcaaatgatgagggttgggggatggaagcattattccaggtggacgggatagaatccagcctctgcctggattagcccagggggatttggaaagcctttctaccatccttgaggatggtaactgagcttcctctgacagtgaccaaaggatgctgtatccttcagagctaaggcaagacagagagtctgctgttaattctcaaatccagcgaaaggctggacatctctaaatctcgtcttcctccacctcatgtgcatgcctgatctcaccctgacactcctgatgccgcatctgtgatagcactcgtgttgccttcacatggcaggctgggccaaccctgggtggaaggttctgacatttgtgttttcagaaatgtacatctgccttccagtcatctgtgcccttctagggaagatgtgcttgatatgttcaaattggatctactctgaaaacgaaacttggttttggtcctgtgaggactacttgtttgtccacctcctccaccaaaggaattaggaagttaagagaaggggaagaatatggaggataggagagggtgatgatgctttagcccattaaggaagaaaagttccccttactcttacaaaaggtgattgcaccacttaaaaaaggataggtagaaaatctggccattttatgtgttatttttttcctgcataccagtgccccctggaaagatggggatgctcatttcagagacagcctcttcacctgtcctccgtctctccattacagagccacaagccaagcttgagt

SEQ ID NO: 135 - DNA, 1148 bp, Homo sapiens
ctgtagttttgcctgatctcactcattgcacttcctggagttaaattttccaacagccatgttgaggaatagcactctgcatgtttttgttttgtttttcggggttttttttaattgaagccctaaaccaggaattatttgtgttctaacaggaggatgaacttgctgaaaataaaactttgctatgtatttactcttttttaaaagacaaaagcaaaaccagactttctacgtactactccaaagactgtgattgtgactataatacatttttggtaatttttttatacctaatttgtataggaagtgctatttctcataggctgtttcttgaaattttaagtttattgctttaaaatggcagtgtttctcccactttgatatgctaacatttagtaagcactggctttatgaaagcggctttttataagtatactgcattttttgagcctatcattaattagcttagtatgaaagataagaaaatctccatgttgtatccatttggctcaggaagattctttgccttacctttcttagaactctttattgcttatcaaaagtttgagtacccgcttggtttttttttggtaattaaatattgtatgatttatctggttcaaggaagatgcactattcagttatctattgagaaattattttgcagtggttttagtgggtgaaaatgtcccatctgcaccagtacacaggcaggcattatcattcttcacctactttttaaatagtggcaacttgggattcattctggtgattctgaaccttgcctcatagcttaaagtataaaaaagattcaagagcagtgaggtttgttctttccagtgaatggtggactgagtggtgcgaggtggagggctaacaagaggaaagaactacattcttcagaatacagtgatgaaaattcattttgaaactcaaatattttcattttggatattctcctgtttttattaaaccagtgattacacctggccatccctctaaatgttctaggaaggcatgtctattgtgattttgatgaagacagaattatttttctctgtagaaacacagataccactttatcagggaagttagtcaaatgaaatggaaattggtaaatggacaaaagctagctagtaaaaaggacg

SEQ ID NO: 136 - DNA, 1251 bp, Homo sapiens
cttagaatgatcagtttctgttttgatacatttcgtaccaaaatttcttctacaactcatcaattattcttcgttgtttgtttcacaccattctcgaaatctcacatactcttttctcaaattcagggagtcatgtgatatttcttgttttattcacagagggctggtttttaagtttggccgcactgaagacttatggcagtgaacacatctgatttcccacagcacaacagccctgcatgggtttgtttgtttttttactgctcactcccaaccttttgtaatgccattttctaaacttatttctgagtgtagtctcagcttaaagttgtgtaatactaaaatcacgagaacacctaaacaacaaccaaaaatctattgtggtatgcacttgattaacttataaaatgttagaggaaactttcacatgaataatttttgtcaaattttatcatggtataatttgtaaaaataaaaagaaattacaaaagaaattatggatttgtcaatgtaagtatttgtcatatctgaggtccaaaaccacaatgaaagtgctctgaagatttaatgtgtttattcaaatgtggtctcttctgtgtcaaatgttaaatgaaatataaacattttttagtttttaaaatattccgtggtcaaaattcttcctcactataattggtatttacttttaccaaaaattctgtgaacatgtaatgtaactggcttttgagggtctcccaaggggtgagtggacgtgttggaagagagaagcaccatggtccagccaccaggctccctgtgtcccttccatgggaaggtcttccgctgtgcctctcattccaagggcaggaagatgtgactcagccatgacacgtggttctggtgggatgcacagtcactccacatccaccattgaaggaaaggaaaaaagggcagagacttgacactccagtcttagacaggggacaatttctttgtagttgttctgataataaactgggttccatgttgcatttcatctgtgtactgaaccactagcctaatagaccagcacggtcaactagaatgacaaacattagctactgggaactcttgttgtctcttcctcttcagaactcttgtccccccaggctccccacctctgcaagatgggatacactcttcaggaccacagtttgaaatgtctttcataaaatgtgctacaattagccttcggaatatttgctgggtgatttaaatgtgtgggtctcattt

SEQ ID NO: 137 - DNA, 2414 bp, Homo sapiens
ctccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaactagagtggttctaagtgcttttcctttgagtggcatgttgctcagctccgtccttccatggggtggctccctcttggggcagagttgagctggaatgctttcaggtactatcttacctatcgaaggcttgagtgacttgcccaaaataagttttacgatagaacaagtggtaggacttactgttttgagaatctggtgctc

SEQ ID NO: 138 - DNA, 1482 bp, Homo sapiens
agagaaccgagaggcacaaatggctgccaaactggaacgtttgcgagagaaggttggtttcttactttgtaaaagggttgagcttggagtttgatgcaccaatgagttggcttgaactaagtgctttgataaaaggtgtttggtgtctttttgtcatccattttggggcttaacatattaaatgaaaggtatattttaagatggaatattcagtaattcccagcataattgcacagtccttggaagtccagtaggcagcttgttaggttctacaagggacccaggagatttgatgatgatgtctcagaacttaaattgtgtggttcccacaggctgtaatatatgcactgaggttgtgttgggcctctttgaggtgggggctgggggtcgtgacttgacaggcttttttttttttttttttttttgactgatgacaccttacccttcctttacaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgttggtctttctaatgtagctatttttcttgttgcatcttttctacttcagtacacttggtgtactgggttaatggctagtactgtattggctctgtgaaaacatatttgtgaaaagagtatgtagtggcttcttttgaactgttagatgctgaatatctgttcacttttcaatcccaattctgtcccaatcttaccagatgctactggacttgaatggttaataaaactgcacagtgctgttggtggcagtgacttcttttgagttaggttaataaatcaagccatagagcccctcctggttgatacttgttccagatggggcctttggggctggtagaaatacccaacgcacaaatgaccgcacgttctctgccccgtttcttgccccagtgtggtttgcattgtctccttccacaatgactgctttgtttggatgcctcagcccaggtcagctgttactttctttcagatgtttatttgcaaacaaccattttttgttctgtgtcccttttaaaaggcagattaaaagcacaagcgtgtttctagagaacagttgagagagaatctcaagattctacttggtggtttgcttgctctacgttacaggtggggcatgtcctcatcctttcctgccataaaagctatgacacgagaatcagaatattaataaaactttatgtactgctgtagcaactcctgtgaaatgactaaagggaaccttaattatttctaaagtagcatttgactc

SEQ ID NO: 139 - DNA, 1115 bp, Homo sapiens
tgtcctagaaaagttgtgtggacgactgctttaattttcatttttagcactctaaagtttgggaagtaattaagaaccacctcaaaatctgcagttttttgttcttgtttcttataggctgaaggggatgctaagggagataaagcaaaggtgaaggacgaagtaagtcattctctcttcaagggtcaaagccttggactagcagaggccactggactcggtgattaaccgtaacctgtgtcctgaatttacactcctataatctagagcaaattgataccaaactttcaaagcgacttacctgtcctatttctaactttctcgttgtctttaatagccacagagaagatccgcgaggttgtctgctgtaagtgtatgcttttgaattttcgtgcttgtccctgaaactaaaaaacatcaaaaaacaattccctttgcttccatgaattatggttagtgcctggttttgaatcattgcctctacttgggactcttgcccctttgggttttgctggttctgaaattctgatgcctgtagccaaagtgggacatttgagtgggcttctggaaatccaacattctagaagaaagccaaccacaaaaacttttgaggaggaggagaaacttctctacccttggtacttttggttggttgtgggtggttttcttcagtccattgtactgatgttcactttttcctctcttcctgccaaaaaaagaaacctgctcctccaaagccagagcccaagcctaaaaaggcccctgcaaaggtaagtgctaacattggaactgatcattttcacagaatgaggactgtccttagtgccttaacttaattagcataatggtgcctccattaatggaggttataaactgtgtggatagcttacctcgtccgtgtcattcataacgttggtttcctgatcaagaattctgttgttagtttataggaaaatctgcatttaaatattaaataccccagggtttaaactaatttattcttctgttacttaggaaattctaagtactaaagattatagcaaattacagataatttagcctagttttgatcagttgttcttgtcaaatgggtgagggtttgtgttttatcttga

SEQ ID NO: 140 - DNA, 1143 bp, Homo sapiens
aagcgattctcctgcctcagcctcccgtgtagctgggattacaggcatgtgccaccacgtccggctaattttgtatttttttttctttttttttgagacggagtcttgctgtgtcgcccaggctggagtgcagtggcgcgatctcggctcactgcaagctccccctcctgggttcacgccattctcctgcctcagcctcctgagtagctgggactacaggcacccgccaccacgcccagctaattttttgtatttttagtagaaacagggtttcatcgtgttagccaggatggtctcgatctcctgaccttgtgatccgtccatctcccaaagtgctgggattacaggcttgagccaccgcacctggcctaattttgtatttttaggagaaatggagtttcaccatgttggctggtcttgaactcctgacctcaggtaatcacccacctcggcttcccaaagtgctgggattacaggcatgagccaccgtgcccagcctgtttgcagttattgatcaagcacttctctgtaccagacactggggtttatagcatttaatcttcataacagtcctatgaagtagatacctgcctatatagctagtaaatagcagagccagcaggtaaaaccaaatgctttttttcttagtaacttcattttactgtgtcaagaaatatttgagtgcatgagtgcacaaaggaaaaaaggaaaaaggaacctcgtcctcaggtctttagcctgatactggttgctcctgaacactggtttctctctttagccttcaacctggactactacacagaggttctggacctctcctacctgcttgaccacctggcttctgaccctttcttccgccactaccgccagctcaatgagaagctagtgcagctcatcgaagactatagccttgtctcctttatccctctcaacatccaggtactaggggctaagacgggactcttgacagtgcatgggattcaccaagccaaaagcacaggaagctttgagggcttaaagaatggtctttgccggctgggcgcggttgctcaagcctctaatcctagcactttgggaggccgaggtgggcagatcatgaggtcaggagatcgagaccatcctggctaacccagtgaaaccccg

SEQ ID NO: 141 - DNA, 1294 bp, Homo sapiens
attgtgtgaacgtcccttttttgtgctgaaggagggactgaaacccagtgatgggcatgacgtgcccaaggtcaggcagtgagaggcagacttgatagcaccagatgtggctaacactgcatcaggtaaggctccgagcacttgattcgctgatttagtcctcacagcagtcctaagatttggtattattatcctcattttatagacaggaaaactgaaacacagggagatgaatttgcttcctgtacacaactcaggagtggcagagccaggattccagtccaggcagtttggcttcagggtcttcacagagcttcccagggcccacccttcaccagtggggcacgtggctggcccagagcaagcccctcagccccaggctgaggttttgagcacctgcttggcactagggtttctctgctaccgtgtggcctcttcttgtggccatggttaacggaggggacaggattgccctgggtggaccccagggaaccgtggggccagggccctctcctcccacccaccagcctgcacaccctccccaggtcctgtatcacctctttgaggagtttgccaactacgaacacgtgggcatcgtggacatcttcctcggcttcctgagcttcttcgtggtggccctgggcggggtgcttgtgggcgtggtctacggggtcatcgcagccttcacctcccgatttacctcccacatccgggtcatcgagccgctcttcgtcttcctctacagctacatggcctacttgtcagccgagctcttccacctgtcaggcatcatggcgtgagtctgcgtgcagcaggcagtgggcttggcggggtgggggcgggggctgccagcttggattccccaggctcgtaggttcacggagctcccagggcccagccttgagctccagggatgagacatgaactccaggctccagacctgcttggtagccatttaaatggccaagggcatcagtggcttcctagaagaggagcacttctgcagcgccccctggggtccaggaatcgggagagggcatttcaggctatgagcagatgaagcaagaatgacctgcatgaaggcaagcccagggtataggagagcagagccttggaagccactaagcttcaggttgaggaaagccacagccctgctacttcattgtctcaaagggagtcccctcagcagccccagtaggaggctcaccaggcctgagtcctggcggtcctgaggtctccaccgggtctggaaatggggagaatgggatgtggggaggcagtgaggggtgaaggt

SEQ ID NO: 142 - DNA, 1219 bp, Homo sapiens
accgcgcccggccctacgaggatgttaaagaaggatttctttattaggttgggtcttggacacggtcaccattacatttcctttacactgtttaattctgtgaatctactggagacttgagagttctgtctgtgatactgatttggtttcggggagagccaagctgaggatcagagatttgaagcataactaaaagttcagacgagctgccacagatgcctactgagcaagtgaaacttgatgtctttctagctttgccttgttctaactttaaggatatgctaccattatccttcatacttatacacaacctgccattttccgatgaagcataacatatttcttccgtgtttgttccaatgcttgttgggatgtgctactgttctccccacccacttcacccattccagaggtttttcaacactatggagcagggccagcccaccatgccacaaatgacaggcaagggccacttcactgggtgggctgttttaggggtggaattaggtcttgggagtcactttattatccatcctccaaagtttgatgatttttttcccccaggtaattaaatgtgtattttgtggacctgggcttggctggaatgctcaggggtcctgaagatcctattatagcttccttctgttgaaccattaagaaaagatggcgaaagtcaacataactagagacctcatccgtaggcagatcaaggtaagcagcccagacttctgcaccagatcatgagatcttttctttcccacagattgattttacagatgaaaaaactgaaatctatagtctgtgacttgcctaaagtcacgtagctagttagtggcagacccaggactagaatcaaggtctctttctctccatcttgtattgtctaagaacatggatttcatggagactctgtccacatacttgtgcctgggctgctgagattaatgcaggctggcaagggaggggagctgtcaatgtgttgtgcagatacatacacatccttgtgttgggcaggtggtgcacaagagcaaatataacttcttcatgttgctccagctgccaagttgtatatgtaagagatcctgggagagtattagtcccagttcagcttgtattctctttgaggctctcctgtgctaaagcctgtcctctgcagtttgtatgtagaagacactctgatacctgtgagataaatggatgactgggcagtcaagttcag

SEQ ID NO: 143 - DNA, 1468 bp, Homo sapiens
gcacccccaacaatatgtagccaaggttgtgtgttcccctccaccatatacacctcctggcatgtatgtgtacctccccctatagatagtttagtctgtgtatttccctccccctcccctatacgtgtaccctggtgcctctccctccctgagccccacgtgtgtcacccctttctccaccacagagtgaagacctcacaggccgagtcgtggaagatatggagggtgcttcacaggccaaccagcggcgcatgaatgcagacccgttggaggtgatgctgctcaacatgggctaccggatcacgggcctgagcagtgggggtgccggggcctctgatgatgaggacagctctgagggccaggtgcagtgccggcccagctagaccctccagccctggtccccagcccctgctactggctggaccctctgccctgggcaggaggtcaggggattctgttttggtttgtcttccccaccacccttttttttcatttcccctgttttgtttgttagtttggcgttaggggtggaggttgctacaacttgctggctttcggactctgggctgattgtcccctgactatccccagccctgaaaaaaagagcaggaggggacacccctccatatgcccccccccatctcctgctttcatgtccctggagggctctggcctgcctcaaaaccccttctgcctcaggtggggaggaacaagctgaactgtcttcagggactgtcctgccctttagctggcagcagcaggaggagtgggattcccaattggtaagggctcgccttggcctgttgccactcttgctccctagcctgcaaggctagctcccctgtggtcttcaggaaaggttttgaaaaaggatgggtcccaccctccctccagagccaccagtgttagagcggagcccaaaggaaggatgggagccctggagtgggcaagaccaggccacctgctgaggtcgctgtggagcaccctcgctcctctcctggctactagctctggccctgcacctactctcactggccacctctggaggctctgcctttcccaagggccctggcagagggtggggcactgcaccttaccccacccatccatgccagcacttctgcactacggccattctcctcttgggcgctcctcagcctcactgtgacctttctgccagagctcccagccaggcctactctgctgaggtggcgcttcctgctaagggcccttctctgccctttctgccctccttcccatcccacatgctgagccgccacaaagaccaaagaagtgatggcttttctctgtcccctgctgctctgaggggagaggggtgggtctcctgagccactcagatgggaaagtcccttactcggcccctccctccccagcagccccaagctttacactggatgcagcgatcaacccaccactcaccaggcctctcctcccctctgcccccggc

SEQ ID NO: 144 - DNA, 1212 bp, Homo sapiens
ccggggacccagtgagccgagaggccctctgggctccacttatgcatatgcaccaaaaaaaaaaaaaaaaaaaaaaggcttctttagacccagagccctttaagatgataaaggacccaatgcaggtaatcctgtttttggactcacgtaatgtagaatgcaaagtttagtgattatttaatctgggcctaagctagtgagagtatggaacaatggcccataaggactcctaagcgccgaagccaaggagcctcctcccttcctggttcaccccgcccaagggacctgcccccattcctgtggccctggggcccagcttccaatagtgtcagaagcaacttgtggctttgccttggttgtgagatgggtacattccaaaggagcagcctgggggagggggcaggctcagccagcccttggaggctcagagcagctggcccaggctccagctcgcctccagtggaagcccgagcgccctcagaaacgaccctggccaatgtcaacgcagagccgaggcggtgttgtcacggctaatgtgaaatctcttcccgtggcgcccatcctctgactctgcagtgccagcttggacagattgaggtctctgtggctttggtgaccctgcttaagcattcccaccgtgtcccagctctgctctaggactgcctcccactgcggcccctcacctgacttcagggtatggggagggagggagccagtgctccaaggccagggggctttgctcatgagagatgtcaggcttcctggaggcatcaggctttgagccctgctggggtccaactgacctgggaccaggtgtcgcgcagagatgtgcctcattctgtgcctccttctgtgcctcctaccatgttccctttaactgtgcctcagtgtgggttagggaacaattttgttattgtattaagtttattcagttaattcacttgaggaactaaccagtttttactttctgtctagaatgatgtacatgtagtagagtaagccataatgctcccaaagtgccttgttttctctgatacaaacatatttataaggacatattcctgtgggttcttgggtgtgtttgccacatcaagattttagggaaggggggtatatgtgtagtagggatgccgtttgaaaacaggcactcttcccctgaggatgggaaaggagctcttcagttggagatctaggcagtgggttaagccagac

SEQ ID NO: 145 - DNA, 8155 bp, Homo sapiens
aaataactctaccatgaaaatcttgacttttaaaaatcttgacacttctgacacttgttcttcgtggattaagagctctgctttaaagagtgatgaagatggtgaaaggaaaaaatgaacctttttctctactgggaaatcagccctgagggtaccttcattaccttcacctcccagtaaagggggacattttgttccacggaccaatcctgttcagacaggcacttgtcataggttcaatgactctaaggccagaagcttatgtgttcagaatgccagctacccatgtgtgtcttctttttgtggagtaggaagatgaggatttgccttccattttcctgttgtccaggcggtttggagttggggcttcatggttagtctatctggacatgcctgttggtgaacctataaagagacgtgccaaggctccagggctccaggccttggggattttccacatcagagcatcttttgattcagttagttttctccaactctgttctccctgaggtctgttttagatgagttctttagaccccaacaatggtggaaagagggggaggtggagcagagcaggccagattttgctagctgatgcttggtgtatttgtgcttgtttgaagttttgttgttgttcacccagaacaaattcacccaaggcccagtgcactgagggacaggttttcatgagacaagccctagcacgctactttaatcgtcagctcatttggtttgataagagacctggcagaaagaccacatttactaccacatagcaccctgcattcatcctcagcttgattttgcaatccagtgcctccttggccttcgagctctccagaggcttgctgacctcaaaatcagtctgtgtgccagtcacgtgtttgcagctcactagcctctgagacttggcttcacatttgtcacaggacagactttgggattcaggtatatctgcacctgacactggggagagaatttaaaagaactgctgggtttgacaaggccaacactgggcaaggaacagcatggttttgataatctgggttgaatcctgttactacaaacaattcagcataaatatctgggatatatttgacaatagaatatttagtcttaaaataaaatttcagtgtaacagaaaatatgtgggaaatatacctattttacttctccctaatagcttttgtatcaaatgcatttttgtagtaccttttaagaagaaaaaacccactcaggctctttaaatgacagtttttggcattcggttcattgtcaggtatccacccactttggtgtaccagaatggcagcattggctgtgttgaaaacgtggatgcaagtagctatccgccaccaccacagtcagactctgcttcttcaccttctccttccttctccgaggacaacttgcctcctccaccagcagaattcaggtaaatggtggtacctactccatccactattggtagttatacacttgagaacaaaagaatggaccaggagcagtggctcacgcctgtaatcccagctctttgggaggccaaggtggtgggaggatctcgtgaggccaaaagttcaagaccagtctgggtaacatagcaagacttcatccctactaaaaatcaaaaaaattagccaagcatggtggcaaacgcctgtggtcccatctactcaggagactgaggtgggaggatcgcttgagcctgggaggttaaggctgcagtgagccatgatcatgccactgcactctagcctgagtgacagagcgagaccaaaaacaaaaacaaacaaaaagttaaaaccctaggtcaagaccactaaaataacttcaaacaagactgtctagataatagaaataattaacactgtatgtatatgttgcttaattctcataggagtcctcttttgaggtaggcactgttactatccccatgttacaatgagtaaactgaggcacagaggggtcaatgaaatgacccaaaggtcacagccagtaagggcagagccctgattggtcagttgaactccagaacctatattcttaactactcctgttttgcctataccgaaacaaatggaaatcaccagcttctttcttgttttttccttaactttattttatttacttatttatttatttttgagacggagtctcactctgtcacccaggctggagtgcaatggcgcgatcttggctaactgcaagctccgcctcccgggttcatgccattctcttgccttagcttctcgagtagctgggactacaggcacccaccaccacgcccagctaattttttgtatttttagtagagacagggtttcaccatgttagccaggatggtctcgatctcctgacctcgtgatccgcccacctcggcctcccaaagtgctgggattacaggcatgagccaccatgcccagccttttccttagctttaactcatcatgaaatgaagtggtacaatctgctgtccatgatatagttagcagttaccttgcccagttgtctaggaacctagcatagagtcacttcctcttagtgcttctggttagtttcactgctgtgtcaaatctccagaaacaatgaaacaaagggaaaagggggatgaaactccaaattcgtccattttgatatttgtgcatgtccctggcagaggtgtacagtggaagtgttaggcagtaatgactgaaaagagatctgagaattgttcagattgcactgttttctccgttacttttgtcctttctgatgcctgataaatgagagctttgaaaggtgcacttttctccttgggtacttcttaattagaaattgagtatgttgaggacccctcggatggagacctaaagctgtgctgtcctccttctctcccctcattcttcttggccctagaaaccattaatcccaaatctccttctgcttcccaaatcacttcctgctggtggccctgtcagatgcagctaaggctggaaggtctgtggaaaattccaaaatggctgcttttctaaggagtagctgttagtgcagggtagatacaaaggtggaaaaagaaaaccttcagcttcacacatggcctgagaccttgcagctgcagccgagcaaatctgatcccaggagaggtgtagctttaatcctctttcaggcctgggtcaggagtctggtggcacattcatttcccatctctgcagattctcggattgagattcattctctctcaagatttccccacatgagcactgaagatgcattcacctaaatctatatcccactcaggtgtggtcagcctggcttgggtttcctgccctctccaatgctggtgaatgttaatagcctgagaaacagagcctagtgtgtgggtggtgtttgaatttttattccagttctttcttgcatgcacccttaaactggctccaggattaaactagcaactgccatggaccatccttcttagggaaggggagggagggtgccttccccttagagctggaaaggcagagggggccgaagagatgtctcagctagcctgtacctgatagaggaatctcaagtccacttcttgcaggtagttttactcaatctgtctatcctcctctactggtgggaagctcattaccttaaaaggctgcttatttcattattggtctgttatgaccatctgtaggcttttctttctgtttaagtgaaagtgaaatggtatagtcaaccaagataaacctcggtctgtagacaaggctaactgtagataggtgtctgcattctaagggtgatggtgagtctttttttctttggccttttagttacccagtggacaaccaaagaggatctggtttggctggacccaaaagatccagtgtggtcagcccaagccatccaccaccagctcctcctctaggctctccaccaggccctaaacccgggtttgctccaccacctgcccctccgccacctccgcctccaatgataggcatcccacctccaccaccgcctgtaggatttgggtctccagggacgcctccaccaccctcacccccatctttcccacctcaccctgattttgctgcccctccacctcctcctccaccaccagcagctgactacccaactctgccaccacctcccttgtcccagccaacaggaggagcacctcctcctccccctcctcctcctcctccggggccccctcctccccctttcactggtgcagatggccagcctgctataccaccaccgctttctgataccaccaagcccaagtcctccttgcctgccgtgagcgatgcccgtagcgacctgctttcagccatccgtcaaggtaaatttcaatggtgggtttgggactgtggagccttgtctttctgaagctgggatgactgattgggggatgggtgagggggtccctgtgcccttcccaggaaacggctttcattgggtggggagagattgggacattaggcctgggagcagcctgagaaaaggcttcaccctaaaaatatggagatttagatttctttccaccttggtttaaagtaaaggattcttttcttttcttttttttttttttttttttttttttttgtgggggacagagtctggctcttttgcccaggctggagtgcagtggctcgatctcggctcactgcaagctctgcctcccgggttcacgccattctcctgcctcagcctccggagtagctggtactacaggcgcctgccaccacgcccggctaatttttttgtatttttagtagagatggagttttactttgttagccaggatggtcttgatctcctgaccttgtgatccgcccgcctcggcctcccaaagtgctgggattacaggcgtgagccaccgcgcccggccaaagtaaaggattcttaagctgggatctttgaagtccttggaaatatatgcttatgtgtgtttgcatgcatttttttttccttggggaaggatccccatttttcatcagtttctccgaagggttttgtgccttcgaaaaaaaacaagaatcactgtcctagtgggtccttgttcaactggactcagcaactccccagccttctccactgctctgcccttcgtgtcttccttccttgccccctgccctctttctaactccttttttctcccattttcttttatctcctcttttctcctcttccctcccctccccttccctcccccttcatcatctcaccctcctggaacattggagcatttattctatcaggggccaggtctggtcccaaggtgttatcgtggtttgttctgtttgtgatcctcaaaaaacttctaatctagagaggacagtctatggcagctgagccccattataattgatggaattgggcaggctgagggtctgctagatggaatgtggtggctgctccccacttcaaagccttatgagaagtcctcaccagcctgaaagtgtgtaaaccagaaaggacagcaggctgcctttcagacacacctgtgacatcagggccatcaatttcataaactcatcttcttctgcttttccataacaaccttctttttctctatcctttccaataccacttacccattggtggccactccctcttacccagttccagatggattccaaggctgaggacacgccttcctcacccttctgtctctttgccactaggttttcagctgcgcagggttgaggagcagcgggaacaagagaagcgggatgttgtgggcaatgacgtggccaccatcttgtctcgtcgcattgctgttgagtacagtgactcagaagatgactcctctgaatttgatgaggacgactggtccgattaactctttctgcctgctgcccaccttctttttctttccttcctacctgccttctttgatgccaaccccaacagacccgtagggggagaaaagggaggaaaaaagtaattttaaggggccaaagctttccctgaagcaaccaaagatatatccaagtgcttcctccaagtcaacatgtatttcctctccccattttcaggccctgtggggctcctgaggttcagtagctgggatgttccctctttccttcaagtgcctgttgcatattgaaaggaaggagaaatcccaaagcagattcctttgatcgggtttctgttggagatggggcttcccttaggagccatattcaactacagccttctaaaacctgtgccctcagccacttcgaatgccagccaccttctggttctaaaacggggagtggtctgaatgaacacagctgacccctttcccgcgcactgaaagggcagagtaggccgaagggtccaagggccagactgcctcaccctctgccctaatcagcagggtgggcctgccttttgctaagcgatctctatgcctgggatgccctttattccaggaggcatcaagcctctaaagaatgtctcacctcctctgcccaaaaatgatgcctttctgtaggctggtgttgttgcctccctcccaggatccctttggtgagtatggtgttcaggatgcaccaccaccacctctagataccttcaggcaacacagcccagttttaacctctagtatccatgaccaaactatccctgacacatgaggacaggggcctcttctggctgtcaggagcaaagcctgaagacttggagctgcaggactggaagaacagtggagccccgtgggtctcaccctttaaggatgctgaggcctagagatgggaagtgacttgctcaaggtcacacaattggatagtgacatagctagagcgcagagttcctgattccaagtcacctgtgctttctgggaccaaagaatgggcacctgctggagtccgggcagagctttctcagttgtattgctactccagacctcaccataggttggggtcccagtaggaaggctcagggtctgtgccagccctgtcggtgctgctcagaccttcatagcctctcttgtcattctttgttgccccttttctgtcaccagccaaccacatagccttgggaccagcctctctgggggaccagaagtagtgagagaaggaaggggataggcagctttgacaggtgctgctttcaattcctctgcaactcctcccccttttatttccccaatttaaacaaagattctgccaactgtggaaacttcagtccctcaggctggcagccatgccagtacctgcctgggggtggggggtgcctggcagccatgaagcaggctgaaaggcagaggggctccaggtcctgtttccagctcccctcactgcacatggtgaagctcgctccctccctccctcccttcccgcttttcccagagctaatacacaggtgctattattcagaaaaaaactggtcagctctagccaacagtgaggtttcttttcttctgccctaactattgtgtagcctcttatgctgaaatcggcttctgctggcttctccggctttcagagccctgaaacaaagagaaacaggatctgtccctacccagcacagcaaatggttgtagtaattgccaaagccctcataaagccctccggcttgaggagagagtgtatagtcatgggttctgcctctgtgcccttgctggccgcttctcctctgccttctttcctggaactcagggtgtggggactgagcctgtaggggacagcatgccgtcttgctgtggccactcccaagtgtgccctcttccctctttacacatcaggtgtctctggcacaggacttggcactaagctccatgctgagacaccaggctatgtgggcccccaccttgtttcccagcctgcaccttagaagccgaaggtgctttcatcagaaccctaaaatggtcgttgaaggcgcctgggccgcagcccagcagtagttggagaggcaggcagagggcagtggttctcccaaataggagacctggggcctggccaggccagggtttgggcctaatggctttgactaaattacccccatcctccttgcccggaaaagggagagctagagccactcactgtcattctgctctgaccttgaagggggcggtgttggcctggcttctggaatggactgagtccatcgtggaaagggctgggggcaggaggaggtggggaggggcactgcctgcggaaggtaggattagatcattagctcagtgacctcc

SEQ ID NO: 146 - DNA, 1138 bp, Homo sapiens
tgcccttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcggcctctttgcggagaatcgtgaccaagatgtggaacagtaatgatgggggtgcggggtggaggaggaagagaatcgcaggaggttttagcaagagggcgagcctagggtccgagaggcgtgtggtagcgggagaggaagggcgggagcggagctggggcgtttgggggtcacccgcaggaaggcggcgaggaaggttagggagactcgggcagtgtttgaaggggcgaagcctccgggagcctgcgggtttctcggaggcgtgggacgtggcacaggcactaatcctgttgttcaaaacaggtggattcgaaagctatggcagctcctcatacgggggagccggcggctacacgcagtccccggggggctttggatcgcccgcaccttctcaagccgaaaagaaatcagtaggttgaaaggagtatttagttttgttttatcctgtcctgaagtccctgagtcatctatgacagaaactttatgctttgaaggaagatttcaacgtgaactgatgcgataatgatctattattatctgcatctcttataattaagtgctgtaagtttcagaaatgaaatcttgccaaattttccacctcctgtttccctggcttttcccgtcgttggccttattttgaaattgatcagtgtagctaatgaatcagtcttgtgtgaacgccctcaacttggtttttaaatttatttttattttttaaaatagagatggggtctcactatgttgcccaggctggtctccgactcctgagctcaagcgatcctcccacctcggcctctcaaagtgctggggtaacaggtgtgagccactgctcctggcctgaacttatattaatagtctcttttacattctttttttttttt

SEQ ID NO: 147 - DNA, 1156 bp, Homo sapiens
agcttgactgtcattcagactgtatcacaggaggcttagcttccaaactggagagaaggaactaaagtgtcttatgaatttcagcttcttggctcttgagaccgaaaggttctacctattccccctgcagagaagcacccatttcccatcagatgctcgtccctgcagcttcttccttcttggtcatcataatgctaggttcttacccctttcctgccctctgcacctcatgtccacctccaggcagctctggccagtccccgggtattagacccaagaattcaaatcaaatctaaaaacatgcttataactacattttggccaaaactgccaatgtatttgacttcctttgtggaagccctaagccatatgaaggatgtcccaggtatgtatttacccagatctctgcctgaaactgaagagcagattgctgtatttaaattttcccatggaaaaccctgcttctcaaatcccattctaaagtaggaaaccagaaagactttgctgattgtggggggaagggagaaacagacaggttttcacattgttgccaaggctggtcttgaacacctggcctcaagcgatcctcccacctcggcctctcaaagtgttgggattgtaggcatgagccactgcacccagccagactttcctgatttaaatgagagtactgcatcattccctacttcatggcccaaaacttaatcctgggccaaatgcaggagcatctctcgacctctgggcagattggtgggtgcccaggcactagtcacagccttccagcccagccatgattgttggatgccccatccctccaagagcaatttgggcatctactcaggcaggataaaattccctagagctgaggaagttcagcctctcccaggctacacagagagagatgatacaagcacctcagattgagatgcaggattggtccgcagaaggaggcattgttgaccaaccccagctataattgcttgtcaccagagattctgcatacccatttccagagatgttgcagcacaaagaggcaagactccttccaatgccaggccacccagatagcaagagagagaggctggtatacacattccttcagaactcattgaaaagcgctcataactcgtgattttaaggagtaagtttttgctga

SEQ ID NO: 148 - DNA, 1163 bp, Homo sapiens
agcatttctcttgctcaagaagttcattcttatttctctttcaggataaaaagcatagtattaaagcttaagctctaaacatctttaccttccaagttcttcctctaacagagttagaattatgacaggactattaggaaagaaaacaaaaaactcaaaaggcactatggagttaattgcctattcttccaaatccagggcaggcaatttgtcattgcttcagactgggactagtatccttgtacctggcttctcatctgcctcttttctcctgatatttcccagcttttaaattttatttcttataaaatagatagtagagggattagtatgggacctcaaaaacctatctgaagtactcttaatgtataaactttggtgatgaaaaaaagttttaatataggttaattagattttgattttcagttttaactgttttcagaaatgtttgaaaactacttctccttggtctagtggaaacagaactggtctctatgttctgagaccttactctgagctacctttacctcctgttgtttaccaagtctcctcttttcttcacttgtttcctcttcttttttttttttctccccttgtcctctcccccttctttctttctaagatgggaacaaaccaggagggagaaacttgaaagaatggctttgcctgtcttctccaccactccctttcatttttatagagtatttctctatggttttttgttttgttttgtgacagagtctcactctgttgcccagctggaatgcagtggcgcgatcatggctcactgcagccttcaccttccgggctaaagtgatcctctcacctcagcctctccagtagctgggactgcaggtgcacaccaccacacccagctaatgtattctatatttttttagaggtgggatctcactatattgcccaggctggtcttgaactcctgggctccagcaatcctcccaccccagcttcccaaagtgttgaaattatagatgtgagccaccacacctggcctagtatttctctatgttgataggccttttgggttcaaccacaggtaagtctagttgccaagtctcttctaaacaggtatatctgataacttacacctaggttgtgaaagaagaccaagggttctcttaatgctctaccaaaatgtaaaa

SEQ ID NO: 149 - DNA, 2524 bp, Homo sapiens
ggctcaagcaattctcctgccgcagcctcccgagtagctgggactacaggcgtgtaccaccgcgcctggcttatttttgtatttttagtagagacgggatttcaccatgttggccaggctggtctccaacgcctgaccttgtggtccgccacgccaggccgaagattttcataatttggaagcattgcgtttcgtaattatgctttctcgtatttttgtgatttgggtcatttttatttttatatttttaggattacaggcgtgagccatcgtgcctggccgatttgggggtaattaacaagtccacgtgtttcatttgaatttaggatagctgggcctaattgttgtctttgcttctgcggtaccttccacatagtactaaccgcctattgtaaagtaattagaatagctgaatatgcatgttaccagtctagaaaccgatttttttttaacaccccactgtggacagggtggaaactcgtttgctttcttgtttaagatctgtagtaacatgaatggatgaaattgtttcctattggattctgtaaatttatgcgttacactgattgtccaacgtggatacacccgggaggtcactctccccgggctctgtccaagtggcgtaggggagcatagggctctgccccatgatgtacaagtccctttccacaacgttggaaataaagctgggcctcgtgtctgcgcctgcatattcctacagcttcccagagtcctgtcgacaattactggggagacaaaccatgcaggaaacagccttctagagcactgaatctggattgaagtctttttttttttttttttttttggagatggagtcgctctgttgcccaggctggagtgcagtggcgcactccattgcctctgcctcccgggttcaagtgattatgctaagtgattctcctgccttggcctcctgagtagctgggattacaggcccccgccaccacgccaggctaatttttgtatttttagtaaagacagggtttcaccatgttggtcaggctggtctcaaactcctgaccttgtgatccgccagcctctggcctcccaaaatgttgggattacaggcgtgagccaccacacctggctggattgaagtcttaatacatgtttaagaaaaattggctaaaaagtagccaggcatgatgataggtagctggaggaaggagaatcgctggagcccaggagtgacctatactcaaacctatactccagtgccactgtactccaaccccaggcgatagcatgaggcccctcgttgaaaaagtttagggttttgctgtactaatagattaatatcttgttttgcaggatttgttaaggattccaagtaactcttatttggtgagtaaatctgctaattgttttttgcttatcagctctttgtcaatgatttctgtaatggaaataggattgaagagacttttattctagttggtcaggatttacctctgaggcatttaatcattctcagagcaatagccaaatatcgactttgctgcatttttgtaggcatgttgacataacttcaacatatgctctgttctgtaaaaattgctttttttagtcagctcattaaaagtgcaaagtagtaaaagctgccctagtgaactgtaggaagcctaattggctttatctacatgtgtagcctgagctgagaaagatactagcccttgaaaatactgtgggtgattagcaatattggatttgtcggttactccaattcctcactaatgagcattccaacgtggataccctgggaggtcactctccccaggctctgtccaagtggcataggggagcttagggctctgccccatgatgtacagtccctttccacaacgttgaagatgaagctgggcctcgtgtctgcgcctgcatattcctacagcttcccagagtcctgtggacaatgactggggagacaaaccatgcaggaaacatatctagtatactagattttaagttgaagtaggatcttcaggagtctaatcattatttcttttcttttaggagagaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagtcttgctctgtcgcccaggctgtagtgcagtggcgcaatcttggctgcaacctcagcctcccaagtagctgggattacaaacataagccaccacgcccagccctcatacctcttttaaaagtcgacctgttttgcagaaagtctgctgtttttgtactaaaggctttggaatttggcatttagctaggaatgcacattctttcacctcattcatactttaagaaccacagaagtgactctgcttggccagaaggcacactgtgttggtggttatattaaaagtccttgagtattttgcttttcatgatcttgctcactg

SEQ ID NO: 150 - DNA, 2524 bp, Homo sapiens; identical to SEQ ID NO: 149

SEQ ID NO: 151 - DNA, 3395 bp, Homo sapiens
caggcggccgggtttacggaaggggtgggggtttgggaaccggtctcctgggggatgcggggatgaatccctgggcctgaagtgtcttaattcagggggaggccgcatgctggtgtcaggatggcctccagttgaatctgtgacatttaccagctaggtgattttgggactggtgactacgcgcgagacctctggaggtcgccctggtagacacggttttcagaaggacgggttttaggcattcagacccttgcgtgcatcccagcttgttgctttcagcctcgctaagtgactaagcgaccttcaggaagtaacttaatcggtctaaacctcttacctgtaataggcggataaaacggtcccatcaagactgagaaaaagcacaccagctattggcacagcgtgggcagtggggcctacaggatgactgacttagtctacagagatcccggcgtacttaagcaggtagtaatgatggacaggtgaggctttaggcggccgccctgggatctgaattgccccttggcccttatcgaagctgcagctgcttccgcatagctgctgtggtcaaaaaggagcccagagtgacagttttccttgacggtcgccgttctgtttgttgtaactgatctgcaacattttgggaaaatacagttccattgtacctgccacctttcagctgtagccagagacctttatcaaaatgggcttgtttccacagaacagcagaacggttgggggtttgcatgtacagttaaccagcataagactcgtactgggaaaatccagctgggatgtgacacagcttaactgatagcttaaggcatcagtattgggaccaaaggctggtcagatttgtatcattctgaggaccaaatgatgggaacaataaaattgttcatgacagttgttctcattttgctgtccagatgaagactcttaagatgacagaaggtgatttttctggtgatcgaggacttccggggtaatgacagtgatgaaatgcaggggacctggtaggtttcttttggagactaactgggggctgcctggtgggacagaacagcatgtttccaagggctgtggctggtcatagccatgggatctccaactgcatgcaagagcaacctggaaagactttgacagcgcaggtcagtacaatacctgcaagctgccactcagctttcctataatgtttcaggaccagggctggaagccttccatgtgtcaacttcaatgtagatgggtttttttttttttttttttttgagacggagtcttgctctgtcacccaggctgctggagtgcagtggcatgatctcggctcatggcaacctctgcctcctgggttcaagcgactctcctacctcatcctcccgagtagctgggattacaggtgcccaccatcacacccagctaattttcttgtatttttagtagagatggttttcaccatgttggctagatgggtctcgaacttctgacctcgggtgatccgcccgactcggcctccccttccaaagtgctgggattacaggcatgagccaccgctcctggccagtttagttttcacgctaagctttttgttctgcaggttgcccccaagtttcctggcagtgtgtgatactgaggaggtgagcttgtttctggagctgtgctttaaggtaaagttgatcagcttaatcctcctgatccctttcccatcggatctgaacactggtcttggtggtcgtaaaaggaggaaaagtaatagtgaagctggcctaaatgttgtaatctggtatatggcatgtgggctagtttcagacaggtttcagagatggttggatctctgaaattgtaaaatgaagtataatcttaggctaagggaaggatgcgtgtgaagctctggaggttggtatagtaatagctgacctattactgcatttgggagggatctgtcatagcttccttgcctcttaattaagggtggtgtttttttcttttagattcatgttacatgtaaagctgtcctcatttgtgactatggacctatggagttgggtaagttagtgactacccaaagctttgtcacaacttggtgtgtagctgcaggtagtgctcaactatctgggatcctgtcctaagtagtcaacctaatagaactataaggttacttaggtctgtgtcaaagttacagctttttttttttttttttttgagacagggtctttctgtcacccaggctggagtgcagtggcacaatcttggctaattgcctcccaggttcaagtgattctcctgcctcagcctcctgagtagctgggactataagcacgcaccactatgtctggctaatttttgtatttttagtagagacagggtttcaccacgttgcccagggcagtcttgaactcctgaccccaagtgatctgcctgccttggcctaccaaagtgctaggattacaggcatgaaccactgtgccgggccagaaagtcttagcatcttagtaacatttacatttggcctccctcgtgtgcccttagctattcattaccagagggcaaagatggttagaacatgatttacccaccctaaaatgcattgaaggcatcagagggcaccgtgggccacaaggcctggtagccacaaatgttcagtggtggctggagctcatgatgcattctttggtgggacgtctctcagcattagggagagttgagagtggggtagaaacaaggggttccatgtagcacacactgtatttagaatgactggtccaggatgaaacctaatttgagtggacatccatggatgagaaatgcggatatgggactgagaccagctcctaggaaaatgtctgggtgggggaaatctgggaattagtaacacaatggcttacacttcctttgcaggacaatctctatgggaagcagaaggcaaggaccccggtcattttaggtagaaacaacagcatgctaatgcaaaaaattatgcagtgtgctactgaacttcagaggtgatcaataaaagaagaataaaaagactaataaaagtatatttgtgtttgtatttttttgtagagaccgaactggtctcttcccgagctcaagcaatccatctcccaaagtgagccaccatgcccagcccttaaagagatctttggagattttttatgatgtaggatgaatgctttgcctcaagcagtaagtcccaacacatgacaaggttggacagtttccccatttacttgggaaacacggaagtgagcagtataaagttcacacggagggtctgctttggctttgagctatcttccttaatcctttctgagctgccttctcccgtgtcaaaatattgatcctaaagtgatccaggccttgtatatgcagatgctgcaactcatgaaaataga

SEQ ID NO: 152 - DNA, 3395 bp, Homo sapiens; identical to SEQ ID NO: 151

SEQ ID NO: 153 - DNA, 3395 bp, Homo sapiens; identical to SEQ ID NO: 151

SEQ ID NO: 154 - DNA, 3395 bp, Homo sapiens; identical to SEQ ID NO: 151

SEQ ID NO: 155 - DNA, 3395 bp, Homo sapiens; identical to SEQ ID NO: 151

SEQ ID NO: 156 - DNA, 1258 bp, Homo sapiens
catgacaatcagcttatgcgtgaccttgtgaccttgtgcttccactgcacgcctgcctgggctgctccaaggtggtggctaggggtggcacaagttacacattttcaatttggataggttgtgattcttgtcttccccagtcagatacctacagccgctgagagccggtattccaacgccatgagacgccttctgtcgtgagcagttgacaagaaagacccagcacttactgcaaccggaaggagcggttcctccctcgctcgcgcagccgctcttccccgccactccctcggtgcccgccagcacattcccagcaagccctgagtatatttgcatatcaactcactacatttttttcttctaactaaaaaatcgaaaggacaaattccagattctccttgtgaagtcttcctttcagttcagaagaaatggaattcgctcttcaacttcaggaagttgaaataaagagttgcttggattttgtgttcacctttaccaaaaaatggatttggtaacactgccaccctgctttggtgacagagaaagcaaaaagggcttctgtcgtgagtggcacacgtagggcaactcgattgctctgcgtgcggaatcgacatcaagagatttcggaagcataattttttggtatttgggcagctggtgatcgttggtcccggcgccctttctttactgttatatgttaggcgaaatattacgcgtttggagtaagtggtgctttttgtaactgaaaagagattctgtgtgtgtttttttttttttttagaggctgcatagttatttgtatgaaccgcaggtgacctaattagcaaggtaattcagacctgtatcctagcacttaagaagtggaagtgggataaccctgcgtgttctcgtgtgggaggctagcttaagcaacaaagcaggaaggccccaccaacaaaagaatttaaaaattatacgtgcgtggtggcgcgcgtatgaggaaattatttggcaactgtgttacagtatagcagcaaatggaatagacctagtccctgactttaggagacctgcctcagccccccgaatggctgggactacaggcgtgcgcctccgcgcccagctaatttttgcatttttggtagagacgggttcaccatgttggccaggatggtctccatctcttcatctggtgatccgcccacctcggcctctaggagtgctaggattacaggcgtggccatcgcgcccggcctgcaatgttattttatgaagcaga

SEQ ID NO: 157 - DNA, 1238 bp, Homo sapiens
ggctgattttttatatttttagagactgggttttgccatcttgaccaggctggtcttgaactcctaggctcaagaaatctgcctgccttggcctcccaaagtgctgggattacaggtgtgagccatggcgcccagcctattttaatttttaaaaatttatatggggagtctctctatgttgctgaggttggtgttgaacccctgggctcaagtgatcctcctgtctcagccacctaaatagctgggactacaggtgtgtgccatcacatctagctaatagagttgttttgaattggttaaatttaagcctgtaacccatacgtgtaatagaaatgtatatttttggtgatttatgaatacatagtattaggccaaggtttagttgtgattgatatacagctattagtacttacatatactcttaagtaatcctattaaaatcattttaacacaatgggatcttaatggcatatctttaaacctatcttataaagaaatgctgctttaacttagatgccaagcacatattttaatttaccaattagaagttctatatgtattcaagtgaagagtgtttcaccttaataatacatttcatacagattgttgaaattcatcccattcccccttccctccccagtttttggccatatggacacaggcaggactctcaggagtgccaaggatttaagccctcaaattttacctgcctaccatttcagcatgcgatagggacacatggaaggcagcttaaagtaaaggctttaaaaaattttttttgctaccacccacttgctgtttcttgcccttttctcttttttttaatgattcagaggatcgacactgttgccagcttactacctgcagtctttccagtcttgatggtattacgtaattatataaaccttttgcatggtatcatatgatattgtatatttgtcttcctacacatgtgtctttagagtaatttctttccatctggtgttgaaaatgagctctttgtgaggttatttttaaatcttcaagctttctggcatcctcaacacttgaaataacacaattgcttttggaggcaagaaaatccacatagtatactttgtggtttttccagtgaaaatgtaaatagtattttatttatgaaattttatatatatatatatatatatatacactttttttttgttttttttttttgagacggagtctctctctgtcacccaggctggagtgcaatggca

SEQ ID NO: 158 - DNA, 1138 bp, Homo sapiens
tttaaacatagagtatggcaaatccaagtttcctacccagctgtgacaagtgcccagattcagtgttctgggtatctccattgataatatctctgtgccacatttaggaagtaatgattaggacaggagccaatcataatcctgaaagatatagtcctcaatggcataatcctgagtgttgaaatcccaaaagaccaaaatcccaaaaatataattctggaaaaaggaatttaaaaaaaaatttaaagatatgtatttacatttttaagggggatttatttgagaaacataaaaacataacagaacacttcataggctactttacatgataaaataggcaaaaacaacatacatattttgcaagcataaacacttgggtatactaatgacagtcatacaggtataagttatgagcagacaaggtgtattcataaaaaaatagcttatataactgcagtcatctgaaataccacgacaaacaacctaagtcttaagatcaatcaaaaaccatgatgggctttttgctgtaggcccgagtggttgctgccgaaatgggcaagttcatgaaacctgggaaggtggtgcttgtcctggctggacgctactctggatgcaaagccgtcatcgtgaagaacattgatgatagcacctcagattgcccctacagccatgctctggtgtctggaattgaccactacccctgcaaagtgacagctgccatgggcaagaagaagatcaccaaggggtcaaagatcaagtcttttgcgaaagtttgtaactacaatcacctaatgcccaaagcccgacgagaggccaaggtcaagtttgaaaagagataaaagacaggcaagaacaagtagttcttccagaagctgtggttttagatgctttgttttggtcattaaaaattaaaaagaagcagccataaaaaatgatgagttcatgtcctttgtagggacatggatgaagctggaaaccatcattctcagcaaactatcgcaaggacaaaaatccaaacaccgcatgttctcactcataggtgggaattgaacaacgagaacacatggacacaggaaggggaacatcacacaccggggactgtcgtggggtggggaaggggggagggatagcattagga

SEQ ID NO: 159 - DNA, 1678 bp, Homo sapiens
ctttttttcattttgatttttgaaagtgaagatgatgccctaattcctggtaaggatttggggcatagttttttgtttttttgagacggagtttcgctcttgttgcccaagctggagtgcagtggcgcgatctcggctcactgcaacctccgcctcctgggttcaagcagttctcttgcctcagcctcccaagtagctgggatgacaggcgcacaccaccacgcccagcaaattttttgtatttttagtagaaacgggatttcaccttgttaggctggtctcgaactcctgacctcaggtgatccacccaccttggcctcccaaagtgctgggattacaggtgtgagccaccacgcccggccgatttggggcatttttatttaacagaacttctctaaccttccaactgcttcccacaaacacattggcctcaaggctccttagaatcccagttccagcttcctaaaatagacagtgggtatcgggcagcagtcactggggctcaagggcagtgagcaagagaaatgtctaaagctgcttctcccaacaccgtccaaagtctccactgcctgagttttgtttcggctggtttgaactcatttcgggtgtgtgcatttttcttttggtacccatgtgagacatgaacaacaggagggagggaaagagcccaggtgggacgtgggacaggcttaggggaaagagcttgtcctatctcaggaacaaaattataggctgtgggcagagggtctgaaaggtgggctttggggtagtgcccaagcctggtcgtgttgccaggagtggtgacaagaaatgcagcttacatcaaacgaacatgtagtgcatgcccactgcctgatggccagatggcctgtaggaagagctaccagggcttccagacctgtggaacgaagaggatggggaaaaggcagagggcactgagtgtccctttaaaaactaacccactgaatattccgtgtgatctagaacagtgtggcagctttcacagcacaggaccgttcatcgggggcctaaacgtttccctcagctctgtcaccaactcacttctctcggcttcgttgtctgtaaattggatgaaaagagctctaatgcctttcaggctcttagaagccatagatttggacaagcccagcaagatgggtgtccttccaggcctcttcccctttcctccatctctggcaacagttcttggggtttggcaattgtttggattttttttctttctgcagttgtgtgtatgtgtgtttgtgtgaagaaaaacagactctgtccaggtagaaatggtgaggagggggaagagaattacatttccagggtcagaaacttggcaacagttttcctagagtgactcagacacaccacagtaacaactctcgctgcaattttattttaatttgagaaataaagatttcctccaagccacatgaggactctggcacccacccacaaagcaagacctgtatttataagccgagggctcagggagcctaactgcgggacccgtcagggccccgtgacccatccccgtccccacccccccctccaccgctgggcccatcagtgtgtgttggggggatgcttggcagctgggggtgaggagacaacaaacctcgggaactggagccagagctgcggcctgactgacgccttttgatgctca

SEQ ID NO: 160 - DNA, 1187 bp, Homo sapiens
tcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaatttcatggtgtttgaattgaagtt

SEQ ID NO: 161 - DNA, 1176 bp, Homo sapiens
tcacggctcactgcagcctcaacctccttgggctcagatgatcctcccacctcatcctactgggtagctgggaccacaggcgtgtgccactacacctgactaattttttcaatttttgtagagatagggtcttctgtgttgtcaaggctggtcttgaattcctgggatcaagcaatcctcccgcctcagcttgtcaaagtgctgggattacaggcatgagccaccacacttggccccaaaactttatttaaaggaacaatttaatgtgtatttattgtctctcccacccacctaatatggctggtgctttaaagaacctcagtacatgattgatgggtagatgaaaatatttaagagtaaactttattctgcggaatgctggcatttcttaaaggaaaaattcactcagatgattgcattagatattttagcaaaacatatcctaatgtagtcacacttttttttttcttcaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtactgttgatgtcttttgtgtgttggagctcatcataaattcattagtgagcacatagataatttatttacattttcctgttgagttcttaataacatgattccatctggttcaataacttagaattttgaactgaacatttatttgtaaaactcttgaactcttaggtcatgagtacaaatagaagtcccttctcttagaaatcagaggccttgctcacgcctgtaatcccagcactttgggaggccaaggtgggcgcatcacaaggtcaggagttcaagaccagcctgaccaatatggtgaaaccccatctgtactaaaaatacaaaaatgctgggcgctgtggcgcatgtctgtaatcccagcactttgggaggccgaggtgggtggatcacctgatgtcaggagtcgagaccagcctggccaacatggcgaaatcttgtctctactaaaaataacaaaatttagttgggcgtggtgggtgcct

SEQ ID NO: 162 - DNA, 1156 bp, Homo sapiens
acatttagagagggccccggagatgggagcagctgaagatgatgtggacgtgatctcaaagggaaatgggagggctcaagctggagggcctatcttgcattctggggacaggtatcttttttgtcttattttttttaagacagagtctcactctgttaccctggctggagtatagtttcatgatcatagctcactgcagcctcaacctcctggactcaagcaatcctcccacctcagcctcctgagaatatgggaccacaggtgcataccaccatgcccagcaaagcttaagataattgccaaaatcatggcgtaagggttacagagcagtagaacagtctcacgtaagaatgagacaccacctgattcttagattctaaatgtcacaggaccctggaacagcacaacagcatcttgggcacagagacgggggtggtatgagatggggccatggggagaggcctggatttcaatcttagttccgctgctcattagctctgggaccactttgtaccccatctcaagagtgggagaactgtgtcttccttcatgggtgcaggggagtacttgatggcctgatggggaccgtgcatggcagggtgccatgtgcctcattataagtgatggctgcatatgcaaggacagactgaaatacaatgtcagggctaaaaggactcctccgaaacttccaggcctctgtctggcccttggaatcaccattaaagcaaccctgatggcaggccccgtgccagcaagactgggcagtttggtctctgctacatcctcagcacctagaacaagtcttggctcagaatcaatgcacaattaaaactgctgaatggatgaacaaatgaatgaagagtaagtgaagcttaagtggaagcagcaccagtgactgtggccttggatgaaaagatgggagttgaaaccttcaccctgggatcactgcacctccgttttcccggtggtgacgtccaggagcagttgttgctctccagggtcttcagggtctctcccaagtccctccccacgaggtccgatgataagcctgtctctctggggagctgggagggccaagaaagctaagaagggtggcaatgggtcaggtctgagtggggctggcagcagcgacagcggaggcctccccagcagggct

SEQ ID NO: 163 - DNA, 1193 bp, Homo sapiens
aatctcacgctccaacctccatcccactgatggggcataaaggtagaagacaggactcttatttttttttttttttttttgagatggagtcttgctctgtctcccaggctggagtgcagtgacacgatctcggcttactataacctccacctcctgggttccaacgattctcctgcctcaggctcccgagtagctgggattacaggcatgtgccaccacacccggctaatatttttacttttagtagagacagggtttccatgttgggcaagctggtctcgaactcctgacctcatgatccacccgcctcagcctcccaaattgctgtgattacaggcatgagccaccgcacctggccgaagaggggacttttaattggcaagttcatcaccagttaagcagggctctgtcccctccagtttaatatggtctctctggtgtttacaccattgccttgggtgaatgctcaatgtttcaagatttctcccccttcccatttctcctccaaatatggcagcctaaatgtgagggtgatctggctgtgacatctgtcaccctattgatcgcagggttgattctgctgatctggctggctaggcgggtgtccccttcctccctcaccgcccttgtgcattcctccggaagctgcacactcagtctaagaggacaaccatcctcgatagaggactgttcttcagtcaagggtatatgagtagctgcactcttcttctggaaccttccaacaagttctcaaggtccaaatatggcagccaggaaaggggcaaatggaggaacctgggagtctcctgggagcagtgggtggggtctcctgtcgctgtgttacacacctggtccacggtggcacccattcaaggcccctcttcctgctcctctcagcactggccacagtgcatcagccacggaatgggtctcaccaacctggtcctgagccagcctctcctgctgtggcccaggaagccccccttccctcctggccacaaagtgccccgctctgctggcctcttgatcccaggcgcatgctggagttctgggcctcctgtgcacccagcccaggtcatgaggaccccccagtgctcagtcaacctcacgtaaccagctccctctttctacccacgttgtgttttcacccccacaatcccgcctccttccccacactggataagtggtaaggt

SEQ ID NO: 164 - DNA, 1144 bp, Homo sapiens
gttgatatgatgttagaccacacttggctcaatatttagaagtaagggaggaatttacatagtgcagtggagaagtatgaaattctttttacaggcttaataattttttttttctatgctattagctgtcatacctggggcttattaagagtcatgctattatacagagttaggtttgggagtagagaacttgaccaagagctgcaaagttatggctgggctttgggtaggaagaaaaaaaaggaaggaagaaaaaaaaggaaggaagaaaatgggttggtgggacattggatatagtaagactgttctgaactctgtaacataaatgtatgtctgtctccctcatttggcaagaccttctgcagtgttcctgcctctgtgttgtttgttaattagattgtaatgtgtgaaagggcacaacactatcctcttctgagtagcatctagtgtagtctggtgcccacaacggttgcccgttattattagttgatgacgattagtgaagctgaagctattttttaaacagggcccaagggatgcagacagtgatgaaaacgacaaaggtgaaaagaagaacaagggtacgtttgatggagataagctaggagatttgaaggaggagggtgatgtgatggacaagaccaatggtttaccagtgcagaatgggattgatgcagacgtcaaagattttaggtttgtatgttttacacttctgatttttgaatatgggctatgggattttgtttgttttgatttagttttactttgattttcgttttcttcccctcttcatgttttctttttaagaatccaatctagtgtaggctatgctacaaagattgtaaattaactggtgaggtggaattttctaaaaggtgtcaatgcctgaagcgttgccaaaatgatagattttgcatttgcatagaactttaaaatctgaagaaagattccagagaagactatttcagtgattctcagatattaaaatcacctaggatagatgccttggaacctttcttaagtttctcccaaattaccgtattagagagctatggttactaatggaatatgtcatatccctctggtggtttagagggaaaaacagttgagaacttgtgcattatctcatttgagtctcatgagc

SEQ ID NO: 165 - DNA, 1157 bp, Homo sapiens
caaaagccaatgtcgtgtattacagtacaacgtaagcatggaacctcatgatgacagtgaattatcagaaaagaacaaattatattgtttttaaaaagggcagtaaaatcatattttgttttagtaatactaataaaatatattaaaaagaaatccttttacttataaaggggtaaaaattttatccactcagctagttaaaccagataagctagataaactgttgtattcctctgctatcctggataaatgaggagtgtgttccatttccttagcttatgttgaatatcatacagtgagggacatgataggaggttttggctcaactgaccatggcaagtttcctgattccattggttatccatgagacatcactcataatttgtttgagcctctggctgcactgtatcatgcttgtgtatcttttttgtagatcattcagtttcccagccaatcatggtgcagagaagacctggtcagagtttccatgtgaacagtgaggtcaattctgtactgtccccacgatcggagagtgggggactaggcgttagcatggtggagtatgtgttgagctcatccccgggcgattcctgtctaagaaaaggaggatttgtaagttggcttgaggaacttgttcctatctctctctctctctctctctctctctctctctttttttcccctaaagcaaaacatgcctgtttagtttccttagatgttcacagcattaattacagggtattttcaaacaacgtttgttgtaaatagaactcagcaaacatagtaggagatgtaaactcaacttttaaaaactaaagtaataatgttttggtggggggacacattgatagtattgtgagataagaactgaaatctggatcaaagttcattggtctatcagaaaacaccatttttactttaaaataaaagcaaaaggggggtggtgaaggaattaaaaaaataaagctgatgctgggatgttaacagggaattccagatttgagagcagtgatttgccaatacccgagaaaccttaatatagatcagattatagggctattcttgttttgttagctacgatttaattatagaatcctctttggccctccttgaacggctttgtttctcacacctggcctgtcaagaaattagggatt

SEQ ID NO: 166 - DNA, 1179 bp, Homo sapiens
gtcccgcaggcccccgctggccgtcacatcccgggtgatgacagtgactgtgcgcccccctacccagcctccagctgagcccctcatcactgtggagctctcctacatcatcaatgtgagtggagatccatgcagagaccttgggtgcacctcaacctgggtggccagaggcctggctggtgggaagcactctgtccctgatggtgggctgaaccctggacctgtgtgggagctgctgtggcccccatggcatgggcagtggtggggtgtggtgagcttccctccctagactgcactcatgtcttttgctccccaggggaccacggatccccattgcgccagctgggactactccagagcgtgagttgggtggctcctctgggtgaggaagggagcagccctagggccctttgccagaaaggggtctcctgcctaaaaggcaagagggatttttggtgccatcctagcctaaggggtcaagaacgtatcctgggactccctgctgttgcctcgtggatgtggccttactgtggatttagcctgtccttgggcagtggccaggactgggggcagggccacgtagctggcctggggctcactgaatctctcccctacccaagagatgccagctcaggagactgggacactgaaaattgccagaccctggagacccaggcagctcacacccgctgccagtgccagcacctgtccacctttgctgtactagcccagccgcccaaggacctggtgagtggaacagaggtgcctgggctgaataagggaggaggccctgggcttccagcagccatcagtgatggtgttggcaggcgcctgggtgatcctgaatgtgcatctgcaggtgcgcttgtgggattgtacgtggatgtctgtgcccctgggattgtgctcacagcaatgatatttgcctgggggtatgcggcagtggccagttgtgtgtgtgtgtgtgcacatgtgtgtgtctggttgtgtgtagaagagtgcaggtgactgagcataaatatgtgtccacatagatacccgggtctgttctgtgcatacatgagtacaacagcaagaaggtgttgcccttctgcctgtgggtatgccagtctatggtagatgaggggacagggcacccctgcagctcccccctcccaggaacccatctgactgtctgcc

SEQ ID NO: 167 - DNA, 1159 bp, Homo sapiens
tacctaccctgcgcccggcccggtccccgacttagggatggcaaacttgcgccccgtggccgcccccgccagcgccggcccccgctcctgctgctgacggcgcccaggtgagtgctcggccccagaccccgacctggcctcgcaccgagccctgccggcgcggtcccgagtttccgcaccggcccggactcggggcgctctcctaacccgtctctgctgaattctcccccagcccgaactgagttcgttcagcgttcgcccacccccatcttctggggaactcccaaacctagggccgaggcccccttaatcgctggtgaatctctaatctcggccccccccctcccccagcctggaccgaccctcttacccatctatgctaaagtctccccctccagaattctgacacagaccgtgcttgctgtctcgagtctttccctatctcggcctggatccgggcagtgtgccccccacctttattagagcccccccattaacctgcagctcaactgtgtctccccctctatttcccgtcacggtctgaatgccggaccctgctcctctcctccacttcatcactgcccggagtctttcctgtccccatccatgtctgcccatagtttctaccctcccccgcgcctgtaccccgaccatgcttcttctctatttctgcccctagcgccccctcccccatatctatctgaccggagtcccgccttccctcgccaatcttgctgcaagtcccctcccctcagcttggaattggggccgtgtcccccgtgtctgctccgcgccccctcccctccagctgagatcccgactggacccgcatccctgactcccgtgtccatctttggccggagtctatctgtccatcccccatccctatcctcccacccctggtcatagagctgggcaccagacgcaccctcccgcagccccagggccggcatgatccggagggggttgtaggctgtgaagttggcggccactcccgcagtcagcttggtccgagggcacagccgggggaagtcctccgcgccgcggcccgtgcagagcaggcgacgggtctgttgcccgccggggggaggggcgcccgggccgagagatgccgcctgcctgcccgcctcgccagctgccggccgggctcctgggcgtc

SEQ ID NO: 168 - DNA, 1404 bp, Homo sapiens
agcctttttagatttgttcccttctgtccttccactcaaaactgaaaaattgcccaggctgcccaagagggccaagccaagtagagagcaaggaacaccaggggaagtgtcaagacattagaagaaactcagtgtttttggtgatctttactatgtgacctatccctgcttatccctaagtgctgtcgccacatggtttataaactgtctttgttttccccacaggccaggacgactggaatgggaccaggccgtcgctgaaggcccctcctgctaggccagtgaagggagcatacagagagcacccatatggacgttattaaaaacaaacatgaggggaaaatatcagttatgagcaaagttgttactgatttcttgtatctcccaggattcctgttgctttacccacaacagacaagtaattgtctaagtgtttttcttcgtggtccccttcttctccccaccttattccattcttaactctgcattctggcttctgtatgtagtattttaaaatgagttaaaatagatttaggaatattgaattaattttttaagtgtgtagatgcttttttctttgttgtttaaatataaacagaagtgtaccttttataataaaaaaaagaagttgagtaaaaaaaaaaaacacacaaacctgttagtttcaaaaatgacattgcttgcttaaaggttctgaagtaaaggcttgttaagtttctcttagttttgatttgaggcatcccgtaaagttgtagttgcagaatcccaaactaggctacatttcaaaattcagggctgtttaagatttaaaatcacaaacattaacggcagtaggcaccaccatgtaaaagtgagctcagacgtctctaaaaaatgtttcctttataaaagcacatggcggttgaatcttaaggttaaattttaatatgaaagatcctcatgaattaaatagttgatgcaatttttaacgttaattgatataaaaaaaaaaacaacaaaattaggcttgtaaaactgactttttcattacgtgggttttgaaatctagccccagacatactgtgttgagagatacttagagggagggagtaggttttgaagaggttgatggtggtggggagggaaggcctcctgaattgagtttgatgcagagctttttagccatgaagaatctttcagtcatagtactaataattaaattttcagtatttaaaaagacaaagtattttgtccatttgagattctgcactccatgaaaagttcacttggacgctggggccaaaagctgttgattttcttaagttgacggttgtcaatatatcgaactgttcccaagttagtcaagtatgtctcaacactagcatgatataaaaagggacactgcagctgaatgaaaaaggaatc

SEQ ID NO: 169 - DNA, 1210 bp, Homo sapiens
acaggctgactggggcattaggaatgtttgtacctctctgcttccctggcagcctggggaagggtgcagggctcagtgcgctaaaccatggtaaacatcttcaatagaactaccctagaatttagtgagtgtgagactgagatattgctcagaataaatttattccatagccatttaggattgcatgttctggaccaaccttgtccagtatgttttctgtttgagctttttcattcttttgttaagccaacaagttgagaatttggccctgctgggatccatgtagtgggcactagctgctctttggccaaggccttcataaatgattcagtctctcattatctgtcctctagccccacaccctgatttagaccgtggcaaaggaagaacttgaggtcaagaccaaccaaatctgtgaattaaagctgttatttttttctctgcaagggcgctttgcttcaggtctgggctatgtgcagaacctaagcaggctgtgagagttagaagaggcagtattacatgttaggcccagaacaccatgggaaaaggtttatgtagtgtatcttagtggcctgcctagctgcctctgggccaggctgacttctgatgtccacattagctcgtacctgaaccctgttgctgaatgccagccctgttctcctgtaactattatatacgccatggcctggggggcattgaaggaagtaagctctcagagatcctaacactggctgggaacctctgactcagagcatgtctttaaagagtccacatctggccaggcgcggtggcacatgcctgtaatcccagcactttgggaggccgaggcgggtggatcacgaggtcaggagtttgagaccagcctggcaacatagtgaaaccccatctctaataaaaatacaaaaaattagctgggcgtggtggcaggcgcctgtaatcccagctacttgggaggctgagacaggagaatcacttgaacccaggaggcggaggttgcagtgagccaagatcatgccactgcactccagcttgggtgacagtgcgagactccatctcaaaaaaaaaaaaaaaaaaaaaatccacatcttcagctgggcgcggtggctcatgcctgtaatcctagcactttgggaggctgaggcgggcagatcacttgaggttaggggttcaaaaccagcctgaccaacatagtaaaaccccgtccctacaa

SEQ ID NO: 170 - DNA, 1149 bp, Homo sapiens
agtggtgcctgggtgcctggcctccagtgtcccacctccttcaccaccccacttggctcctttgccatcttgatgctgaggtttcctgtttggtgagatcaggttgtttgtggtaaaagaaaggaaagggcttctgatggctttgccacaagcttacctgtgggtttcagtcctgagaggccaccaccagttcccatcagcactgtctccatgcagcagttgctgggtcccatgtccagctgcctctttggcttcatgggtttttctgcttcctgcccccacccccacatgtgcaatcctcaagatttgtcctgattctatttcctggcacctccctgcctgtccttggggattctacttcttcctgtgtgggagcccatagctgttgtctaacaggtaagaaatgaaattgaactattgactgggccccagaaatccataaaatggctgcagacagttgtttctgtgtcctgttctacccccactccagtacataactactatgtactgtgtagagccattctatatgctgaatgttctgctgttgcaaacttgccagggtattagccagtgtttgtgccaagcagttttctgggacaacagaatgactcagaccaagatggataggatggttagggctttgcttcttgctgtttttctttgaagctagttcattgtcctgcaggtcccttcatcttccatacctagcccactcttttagcccttaccttaaatctctcagataagttggttcacaaagaatgttaagtactgaatcatgtgtgactgagaccagagatggcaaatgaatggcacaccatttctccttctcctgccccagggcaggtaccactgatctgcatcagagttgcctgctattctctggtgtatccttcacatctaggtgccctcaagcagctgtgtgagtgttgagatctctgccatctctggctgagatactgctgtcctgtgaagtgtttcccatgacctttttcttcccctttgaatccctctgtctggagtagtccttgcctcttcctgctccagtagggccttttccctaccccagcccctgtgccaggctaagctggtacaagagctgccaacctcacagagtgtttgctaggcgagagaggtgcagggaagagg

SEQ ID NO: 171 - DNA, 1194 bp, Homo sapiens
gtttcaccatgttggacaggcttgtcttgaactcctgacctcaggtgatccgcctgcctcggcctcccaaagtgctaggattacaggcatgagtcaccacacccggcctggccattttcaagatgagaaaactgaagttcagaggagagaagcactgtatttgagatcatatagtgagacagtggcagagcaggcaccagaacccagacttccttactaccagctgctcccacttggataagacatcagagatactgtttttctggactggagctcaacttggccttttattctttggagccgttgggagtcccaggagagctggagctaacaaatgaggatgcctttacaagccgcctgactcctctgttgcttcccttcaggaagggaggagaatccaggagttggtctttttaccagctccctgctgtttcccaagaaataaacagaagagggcagaatcagccttgctacaggctgctgagggttcctggggcaaaataggaagccattgctcttactgggatgtgtactatcctgtggtttgacttttccagatcgtcaatgtatggtactctgtgaatggtgagaggctgggcacctacatgggccataccggagctgtgtggtgtgtggacgctgactgtatccttattttgggtctgagtccgtgttgctagggtctgtcagcgatggagaggctgagttgggagttgggagttgggggtgctgttgagggcctagagaacgatacctcctactccctggtctcttcactgactgaggaaacattcaggacaaattccagttctggataaggaggtaagaggggtagaaaggctctttggggctgaacagggagatgattcacttggcatcccaagaggacaagggctcgggtgaacttcgtcatatttcttaacaactcttcaggggacaccaagcatgtcctcactggctcagctgacaacagctgtcgtctctgggactgtgaaacaggtaagctgggttcattcacctttttagcaaatattgaggacctacagtgtacctgtttgagtaaacaggtcctaggaaaatagagatgaaatccatagatagtttccagtctagggaataagagacaagaaagatagatgagaaaatacacgccatggtagaggaagcatagattaagttttctttttttttttt

SEQ ID NO: 172 - DNA, 1203 bp, Homo sapiens
ggccgcggagctggggcccggcggggagcgcactccacccgccgacccgacctcggtggcccacggtctttttttttttaagggggagccgagatgcgggagagcctggggtgggtgggggccacttacacaaagcgggaggctgggaaaataggccgtccaggtgcagagagacagcgccccggggcggcttcccgcccaatgtcgcctagagcggctcgcccgcctgcccgggatccgcacagcagatccggagcggttccgcgcggaatagagagcgcgccccgggggacgggggtgggggccacgggaccccagcgcctcctgccggtcgcgccctctgcgcgctcgctccccgcgcgcccgtgaggggcgagagggaggtgtttgacgggatcctgggtgtgggtgaggctgaagccagactttcgggttgcagtagaatcgaatcgaggaccccttcctctagaagggatcagaagcgggctgggggagggggagcccctgccctcattgctattccctctgccctgcaggagaatggccacgtgaaaagcaatggagacttatcccccaagggtgaaggggagtcgccccctgtgaacggaacagatgaggcagccggggccactggcgatgccatcgagccagcaccccctagccagggtgctgaggccaagggggaggtcccccccaaggagacccccaagaagaagaagaaattctctttcaagaagcctttcaaattgagcggcctgtccttcaagagaaatcggaaggagggtgggggtgattcttctgcctcctcacccacagaggaagagcaggagcagggggagatcggtgcctgcagcgacgagggcactgctcaggaagggaaggccgcagccacccctgagagccaggaaccccaggccaagggggcagaggctagtgcagcctcagaagaagaggcagggccccaggctacagagccatccactccctcggggccggagagtggccctacaccagccagcgctgagcagaatgagtagctaggtaggggcaggtgggtgatctctaagctgcaaaaactgtgctgtccttgtgaggtcactgcctggacctggtgccctggctgccttcctgtgcccagaaaggaaggggctattgcctcctcccagccacgttccctttcctcctctccctcctgtggattct

SEQ ID NO: 173 - DNA, 1175 bp, Homo sapiens
ggtggtgcatgcctgtaatcccagctactcaggatgctgaggcaggagaattgcttgaacccgggaggcagaggctgtggtgaaccgagatctcgccattgcattccagcctgggcagcaagagcgagactccgtctcaaaaaaaagaactatttccttatgtgttttaacatttttgaatcattcattcaacagcattaattgactatctgttgtctaagagctgttcaaggagctggaatacataagtaagcaaaataggcaaagtctcttctctcttggactttacattttagtaggagaagacagataataaacaaatacataaaggtacagagagtgagaaggagtgcttatagattgttaaaggaaagcctgtctgataaggtgacgttggaacagaaacctataggaagtgaaaatgtgagctctgtttatctgggggaagaatgttccaagtagagagactggcaagtacaaaggctgtgtggcaggaacataccttgaatgttcagaaacaagcagaggtcctggtagctagaatgcagtgagtgaggagcagagcggtggagatgaggttagagaagtactgggatggggagcatgcagatcatatagggccttttaggttatgagaagaactttggagttggatgataaaccattggaaggttttgtgcagaggagtaatgtgatttcacttacgttttagaaggatcactgtggctgctgtattcagactaggctgaagttgcaaggaagctattaaaatagcctttagggtcaggtgcggtggctcacgcctgtaatcccagcactttgggaggccgaggcgggcggttgaggtcaggagttcgagaccagcctggccaacatggcaaaatccgtctctactaaaaatacaaaaattagctgggcgtggtggcaggcgcctgtaatcccagccactcgggaggctgaggtaggagaatcgcttgaactctggaggccgaggtttcagtgagccgagatcacaccactgcactccaacctgggcaacaagagcgaaactccatctcagataaatagcctctagatgataagtgatggtgacttggatcaaggtggcagcagcagtcttggagagaagtggtgggattttgctattctgaaggtaaaaccaacaacatggagtc

SEQ ID NO: 174 - DNA, 1162 bp, Homo sapiens
cgttgttgcaaagaacatgatctcattcttttttatggctgtgtagtattctatggtgtatgtgtgtcacattttctttatccagtctaccattgatgggcatgtggattgattctatgtctttgctattgtgaatagtgctgcagtgaacatacccatggatgtgtctttatgtgatttaacccattttataaatgaaaaactgatgtccagacaggccagacaatttctatacacccaggtggaaacaaagccaggattagagttccatgtcccaactccattgtgcatgtgttgcctctcatttttcttggatccctgtatattctcctaatttgataactaattgtttcatgtgagtttttcattttcaaaatactaaaatttttactttctgctgattgttgctagagttaatgattatgatttcaatatcctattttccttttttttttttttttctctaaccccaactttagggaacagaagtcaaagcaataacatattcagcaatgcaggtctataatgaagagaacccggaagtttttgtgatcattgacatttaagacaccaaaaaataaaagactcctacgaagaactgtttttgttttcctcttccttttgagaagacactatgaattaaattctacagcttttttttgatatatggaaatttgtagaacagaaatattttagttaaagtgtgactttcagaaagggaaaatcagggcacagccttggtctgtgttccccaaatattcacactttaaagaattcttcaaccccccaagggacagttatggtcctttgattctctgctgtggcagtaggtgtgcctcatgcccttccagtgcaatgcaagccctccagcctcaccccagagaggatcactgatgtcagcagcagcctgaggctgaatccaggttgaaagaagaataacttgaaaaaatatatttccacacacagaattttgtttttcttccaagttggttaagacatatattttgtttcttttttttttttttttttgagacggagtctcgctctgtagcccaggctgaagcgcagtggtgtgagctcggcttactgcaagctccacctcccgggttcacgccattctcctacctcagcctcccgagtagctgggactataggcacccgc

SEQ ID NO: 175 - DNA, 1108 bp, Homo sapiens
gtgactgggatcactcaacagcactgtgatgtattattttcaatgaggtgcctttcttaactgaccaaatgctgccttgtttggcccctaaatcaataaaatatgttaaaatttgtatcccctgttgtggcattttttttagataatctaagctagaaaaatgacattgaattctggacctggctggaaggaaaagaagccctttcttgtcgctggcagctgtgtggtagggaggtccaagtatgtgcatatgagataagcctgcaacctcttgaccttcagctcctatgcaggcttctcttgagcccagagacaaggcagcttggtctagtggagatagcactgtgcttggagttcaggggacctaggacaaatcccagccagttagttattcactgtgctcctgtttcctcagctgaaaaaggaagttggttatgccaccttcttggccttaatggcattaaatgaaatttataggaagaaggtttttgctcagtacctggcatgcaacagacattggataaatgttagttggatccagatatacacagaaagatatctgcttcctgccaggctggataactgttgaatggacacttgtccatagtctagaaagccagtgcttctaatccttaagccagatctttgactaccttttcagttgcttctttaacactctttgttgcttctctgtgtgtcctagtttaaattcatttcctctccagcaaaagtgagcttaaataatttctccaaactaaagctctcatgtttttggaagggctgcctttgcaagtgaggtttctgagaaatgactgttgttcccaaaacaagagggagctgggctggaagcaccactattcttctttaggcatcttgttacagagagaggcagggtcttcactgacatattaaatcctgttccctgaaccagcccctccctcttctgctccacttcctcacctgtgcagagtcattttcaggtgttagccttactgatttgcactgatctgtttgttccctgagctttttaaataccctgtgaaaattttctttcctcccttggtcatcatgcatctaattgtggggaaatgtttgtcaaaccaacctg

SEQ ID NO: 176 - DNA, 1202 bp, Homo sapiens
gggctgggtggcgggcccagggaaatggggtggggatgggctgggtaagacctggccctcccctgctgccctgaagaccaccccagtctacctcggtgctggccaggaaacctttcggctacctctcccaccatcccagactgtgggcagggggatggggagggagtgggcctggatctgggacctccctccagaatttcctccagatgggggcagtgcccagggaggggttatttgtcttccctgccatggagtgggaatccccagccgaggccctaggcccctcagcagggaagggatccccggggaggcaggtcccaggagcagaccctgcccccagcccccacagacacaccccaatctgaaagccatgcgtgtcggtgtatataggaaccatgtacagagcccagagaagccccctacatccccccgggaaaaaaaagaaaactagacagaaactcatctatatattctgtatctggagttccgttttgaatattaactgtgttatttttatacactttttaagccttaactcgccattgatttaccagtttaacgtttcctggggtttctttgcccatggggttctctgcccccacccccggccctttgtttgacttgcgtcgtctgatactcagtattgtagctttttgtccgcatgttactccctgtaaatacgctgttatacatactgttaacacccctttgctttttctatgggacctccaggccaccatatttagaactagttaccttattaaaaaagaaaaaacagtctgttggcttctcagtctgcatcttggaggcagggaggtgagggcaggtgcccctcagacacttcaggaaggtagtttgcattctatttaaaaaagggagtggggagcaaatgaaaatcaaatgtggggggaaaacactaaagggggcaagaaacaaaggaattacaaaccctctgctctttgtatttctctgttgtgaagaataaactgtacctgcacccgggtggcggtggtgtttggcgtgctctgtgcgagggcagggctggggggcacctttccattgctcctctcccctcccccgccccccagacttggagaaggaagaaagtggcctctcactgtgggctggcctcactccaggtgctgaactgagtgctttatgttgattgcctcacaactccctaagaagtgggcagcaaacca

SEQ ID NO: 177 - DNA, 1175 bp, Homo sapiens
ttaggctgcaggcctgggttttctattatttattcttctggttaatctgcatttttttgatttaggcaatcactgttatgcttagctgcctggaagtaatttggataattcttcactttttaaatttccctaaagtgagcctttatgtaaagtgcaagttttccttcttaatttttgtaaggcagtttttttattttaattcttcttttggctttttatatatgggatggggccataaaataatgagaacttctcaaaaaacaatgcctgaaattagtcttaataacttcttaagggttacagaaagcaagacccaagccagatattgtagcttgtgcttgtagtcccagctattcaggaggctgaggtcggaggatccattgagcctgggaatttgaaacaagcctgggcaacataatgagatcccatctcaaaaataataaaaaataaagttccatctgtattcagtcactctttcagatgtgtctaaataaaacatgtttagtttcacccagaagaacatgcagatgccctcaggaaattggtgcacgatgtatacaaagagatttaggtaataaataatagagactgtcggggtctgggtggagaatgtctgcctggcctaaagacattgaacgttagactggaccatattcaaaggcagtgagtgaagtagttaggcactcaggtgtggacccagattgcctgggtttacatctcagctctaccatcagatctgctgtggctatgtaactctaggtaggtcgatttacctcattaggtctcagtcttgtcacctgtaaaaagcaggcacctcaaagactactgggagcattaaataaattaatacacataagatagttagaccggtgtctgatccagatgttaagcagcagttgctgctgctgctgctgctgttgtgtgatgatgatgatgatgaagatgatggtagtggtggtagtaatgctgccaccatcacattacagaatccaggatctcttacactaaggcccattctctcttggagcacagaggtttgggaattatctggaggaggaaagcaagaataaaagaacaaatatttgtaagtgtttactctgtgctaagcactgtgttagctgccagtacatacaaagtcaaggtttccaatgtcaaccagactctcaaaattttcc

SEQ ID NO: 178 - DNA, 1186 bp, Homo sapiens
gcctccacttggtgtctggtcgagagagccctatctttgggaatccaggtggctcccttcttccagtctcactttgattgtgcccccttttaaattcttttctttcctttccaagggcactttgtcactgaattcttcctctagcaagtctattagtgttctcagctagatctttctttcccacaggctggctgaaatcagccgttgcggtggctgtaagatagtatatgtgctcttgcctctgctcgggtgacattagatagcaaggtttatgtggacgtgggtatagacaggtcagggttgctgggatgaaccaaggtgcagaccggttttcttccatgcttgctgattcaccttggaggcatgtgaccctctttttgactggccttccagtcacagttcactgaaacacatgagtgagtggatgtgcttggggctttttgctccccgcttacccccgtctcttcccagcccaatgatggtggtggctttagtatagggtcctctccgagcacggcaggaatcacttctctccctgcagcggttcagtgtctggtgcttttccactctttctagactctttcctgtgcctgttgctgtgttagcacaagtcggctgggcagctgccagaacaagcctgccagggagccttttgactctggtcagctccccagggctccaggctggtgggactgccgctgagtgaaacatcatggaattagccttgccagagtctgggttgggagccaggcagtgaaaatgtaaaagcccctccgtcttgctcacttttccttttctactttgctttagatctctaagcacttgtagggtagggagccagggcagtgtagcagaggaaaaataaagtggattctagagtctgacaggctcgagttatgaatactgccttaacaattaactggatgaccttgggcaagtcacttagcccttctgaacctcaatatcctcacctgtaaaataggggtaagaatttttgttgggttgttgtgaggatgaggtaattatgtaaggttcttagcatagtacgctaagaactttatatacattgtcacagactgtgctaaaactttacatacattacctcatcctcacaacaaccagtaggtactcagtaaatgttagcagctttaattgtattgcaggaagaacctatgtttcctgcaat

SEQ ID NO: 179 - DNA, 2443 bp, Homo sapiens
ggtctttgtcacttcattgagtgaattgaatctctggttgggcttgttaggcttacttggaaattaaatttccgttcagacgttgaaagtgagagtttgcaagtttttcagtgggttaatctgatgtgaaatttcttagaactcattttggaatggattttcacatctgcactaattcttaaattttttagcactacagggaagatctgttctttgaaacaggtgtatgagaatggctcaagtgggaacataccacaaggcatgtattaccgtaaactaattttcaaattacccttttttcctttctatgttcccggtacctgtggatcgactcattggtgattgtatcgacgaacgttgactacggaaccttctaaaatatttacttaacacacatggacatcaactacttataatgaactgttaattactgttccaatagcgtactgagcgctttgggcagggaggtgcggggcctgtgggtggacagggtcctagaggaatggggcctggaactccagcaggatatggtagagggagagaagagtacgaaggcccaaacaaaaaaccccgattttagatgtgatatttaggctttcattccagtttgttttgtttttttgtttagataccaatcttttaaattcttgcattttagtaagaaagctatctttttatggatgttagcagtttattgacctaatatttgtaaatggtctgtttgggcaggtaaaattatgtaatgcagtgtttggaacaggagaatttttttttcctttttatttctttattttttcttttttactgtataatgtccctcaagtttatggcagtgtaccttgtgccactgaatttccaaagtgtaccaatttttttttttttactgtgcttcaaataaatagaaaaatagttataatattgatcttcaactttgccattcatgcttctatgcatattaggctacgtattccacattgaaagcatgagagtgtctaggcctttgaatggcatatgccatttctgggaaatgcatctggaggctaagtattgctttctacaaataattgccccctttgttttaaaaagaagaaatgcatattgaagtagtttgatgatttgtttggcatataggaagcacgctggtgctaagtattttttaaatggttatgtaagcaaagctgaactgtaaatcttcaggaatatgtattaagattgtggaatgggtgtaagacaattggtagggggtgaaagtgggtttgattaaatggatcttttatggccctatgatctatcctttacttgaaagcttttgaaaagtggaaaggtcattttgttgcatttccccatttcttgtttttaaaagaccaacaaatctcaagccctataaatggcttgtattgaacttttacatttgaattaaagatgttaaacatgaagtcttttcatgtattcaagtgatttataaagatggggtgtagtctaaaaaacaaaacttgaaagtaagaaggtttagtaactgggccgggcgcggtggctcacgcctgtaatcccagcactttgggaggctgaggtgggcaaatcatgagatcaggagttcaagaccagcctggccaacatggtgaaaccccgtctctactaaaaatacaaaaaattagctgggcgtggtggcaggcgcctgtaatcccagctactcgggaggctgagccaggagaattgcttgaacctggagatggaggttgcagtgagctgagactgccactgcactccagcctggacaacagagcgagactctgtctcaaaaaaaaaaaaaggtttagtactgaagtaggtttagttatatatacatttgtactctgtaacttttacatctccttgtgctacttctgttgggcaaaatctataggactataaaaatctattggttctcttctaagagctagtggtgattgttaacaaatagggttgcagataatcattcttattgtaaatttaacttgttttcacatagtttcgttttcatgtagcactaaatctggagaaagttgctcatgctacacagtacaaatatcccttcctcccaccataaaggcttggaatgtttccatggtgttgtcagttaattgtcaacttcattgaacccccttccattagaacaagagactttgactattaaagtagattgtttattgttgcctgttagtataatgggagcctgatttcccagtgtaaatatgttagaggaacagcttcctaacagtaggtaaagtaattgaatggtttggctttgttctgagttacgttccattcaaatctgtacattgtagaattcttactatggaatgtgtcttcctccttttcacctcttttcttggtgctaattggcaaaagaaaaattctaagtcaaacctttattaacatgctgaagtttagtattgtgcctgtg

SEQ ID NO: 180 - DNA, 1099 bp, Homo sapiens
gctgtgggtatagtgcaggtatattgaaaggaatttttttcttgcagcgggaaagagacatgcgaatgggtggcggaggagcaatgaacatgggaggtaagtgtgaaatttaaattaatgatataagtagagagtagtatcctggtggagttgtaaccactatttttgttttctagatccctatggttcaggaggccagaaatttccacctctaggaggtggtggtggcataggttatgaagctaatcctggcgttccaccagcaaccatgagtggttccatgatgggaagtgacatggtaatgtatcctgtgggacgtagtaccaaggaaattctcattttcacaacttaggtgtgtttgttttgttttgttttgtttttttaagtaggtgactggacctcttttagtttcccctaccaatttcatacataaatatgtaatattgaggaatactttggcaacatagaagaactcggtgtgtggtaacctaaacagataacggttgccaacaaggagtcaatgctgttagtattatgtggaattacctttggcaataagtagatttaggtgcttttgaactctagtgcatggcaaatccaaattctagatgctagataatgtatctgattattctacatccaagtgagaataatcaaatggcaaactcattctttaagctggtatttgccataagtaggaatcagacttgtagtttgaagctttaggcacgttttagtgatgtgtaggactttgacctatatttggtgtggcttctatcctatgaaaagggaattgagtgttttgactcgtcgtttcccacctgttgggcctgtctgtaggtataccttctaaaatcaactgacatctccattttgctacagagtagcaaaaatcaacaatttttaagcatactaatggtgtgcatttgatctgaaccttcttgatgctatcatgtttcagctgtgaatatagcctgtcagatgcttagaacaatcagttgaactggtatgagtggctgcattagggctttacaaatcgttaggactgaattttggtgggtttagagagtgcatttttatagctgagttgaatgtgatg

SEQ ID NO: 181 - DNA, 1190 bp, Homo sapiens
atgcagagcatgcggcgtaggtttggagagaaccgggaagttccataaaagcgcaggcgcagatcgtgtaggttacagtggcatttggatttgtgttattttcctattttaattttcatactatttagatttttttagggacactcaacatatgtgggtgacagttgctgatggacgtctactctttggggaagtgtgtctattctcgaacattctggatgatggggctcctttttcaatgttaagatagtgctcatgttagaaatctcacatagtaaaaccttgattttgaccaaacggaacagaaaggcaactgataggtttcagataagcaaatactatcttggggattttcacttgcagaggtctctggtgtttgaaaacttctttcctttttcattaggggtttaaagccaatttgtctctcttgaggaggcctggagagaaaacttacacacagcgatgtcggttgtttgttgggaatctacctgctgatatcacggaggatgaattcaaaagactatttgctaaatatggagaaccaggagaagtttttatcaacaaaggcaaaggattcggatttattaagcttgtgagtgtaattgtttgattttacgtagaattaaaaagggtgggggatttttttgtcactacaaacgctgaaggcttggtttttaaactggggaggataaattgatcttttagatttttcaccattcttacaggaaaaatgcttgcggtataatgcataattgttgctacctaagagaaaagaggggtggggtgggtaaactaagtggtgttagtgggtgctgcctaaaggtaatggtcgaactgagctgaaggaagaaagggagtaggaagtaggcctatgacaatttaagagtagacatcatccaattttgaggtcattaacatgagtgtctctgatacacaggaatctagagctttggctgaaattgccaaagccgaactggatgatacacccatgagaggtagacagcttcgagttcgctttgccacacatgctgctgccctttctgttcgtaatctttcaccttatgtttccaatgaactgttggaagaagcctttagccaatttggtcctattgaaagggctgttgtaatagtggatgatcgtggaagatctacagggaaaggcattgttgaatttgcttctaagccagcag

SEQ ID NO: 182 - DNA, 1244 bp, Homo sapiens
gccctgccggccagggcgtgggctcccctcggctgtggtgcctcctctggccccccaggtccacgtcctttaaattggccctttggctcttgcccttggctcccttgggcagacagcaggcttaggccattgatatcgcagttcttcctatcagcttcagtgacccagggtctgaactgcctccatcctagggcaacctggggcagacaggcctggtggggggtggggaaacctccttccacctgagcttgcttgaagggacccagagtctttgggcccagatctttaaacctttgtgtcgtgttgcagcagagtgacgatgggggttggggggttatttattttgcctgtccttatccctgcttggacacctgagcatctgattcctgtccccctggtgccatctggcctggctggagccaggaacaggagggacacttccccagaatccgcatgtttccccagtgattacactccactgccaccgtggtgcctggctttaactcccacccctgctatgactcctctctgcagagacgcgactggcggctccagcagggactacctttcttataaacccagggggaccacacacacacacacacacacacacacacacacacacacacacacacacactcttgatcccttgcttccctcccccagtgcgttctgtgatcgccaagttcaaagctgtgcacatgtggacactcaataaatgttcattggtgacgagaagcctcctgcgtggtctgccctgcacctgctctctcccttccaggctccatcagttcacagctaccaggtgctgaacacatgccctgctaaacacatcatgagacctcattcagcccttccaagaatcctctgaagggttctgattttacagacaaagcaactttggcatggataagtgattggctcaaggtgttgccgctagtcagtgccagagccaggactccacacaggccatccgactccccagcccacatctttcacttgtacagcagattgccaaactcatgttgatgtggccaggccttgtgggggctctggtgctctcaagtacagatgaaacactgcacccccgcccccatgtcactgggttgctgccaagtggccctgccatatcctcccatttttaaagaagtcaggaatcctaatttgtatgtgaaacccaacttttgaatgtcagtaactatctttaattaaataactactgatccaacaaaacatgcagtcca

SEQ ID NO: 183 - DNA, 1168 bp, Homo sapiens
ctgtgtcctaaatcaatttcctgaagtttaaaaaacactgggaatgtacccattatttaacactcctggccaaacactgttcagaatggagttctgattagctcccatctgctttcaggtgattaatacacagaaaaacaaattattccttcccaggctcggggtgggaggggggataggttggagaagagagcagctgttttgcctcagggtagggaagctaaaccctactagagagggtatgggaaggcagaaacctttgagagatggaagaggccactgaaatgacccaagagcttggtcttgctagctgagcaactgctaggtctgccctgcctggagcccagagtcctttcacttctgctcccctcggccttttgaccaaagcagcagcagtgcccaagcaagagaaagaggtgcattcttggattctctctaaatgtctgctgcttgcttagtccagtgtgtaaattatgtgttagtgtgtttgggaggagaaacctgcaacttgccttcacttactttccttcatgggagggaatgttttcaaagactgcacttttcatatttattctggaacactatgatcctttaagagaaagtaggaaagtctttaaactccaaattggaatgcttacccagtctaaacactctccgtttaattcacagatacttgtttgcaaaaaagaagccatgtaaacaatctgtgtatactttatttttaatttttaatttaattttattattattattatttttagacagaatcttgctctgtcactcaggctggagtgcaatggcacgatctcggctcactgtagcctctgcctcctgggttcaagcaattcttctgcctcagccttctgagtagctgggattacaggcgtgcaccaccacacccggctaatttttatatttttgtagagacagggtttcaccatgttgactaggatggtcttggaacccctgacctcaaatgatctgtctgcctcggcttcccaaagtgctgagattacaggcgcgagccactgcacccagcccccgtgtaaactttattcatcatctacttttccttagggctagacccagttagaggctaaaacgtgatttattttgctgtggggaaaagaaaaacaacttaatgggaagaatcaaatgctgagacctc

SEQ ID NO: 184 - DNA, 1199 bp, Homo sapiens
catgaaacctgtccttgctgccaaaaaagttgaggactgctggcatagaagattcatagggcacagactttgaatatttatagtgtcgcacttaaaccacagtcaaattactcaacttctctaagccataatattctcatctgtaaaatgtggttaagaacaatatctgacctggcgctgtggctcacgcctgtaatcccagcactttgggaggctgaggcgggcgatcacttgaggtcaggagttcgaggccagcctggccaacatggtgagactccatctctactgaaaatacaaaaattagctgggcgtaatggtgcacgcctgtagtcccaggtatccaggaggctgaggcaggagaatcgcttgaacccaggagccagaggttgcagtgagccgagatcataccactgcactccagcctgcacagagcaagactctgcctaaaagaaaacaaaaaaaaattaaaatccaaaacacctctaatccccaggcatttcaggtagagaatgcccaacctatattattaatagataatcttgcttctttgatattttttaatgactttacttcatcttgtccaggccctctctgatccacccctaggaagaccagatctttctgttgcctaatcatgtaatcttgtttgccactcccattattttcaagtacactctagtttttttgtctctaatccgaggatgaactgtttcttttttctctttttttgagaccgagttttgctcttgtcacccaggctgcaatgcaacggcacaatcttggctcactgcaacctctgcctcccgaggttcaagcgattctcctgcctcaccctcctgagtagctgggattataggcgcccaccaccatgcccagctaatttttgtatatttagttgagacggggtttcaccatgttagccaatccagtcttgaactcctgacctcaggtgatccacctgcttcggcctcccaaagtgctgggattacaggtgtgagccgccgtgcttggcctgaactgtttctttttgttttctgaatcaaggttgttttctcattgggccccagatccaatcagcttagattaaaaggactgtcttaaattaaaagggctgttttaaattaaaagggctgtctttaaattgctgaaaccatgagttaatagtacttcttaccaactgggctttacctctctgtaac

SEQ ID NO: 185 - DNA, 1684 bp, Homo sapiens
tcttctattcactctgcttgcttgctggccggcctgcctgcctgcctgcctgcctgcctgcctgtctgcctatgtgatgatgaaatctctgcatggctgcaatgatcccactgttagctggcagggtcaggcttagctccttgactgcagaagaccaagaacctgttccccaagcccagagatgtccacctgggctggactgccctcaagcttatactagagaagagcaactgacctgcccaacttgtgtgaagtcaggagggtttctggcattttccacacctgtccactccttggagctggtttctctcattgctttttctaaatctggttctttttctctttacctggggcctggcttttctgagattgtcttagggttgagctatttgggtatcctgggtttgagtgttaggggatggacataaaggaaaaagagtgatgagaagagaatggagagaatttgaataaaaggtgggaaaggagagcactgttctttgattgtttatccagtccaacctgatccattagggatcgaggtgctacactggcctccagggataagcctggggctactgttgctgggaacttaggcttaacataaagccgaagaaggtacctagaaatttgaaacttccctaaaaagctcctaatgcccacctgctagatagcttctctgtggcctcctatttagctaagcagcagtgtttttggatactttttttttctgtttgtgaataaggccagcactcaagatgggcagccaagggtgcactgactattagctggcccataggatatctgtaaggctggtgggacagttttggacctggaatcatgtgtaactaacaaggttggacgtttcttccccatcagggtagaaaaatcatctcaaactagccaaaaggcagttttggaaactacattgggggacgttatttttatttatatatggggcctaggccaatccaggatggtagctggaataccttccttcttaaaatctgatcatggcagggatatgcagggcactttttactatttggccttctaagcagattgggaaggaggtattttctggttttcgctttcctccgacttaataggacttgccttctccctgggcagggagagaggctgggttggtgctctcccttactctactcatactgacttagagcctctggctgctgtttgggcatccaagaaagggaggggaaggaatgagctaaaaacaaaacagaatgaggtgggaaagggagattttcttctttacagaggaaaataggaaaccctccaagaattgtgcaagtaaagacatttgttgaatgcactgagtcccttggtgtagtagcaataaggaaaaatgaaattactttcctgtgcacacagtccagcctaattggtatgtgatgttgcacttagcagccatgtggtgggcatgtgtgactactctggttttcactttagtttctaaactttttatccctctcaagtccagcatggatggggaaatgtctctggatccccacagctgtgtacttgtttgcatttgtttccctttgagatttgtgtttgtgtcctgctttgagctgtaccttgtccagtccattgtgaaattatcccagcagctgtaatgtacagttccttctgaagcaagcaacatcagcagcagcagcagcag

SEQ ID NO: 186 - DNA, 1184 bp, Homo sapiens
tgcttggcacatagtaggtcattaaatatttttctaatgaagaagccaattctgtgtgagtcattgctagttttctgggacatcttgggagcttctggagctgaatcgcaacagcggaagacgctagctcgaaagagggactttccaagaccaaccccggcgagagaggaatttgtggagcatcatctctgagccgggcgcggggggagggggacaaggaggaagcgtgtgtgtgacccaggattaccgaaggctgcggacgccacccagcggccaggatgctgcccagcgcaagctgggctctaccaggcaggcgcgcgcggagcactccgggagttgtagttgactgtgttaagaggcggtgctgccaaaggggctgttgggtgttgtagtctgacgtttgttgggcgggagttgcccacgtcggccggaccactagtcccgtggtgccccgcgggaggccgcgcaggcgcagtgagtcagtgccggtcggtcttgtgggctgaggggcagcggcttaggctccggcgtctgcaggggtcgccgagctaacccgtggctaggcgagtggggcggggcggccggcaccatgtcgaggcaggcgaaccgtggcaccgagagcaagaaaatggtaacttggagcgcgtgacctcggcgggcggggcgaaattgaggcgtacagggaaggggcccggcgccgagcgcgaggtgcgtttggaaaagggccttcctgtgagctctggcaaggggaagcctcttgctgggtcactccgggggcgttccaggcaggtgaggggaccgtcggagaagttccccggaggagaccccgcccccaaggcctgagtgcagctctgtgctaagccaacaacaacgacggtaataaataccaataactgccacttaacttctctcttactatgtgttgggcaccgggccacgcacgttacagcatctcagttaatctgcagagtagcccctatcagatggataacattgccgttttacagcttggagagcttacgtaatttgcccatatttacacctgggaagttaggatttggacccgtgtttaactccaaagctaatgctaggagctgactgttaggctttactcttaggctacagtgtctcgtactgtggcgtgggtattgtgagagatgttcagatactggtcgtgccagaaa

SEQ ID NO: 187 - DNA, 1177 bp, Homo sapiens
agggacaggcttctgggggcaggcagggcaagggcagaggtggcagctacccgcaggccacagagtttccttggtcttcttccccagccttggggtgggaaagggagacttcagtcctcagcctgagctgcctggggcctgccttgggcttggtgtagctggagatctttggccagagagacctgtgagacagccgagctggagccagtgcccaagtggcccaggccagccctctcagcttcctcctgctgcccaagtcacatttctctgccccctgactcagagttctctctcacccttcctgcttttcatttttcagatgattcatttctccctatttctttcctccccattccctgcactggagaaagtgttgggcctagggtgggggcagagacttgggcaccaggcagcagagggcaggtgatcttagggtgccccctggagggcagggcttggccgagcaacagcattgctgggccctggatattggaaggaccttccctccctggcccaccttggagctccacagtgagcagtgtgcaggtaggaccaggaggggccgtgcctgggagagcctcccagagcctcctggcccccgaggaaagagagttccaatccctacccacctccagcttccaccctttagctgtttggctaaaatcatcatcactagcccgcagtgagtgcctaccccgagggcacctcattcagccctcactgcgggcctgcgtggcctgtgttcttagccccatgttacagaagaggaaacagggttagagaggactttcccaaagccacacagcttagaagtagtggagctaagccttgaacccaagtctcatccggaagccctgctgtctcctgtggtgactggcacggggacaccacttcagcttctgttaccatctgcctagaccatcccagggagctcagcatggggccctgcgtatgtggctcctccaggtgctgcgcccccagcccagggcttgctcgtacctcttgacgtgcattagccgcctcagggctcagagaacctttgcgaggggccagacagctaaggcttctgaggtaaagtgacctctcacgcagccagtgagttaggaagcatgagtctgcgtcagtcccgggtccgcagggcggcctgcaaggggagttgaggttggctggagggggt

SEQ ID NO: 188 - DNA, 1202 bp, Homo sapiens
atattcaaagcataaaatattaacagttgtatatctaactgaatttcagtcaggttccttaaattcttgatctttagtatcttttaagtggtgagtcatcgttcatgctatttctcacatttactgttagtgaaaatttttaaagcatgacactacagtttttagtattcttaccctttttgttttttattcttaatttacagatgtgtcatgaagctttgtcacatatctgggtaccaggtttgacctcaagagatggctgctgtacactttttgcaactggtttgatgtcacatttcagctccaactttgcatcctgagaacacttaaacgtttctgcaggtccattttatacaacttgaaagaccgtaaaactttctggttgccacaagcatatctttcttttctgctcatccaataaacagctgtgccctactgtgatagattttccaaacaaaaatacctggagcagcagtttagcaaaatatgccttcagtggcattcaacaaatggagtttccccaagcacagttctgtaagaagtgcgtgtgagagtgtgtgtatatgtgtgtatgtgtattttaagttattatttgtattgtgcaaaaatttttttttgatcttggggattctggctgtgaatttggtgcacgacaattatggtaaaaaaacatttgcttggtctaaagaagatcattaatgttttgtgaccatacaagttgtaacagtggattgtttttatgtgtaggtattgttaaatacagggactgtttccaggcacagaatatgaatcgtaagttaggatggacattagatgtgattatgatgataaagcgaaggtctgcggtcctatatctacagacacgtggtgagaaattagaacaaactggagacgggccattgacacatggactctgcctgggcatgttaggttaattctttgactccaagccttaaaatactcacatggagtcagcgctcacctcattcacacaattatcatagagctccctggacactgaacctctaaagggaaaaggtctaccctggagccaggagcatcagggttggcttgggagcatgagaggtgagcccagggctaggcctgggccaggccccggcagcactgctacttgggaggagccacttcacctttgtattagttattaaaaaatataatttgggctgggcgcagtggctcac

SEQ ID NO: 189 - DNA, 1226 bp, Homo sapiens
ctcgccaacatgctgaaaccccatctctactaaaaatacaaaaattagctgggcgtggtggtgcgcacctgtagtcccagctacttgggaggctgaggcaggagaatcgcttgaaccctggaggaggaggttgcagtgagccaagattgcaccatgcgctgcagcctgggtaacagacggagactccatctcacgtggtaggtgagccaccgctcctgaccgagaaaggatttctatgcattgttctttagttatagttctcttttccttgagttttgaaaaagcgcaaaaactgcttatctgccataaactggaagaacctatttaatgaaaaagtttggtgagaagaaatcaggagaataatatcaaacagtgttctagagggctacttagcatgattatctaattttttcttagaaatttctcagttgattgccctcttgtggtattttatttacttatttttttaaatcttccattacagccatgcctttcttggacatccagaaaaggttcggccttaacatagatcgatggttgacaatccagagtggtgaacagccctacaagatggctggtcgatgccatgcttttgaaaaagaatggatagaatgtgcacatggaatcggttatactcgggcagagaaagagtgcaagatagaatatgatgatttcgtagagtgtttgcttcggcagaaaacggtaaggaaatgatggaggtggaagctgaattactttcttgttcctttgggactctttttttttttttttgagacgaagtctcactcttgtcccctaggctggtgtgtgatggcgccacctcgtctcactgtagcctctgcctcccaggttcaggcgattcgcgtacctcagcctcccgagtagctgggattataggcacctgccaccacgcctggctaatttttgtatttttagtagaaacgggatttcaccatgctggccaggctggtcttgaactccagacctcaggtgatccgcccccctcagcctcccaaagtagtgggatcacaggcatgagccaccgtgcctggcctcctctgggattactcttaagtgtttttagtgggtcattgagcagtggcttgccaaatgtgaattggcaaagcttttctggtgaaatacctttcctactttggtaccatgatgaggaaattaaatgccttcagatatgaggatggtccattgttcctcagcattctttctct

SEQ ID NO: 190 - DNA, 1099 bp, Homo sapiens
tattctgcagtggttggggagagggatttttcgttattagagttctagaatgtcacaataaggacccttcaagtaaaaatgaaggacttacccatggtcacaaacacacacccacagtggcagtggtagcataaaacagtccccattagctgacccctcagctcttgaatagaaagaacatttaaataattagcttaggtcctggttagtgagatgagatgagatacttctctaggatgggttcagtccttaagggggtgtttgggtattcttctgtcttacaggctcagggaaggcctccatattatacacctaaccagttagcacagatgaggcctaatccacgctggcagcaaggtgggagacctcaaggtaggtggtggggaacagtaattgacagcccaggatatacctgtcctggtctcccctgcctttccttcttccccactctgaggcacagcctaggttctggtccacatcacttctcaatgatgtgcaatttttctcttcaccaggcttccaaggaatgccaagtgctatacgccagtctgggcctcgtccaactcttcgccatctggctccaactggtaatgctccggcctctcgtggcctccctactaccactcagagagtcggtgagcaaactggcctttagaagtgtggcctggggaggagggagtcaggatgactaggctctgtcctgggttggtcagtttgttgggctcgaatttatcgagtcctggttctgtaatcttagctgtgtgcttaggtggccacttcaggagcagagaaacagtatgagttctaggtgtgtcagttgcttttaacattctttgctcatcggtgacctatgtgaaaaaggttagttgtagaagtttgctagctggatgaccacagaggcagcttgttcttttgggtggggtgaggaatacaaggaaacagtgtatacagaatatgtcttgtattccaagatgtggaaagagttgtatgttatcctttggctcatcctcgaaagtagtagtggccccctgtgcaatgtgttgcgtaaacgtgctttgaaatttctccttccgtgggacgtggccagttggacatctgc

SEQ ID NO: 191 - DNA, 1138 bp, Homo sapiens
gagccaccgcgtccggccgagaatttcatttctaacaagttcccaaagatgctggtgctcctggtctggggccacccttggggaaccactttcttagggaatatttgtgatatagaagtgtagttaacagtgatctttttccttcagggggtgaatctctacattaagaacttggatgacactattgatgatgagaaattaaggaaagaattttctccttttggatcaattaccagtgctaaggtattatactgcgatctggggattgaaagcagtggtattccattataggcttattggcatttgtcccattgaaggaatagcatttaaattatgttcatttctgaaagtagctactacgtttttctagcaaaatttctggatgcattctggagaatgacatttcattaggttaacattacactgtttcccaagcactggagtctggagaggaatttgacccagcccctccttgccaactcagagcacctgaatctttcccattccttgctgcctcgtgccggtgtggggacagatggtgctacagaatgagcagaggaaatccagacaggttgttttccatttgtcttggggcctgtctctacagctctgccacattttctccttgagaatgaaggtattttgaagattttggaggtgggcttgggaacttctaccctggtcttaaaaagagaggaaaggggagtggaaggtttttctatgtttcgtagtgtgcatcatttgcttgattttctttgataatcatatcaactaagttagcagggtaagtaggaacctcattttaaagataaggaattttagtccttgaacaagagaatgctgactacatggggatggtgtactgcttgtccttggcactttgggagcaggatggaaactggtgccatctgaacattttgagttatggccggatgcagacgccggtcttgctaaacaggtgtaccagatgccacaaaatcctttagttgatgagaagggaagccacgtgggctggtaagggcttagtggccctgccctggctcttagtggactttgctcccaacctgggaatgtggaaagcaatgttatcagttgtagtagggagttggccagaggccaactgtgggtttgcccagtt

SEQ ID NO: 192 - DNA, 1138 bp, Homo sapiens; identical to SEQ ID NO: 191

SEQ ID NO: 193 - DNA, 1153 bp, Homo sapiens
gatctcctgacctccatgatccatccgcctcggcctcccaaagtgctgggattacaggcgtgagccactgcacccagccccataccatttaattttaaacctcatgcgtgtgtgcaggttaaatggctcctaggttccattcccgggtgatgggtgggagggtgttaagatttatttgttatagaaaggggccctggggtctcccgcagccgcgagctgggcggtcctcccggcgccaggggtcgctgtagcgccgcgcggccgcgccgggtcgctctcgcgtggccgccccgcctcgggcccccgggccgagtgggcgggcacgactgcgcccaggtcgcgaggcgcccttcgaccagcagcgcccggggcgggcgggtataaatggagcggtggctccctcggccgcctctctccgccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgc

SEQ ID NO: 194 - DNA, 1225 bp, Homo sapiens
ccttttgccaaaaggccaggaaatgttcaacatagggctatcgaatgaagaatttgaacctactggtattctatcttctactctgcaccatgtgggcttggcagacttataggttaccgtttagcatgttcaattaataatgcttgaagggcagatttacatgccttctgttttacaaaaccaggtaggggaaacattctccaataagatacagtgttcattcccatgctacaatcaggtaaaagagatgcaaccacttcacatgaggtgtattcaaatataccaactttcaaaatcctatcaactcttacatttttatgtcctagtttcaggaacttctccatccctagaccattttacccactcttgtgcaaaaagctttgggttcccagccaggggttgagccaaaggaccctggcccttttgcttttggctatctttatcttttttttttttagacagggtctcgtcctgtcgcccaggctggagtgcagtggtacaaccatggcccactgcagcctcaaactcctgggctcaagtgtacctcctatctcagcctcctgagtagctgggactacgggcacgtgacaccatgtctggctaattttttgaattttttttttttaatatggggtctccttacgttgcccaggctgatcttgaactcctggcctcaagtgatcctcctgcctcagtctcccaaagggctgagattacagacataggccaccacacagggcctcaatttacatctttttttttttttgagatggagtcttactctgttgtccaggctggagtgcagtggtgcaatctcggctcactgcaacctctgtctcccgggttcaagccattctcctgcctcagcctccctagtagctgggatacatttttgtattttttagtagaggcggcgtttcaccatgctggccgggctggtcttgaactcctgacttcaagtaatctgcccacctcggcctcccaaagtgctgggattacaggcgtgaaccaccacaccctgccttgatctacatcttgattaatctgtttgaccgtttccctaggcaatttcagatcagatttctcattgtaatctctgccttccagatttttcaatttctcccagctgggggaaatataggaaactggtttggggccctttaacattggggaccagtaagggttccctttggtccacccaggcttcaaaagtgttgtattaaga

SEQ ID NO: 195 - DNA, 1356 bp, Homo sapiens
ccataacctttaaaaaatgtttacgagcttcttctccgagaaaacaccaaatggcggatgacactggtgcagcgggggggcctggaggccctggtggccctgggatggggaactctggtgccttccgcggaggtttcggcagtggcatccggggccggggtcatggccgtggacggggcccgggccgaagctgcggagcttgctgaggcaaggccgaggataaggagtggatgcctgtcaccaagctgggccgcttggtgaaggacatgaagatcaagtccctgcaggagatctatctcttctctctgcccattaagggatctgagatcattgactttttcctgggggcctctctcaaggatgaggttttgaagattatgccagtgcagaagcagacccgtgccggccagcgcaccaggttcaaggcgtttgttgctatcggagactacaatggccatgtcggtctgggtgttaagtgctccaaggaggtggccaccgccatccgtggggccatcatcctggccaagctctccattgtccccgtgcgcagaggctactgggggaacaagatcagcaagccccacaccgtcccttgcaaggtgacaggccgctgcggctctgtgctggtgcgtctcatccctgcacccaggagcactggcatcgtctccacacctgtgcccaagaagctgctcatgatggctggtatcgatgactgctacacctcagcccggggctgcactgccaccctgggcagctttgccaagggcacctttgatgccatctctaagacctacagctacctgacccccgacctctggaaggagactgtattcaccaagtctcccgatcaggaattcactgaccacctcatcaagacccaccaggctccagctgtggctacaacatagggtttttatacaagagaagtaaagtgaattaagcctgttaaaaaaaaaatgtttacgagacagagtcttgctatgttgcacaggctggactcaaactcctggggaaaagcaatcctcttgcctcagtttcccaagtagctgggataacaggcatgtgccactgccattacagccatttttaagtgtacagttcagtggcattaaatacattcactttggtttttttgtttttgtttttggtacagtagggatacaaacctgtcggttctctaatatttcttttttgggcagtgcagttttaacattccacattaaggatgtaataatcaaggagtttgtttgtttgtttgagacagggcctcactccgtcaccaggctggagtgcagtggtgcgatctcggctcactgcaacctctgcctcccgggttcaagtgattctcccgcttca

SEQ ID NO: 196 - DNA, 1159 bp, Homo sapiens
cttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgcttagttgtttacctgtgatattggctgtacagaaatgcaaaaaatactgaaaacaccaaggataagaaactactctttattttagacaacctcataaaattattttcacatcccccccaacttcttgctcttaatcctcatcttttagttgaagaataaggcttaagagagagaaaggaaaaaccataatggctaaacttagcagcaccaacacggttctttcatcaaggcgta

SEQ ID NO: 197 - DNA, 1188 bp, Homo sapiens
acccaaattaagttgcttaagagaggaaatgtacatcttgtataacttagggagcgaagaaaatgtaggcgcgaaagtgaaaagtgaggcagctagttcttcctattccattctcgaccaacctgccctttcttaatatgactagtggtcttgatgctagagtcaacttactctgttgctggctttagcagagaataggaggaaccatatgaaaaagatcaggctttctgacttccatccccaaaacacatttaccagcatactccaaactgtttctgatgtgttccatgagaaaaggattgtttgctcaaaaagcttggaaaatactacacactccctttctccttctggagatcaacccacattagagtgtctaaggactcctgagaattcctgttacagtaaacaaaactaacgtaatctaccatttcctacactatttgagcatggaaatcatagtccccactctgtgaaaacttaacgctttttggaagacatttctgtagcatgtcagtttggagaaatgatgagctacgccttgatgaaagaaccgtgttggtgctgctaagtttagccattatggtttttcctttctctctcttaagccttattcttcaactaaaagatgaggattaagagcaagaagttgggggggatgtgaaaataattttatgaggttgtctaaaataaagagtagtttcttatccttggtgttttcagtattttttgcatttctgtacagccaatatcacaggtaaacaactaagcaagtttggtattaactttattctattttctgtataactttaagtacataaaggtttatttccacaggcctcaggaaatgggtagaaatcacaggacaatctctcttcccaccaaaaaaaagttgcatattttggtaagtgtttgtcctagagggaaaaacaactgaaatttacattagcagtgctgtgcaagattcttacataattcaagacctaaaaccagcctgcagtggaggtttcagtcctctgttcaggtgcttagacagaagccataagctgatgagcatgacagggaaaaggaggcagtgaagacaggtgacaggcacctggcagggaagaaggattcaggaatgccagactccttgaaatcatgtgggtttttttttttttttttttccttttaaagtcatctctataggaa

SEQ ID NO: 198 - DNA, 1202 bp, Homo sapiens
aaattttatatttattataaaaataaatataaatttaaggtattcgataacttatgggacgtctcaatttgtgctttaagggcgcacggcgcagagaggcgcagcagaggttttccaggttccggatgccaggggccggatggtgaactcctccctgcagcgaatcctcaaaagccactgctttgccagagagaagaaaggggatcaaagccagcgccaccgtccacgccagccgcaccaggccgctcctcagcctgcacagccgcagcggccgcagcagcaagagttccagggtctccctccgctgctgtagtaacccggtccgggatctcggtggtgctcctgatgcccctcgcgcacccctgatgccggtcgcccacccctgaagattccgggtgggcgagggaatcgtcagagggatcacgatctttcagctactctactcctatgatcgactgcatgtaacagagattctaacgttcaacgacaagaggattctcaacgtccactccaggctcacagatgccaaactggcattaactggcgagccgtgctgagcggcggcagcctctgcatcggagattcctggtggtgcgctgccccaggggagcgaggatagctttgcagttctccagcagttcgccgaggagcagctgagcgccgaccatgtcttcatttgcttccacaagaaccacgaggacagagccgccttgctccggaccttcagcttttggggctttgagattgtgagaccccttgtccccaagagacccgacacttgcttcatggcctacacgtcggggagagagtctttgggcgaggagtagtagcggccgcagcgggactgggcatcaagctcctggggccgccccggcgtctgccgggtgggtgcgaacggtaggctcgctcatctcgcctgggtttatccacatgttgtaactgcaaatgaacgctaaaaaaaaaaaaaaaaaaaaaaaattagctgggcgtggtggcgcctgcctgtaatttcagctacttgggaggctgaggcaggagaattgcttgaacccaggaggcggaggttgtggtgaaccaagatcgtgccgttgcactccagaatgggcaacaagagtgaaactccgtctcaaaaaaaaaaaaaaaagaaatgaaaattgagacatgatatgctggaagatataagtgccattaacgaaatagag

SEQ ID NO: 199 - DNA, 1192 bp, Homo sapiens
tgtcacacctattcaacttccccattttagtacaaaacagccagagacaatatataaactacagtatctgaaccttggcactaccaatattttggaccggataatactttgctataggaagctgcccagtgcatcctgggatgtttaggggaatccttggcttctacccacaagatgccagcattcaatgctgatagctgcccctcccccagttgtgacagtcaaaaatgtctccagacatggccaggtgtacctagaggccaaaattgtccctggttgagacccactgatgaatgtgtgcaatagtggttcccataaactgcatttaaaaaacagctgttaggtttcgtttggctcaagggctgtcatttttcactcctccccccatagagtatgtaaaatgattagaaatgacaacagactatcatttagtatcagattagtgtgtgtatatgccataaattatttccttagcaattcctttagtatttttgttgcaataattctttaaacgctacatttgtaatgctgtcttggagcctaggaattatttttggagatatttatgcagacttccctctataatgatcggttttttattatggttaatccataaatattttgagatgtatctctaaaaaacgagcactctttgaaaacataaccacaatgccattattatacctacaaaaattaaccacaattccttaaaacataatgatgcctttttgaagagagatatattgagacttcattctggggagaaacctttcagataactttatttaccttttcctttgccaagcatacaacattagatttgaaatatgctttgtatcaagtggaagtgtctcttaagatagcccctagaacaacacatcaagaggcccaccaaagaggaccagagaaaggtgactgaaggagccatactcaggcagggaaatacggagagaaagcagaggaattggctcctaatgcttcactgtacttaatgaaatagatactccatccttacagacataattggaagtaagtcaagttcaacttctttgttttatatggagatagaacagtttcaatcacgtgagtattataagtgtgaattatctaaagtaaagctataaatccagaatatataccagtatctctagaatttttcatattactacatttacttaaaaaaaaagctggc

SEQ ID NO: 200 - DNA, 1248 bp, Homo sapiens
agttagtatcaggaggagggcctgtgtgctaggtaagcgtttaacacggatggactcattaatcccctgaccagggagtttgctataggctgtttcacagtcttaaggagctgatacaacaagaactgttaccagtgaaggaggtagatatttggtcagttacatggaatttctgactgcctcgcaagtggagaattgcccgttagtgacactgttacgaggtgctgtggagaaagaatgcttgcattgggtggttgtagaagtcgatgtgtgaggtcttgaaaaggtctgattctgtaggaattataaatttagcgtctaattattcccagtaggctccttctactgctctgccatgaaaaacaggcttagtttcccatggcagctgactagaaattctaacttttctactttaatgtacatcatataattcccacttttttttttcttttaaacagggatgattcttcaagagacccttcaaacttgggtagagtttacagctctgactttacactcggctttggagactttctttaaattatgtttttattaagattattttattatgcggaaaggtatttgggaaacttgtcacttgcatgtcccatcacgtgtactggctcctctgtggtgtctgcctgttgcgtgacactctccttgcagttcttgagttgcggcagaacatcgcgatgggaaccgatggtgggtggggctgcagagtgccccatcggtcaccttgtttctcaactacctcgcatcattgcagatgctagcgcgttgcctgtcgctttcccttggatacctagaccgttataaagtgtgccacatggacttaccgagcatggagagaggattttagctaggatttgaacacttggtgctgggaacctcagggtattgcttgccactaagccatgaaaccagagacaaaatctctatactgccctgagttggggggaattctcagtgccaactgtggctggtcctcattcaaagggacggtcagtttggtgtcaacatgaaacaccaagatgtctgtctctgaagcgtgattttaaaatccccatgcctgtggctgcgcttcctatttctagggctgggaaacactccttgcatcaaggggtcacttacagaacaaagaatcttttgggggaaacttcctctaaaaccctctcatatatagacagctttgactggagggtccatttttcttccaggatggtgttactgcagttgaaagggcaa

SEQ ID NO: 201 - DNA, 1164 bp, Homo sapiens
tgaaatattccacaaagagacactaagaatatggtagtttaataggacgtagtagtcctaaaaagactaaaaagggattaaaagtccctacctggaagggtagggagttagagaattatagaatgagaaaacatttaattaactggcctatataagacattcttgtcctttttttaactggtatgggtctatttgatgcttcgttggaaagtaattttttccccttcatcttatctttcattgtttcttttgcatgaaaccattcttaattattagggaataattcagttggttgtccctggcccagctataaccaatctgaatccaaaacatgaattttggggttttactcttaatctgtctatacctcatgccttgtttttcccagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggtgagtaagtaaacccaaactctttctagccaattattaatagttagcgtccaaaaactgaacatcctattatgggaaagcctagggtacccagcttatcccttatttttcatatagtctcctaaaaaggcccacccaaaatgaaacaagctgcacaatttggacatctccatctctacattagcttatgatatccaggcttcttccaaattctttctaacaagaaatcacaccctttgttcttcttggccagtgcccatttacctgagagagagaatggaaggaggtcttgccgtttaacctatctcaaaaagcataaagctttcaccaaatcctatcataatgacaagaaatgagagaaaatctgccagtagaaagcatggctgttataaggatctcttatctcctttctcactaattctcacctggtccttggagttttctcgcttcgaatccattattacataaaaatcattttttaaaatttaagctaataacctcactaggtttttctttccagatcagattcccctccagcttt

SEQ ID NO: 202 - DNA, 1104 bp, Homo sapiens
gtcatgtggcaatggccccagctgagagggggacttccaggagacagagagcggggtcaggcctggagtcaggcaggcctgggaccaaagcctggatccttcacttacagctgtgtgaccttgattgagtcacctccctcctctgagttcagttcctcctctatgaagtcacctcctcaaagtggccttccttggcccacctcccacccttcatttcttccatacctctgatcacaggccacagttctctcatttgttctttttattgtctgtctcttccttccagaatatgcattccaggagagcagggatatttgttttgttccccgatgtatcccctggatctagcacaggactggcaggtaataggcactcaatgatatttgttgaatgagtgaatggatgaatatgtgaatgcattggagttagtacttccaacctcccaagggcgtttagaggcgaagggcgagatgcataaggtgtccggcccagcacataacaggctcgctcagtgaggatggagctgctgttaccatcctgaggaaaaactttgcagctgcctcccaggaaactgggctcaaagtggggggcgggagagctcagcaactcccacagtgtagcttccacttcctggctggggctgagccctgtaattgctcccatctccttggcagcctcagcagctgtctaatgagtttgcacccggctggcccctgggcttggccgcacagcccaggcctgcctgcccaactgcaggcagacaaaggccctatgtccctgggatctgcttcctgcccgcccactgcgtccctgacaaaccgaggtccccagctgccaagctctgcttctgcagtgaaggagcccaagattcccatgtgggccaggggcacagagcagtggagagggcatttgtcctggaggatggagccctgggtccacatccctgctcttctccggctgagaggtgctaggggaggcggtgggatgtcatgcccaagagcctgaccaacagggttggaaccacgcctccaccacctctagctgtgtgaccttgggcaagtcccagactgctctaatcctcagtttcctcatccatcaagcagg

SEQ ID NO: 203 - DNA, 1148 bp, Homo sapiens
ggccttttctgtgggccctggccagacagggttacctggtgaggtgcagagagtccctctagtggccattttgtatggtagttgctaatgcagaacaagttctgtcttgggcttaaattgactgaagactttagggggaaagaatagtaaatgcatgtaaacaaatggggacactctgttcaggagaataatccgactggcatttgtggcagtttttgaaatgtaaatgtattcatgtgtgttcttgtaaatacgtgtcgctcagatgtcctttgaagtgggagggaatcaatccggggataatttcaaatggaatagagtattttgatattgttcattcagagggtgatgtgtacatatctatattgtatatatgtgatgaaaatgcattggctttttgtgcagatacaacctgctctctgtactgctgttggacagtcagtgttttaatgtttctacagttttgctattgcacgatttcatattttgcctctatgatgaacggcaaccattatttgtaactgtttagtgctgtaaagaaatattccaagtgtcattaggattgttgctgccagaactgatatgcatgaatggcacttaaaataaatatattatgttaactctatttacaacactgattggtctccgttgtttgctgtaattgaagaagtgagaatggagctagtccaggtgcagaaaccccacagccaggaccccagagtccttggggtcactgagattgtgtcctttgcattactacctgaggacagtaattgctgccatttagtgagcatcttattagctccatgaacttggggaagtcactggatttccctgggcctcattttccttatttgcagcgccagtacaatgaggatagtatctgcctcctagagttgtagtgggatttacataaatcagtacatttaaacatttaggacagcacatgggacataaagcatactggtactcagtatgtgccaggtgctgtgctaagtagatattgtggtcctccttttaccgacatgggaacagctcagatagaggtatagaaacttgtctagattcttcagttggcaggtgatagagcagaggtttgaatccaggtcatttgattccaggcatcatgttttttgcacaatcctctc

SEQ ID NO: 204 - DNA, 1137 bp, Homo sapiens
ttttttctttttttgagatggagtcttgccctgttgcccaggctggagtgcagtggcacgatctcggctcactgcaacctccgcctcccgggttcaagcaattctcctgcctcagcctcccgagtagctgggagtgcaggtgcacaccgccatgcctggctgattttttgtattttagtagagatggggtttcaccatgttgcctgggctggttgcaaactcttgagctcaggcagtctgcctgcctcagcctcctagagtgctgggattacagacatgagccactgcgcctggcccagcgttacttttcttgataagaatttacagataagacactcagagagacattgtgtcattctctatcatcactccttttaccatgtgaatagatttctctgtcttggcattcttgctgattcagacttattagttaaatcggatttttctggaatttgaatcagatttcatttgggcaacaacagcagggcagggtttctaaagcaggtttccccactcatctaggttgtcttgaaaggaggatagagccacttacagttttatttgcttcagtgtttaatgtagatattatgtggcctgctgtttctgttgtcttgtatgtctgtgtatgcatgacatttggtccctttctttgaaatgcagcccctcttacgggttttttagtggtggtggtttgttttgtttcatatcatatcacagtttgcatggactgattatcttagttttatgataaaactagaagaaatgagggtttttttttaatgaatagattttgaattgattctttagaccccccaaaaagtgtcagttctaatggggaaatatattccatcaagtcaaagagtaataactgctcactagttgctttttagcatctctggtcttatcagccatgctaaatcactttaattagccttagtgattctatggttgagtaatctctacttgaactaaacaaacatcttttgtttctgtgtgtgtgtgctgtgtgtgagagtgtgcgcgcgcgtgtgtgtgtgtgtgttttaatggagtgttgccttgaatgaatcactgggaagccagccatggtaagggctggtgaggttggggagaaaggaagagctttatgtttctctg

SEQ ID NO: 205 - DNA, 1109 bp, Homo sapiens
gaagaataaccccaggaagtaccttcgcagtgtaggagatggagagactgtggagtttgatgttgttgaaggagaaaaggtgaggatgctttttgtgtaaaggtttgacttcagtatggaaatattttggaggtctcatccattaggatggtggctctaatgtggatggatgtgttcaggtgacctcatgaacacaggtgcatcaagcctaatgttctggctgcagttagagggcaatctcttcagaacagtgaggaactgatatttagtcatttctgtgcacccctggtcacgcagttgcgcccccccccccttttttttccttaactttgttgttttttgctttgtttgaaaatgttctgatttccttttgaaagtgttgaaagtgttctgatttcctttgtcactatcaatatgtaatggcttttgtagggtgcggaggcagcaaatgttacaggtcctggtggtgttccagttcaaggcagtaaatatgcagcagaccgtaaccattatagacgctatccacgtcgtaggggtcctccacgcaattaccagcaaaattaccagaatagtgagagtggggaaaagaacgagggatcggagagtgctcccgaaggccaggcccaacaacgccggccctaccgcaggcgaaggttcccaccttactacatgcggagaccctatgggcgtcgaccacagtattccaaccctcctgtgcagggagaagtgatggaggtaagtttcaccatcaacaacagcaatgtgataagttctggtaggactgtttagagctgttaattatatggaaagcaacttggattcctagtaagaaccaaaaggattaatttataatgtagtcacaattactagatggtctgttttgtttgttttttaactcttggatttatctggttgggtttttttattatattactgacccagtaggcttaatttccattgtctttttcagggtgctgacaaccagggtgcaggagaacaaggtagaccagtgaggcagaatatgtatcggggatatagaccacgattccgcaggtatggtccacgtaaacatgtttctattaaaatttcctcaaacccgtgttaggact

SEQ ID NO: 206 - DNA, 1203 bp, Homo sapiens
ctgtttggagaaagtggcaacattaatataatcttttaatcatttctaattgttttttttttttgttggtttatgttgttcccggaaaaagacgagagtgtttcgtgtctaaaaaactcctagaatgacacgtggtttatcatggtttatttaaactgcctgtagattaataataataattctctggcagaccacatgatacaattacgttcttgttactttagctcattagctcacttgtttttattacccttaattccaaaattaagggattctttttcatttcgctttttacatgatatcgagaggtacgtgattgttgttccctccaaaattagcattcaaccagtggtgcttttggttttttcccgtttactatttgctggatggcaagagatctgttaatgtctcccaatacacaagtaatgtaaactagggcatgtactacactaaatgaagatcaccatgaattctacatgatcatctttatttttttctttacagtttagtcatccaacaagaagaaatatgaaattccagcaataagaaatgaacaaaagattggagctgaagacctaaagtgcttgctttttgcccgttgaccagataaatagaactatctgcattatctatgcagcatggggtttttattatttttacctaaagacgtctctttttggtaataacaaacgtgttttttaaaaaagcctggtttttctcaatacgcctttaaaggtttttaaattgtttcatatctggtcaagttgagatttttaagaacttcatttttaatttgtaataaaagtttacaacttgattttttcaaaaaagtcaacaaactgcaagcacctgttaataaaggtcttaaataattgtctttgtgtaaatttgtctagttttgctttagtttgtaagtatttagctatttataggacccttagcttgacccagtctacaaatagatgatgctcactggtaattccctcaggtaaaatgtctcaaaatctctaatcctttaagtggcatgcctgtgggcccatactaaaaattagaaaatacatactctgataacctggccatttttcattgaaggatttagctcatttgtaagaaagacttgagtgtagattttgggtgggtccctttggctgtgaggcattgtttaaaagggcattgctctagcctagaccgaccagactctca

SEQ ID NO: 207 - DNA, 1238 bp, Homo sapiens
agctattttatatttttactaaaatatttgttgtttttaggagtgattacttggtgagtgtcagccactgcgtagggcgcttgggcatatagcaggggtacttacaaatgagccctcttggagcagcttccttttggctggttcagggaggtgaatgctgttggaaagccttagctcttcacatgctgctgggttttggttgtctgtggatatgtagggaccttgggtcttggtctgtaagcccattttctccctgggtggccacctgaatctagcaaggtgtagtttaagtagagtctcttcagagagttgaggatgttgtgcttgttaaggaagaccggtttacatctgtgtgtacattaccttcctcaggcttcctcaggcccagtgctcatggaagggacgttgagggactgactacgtattagagccttgaaggccaagattatgccttgttcatttgaaattcttgctgtcactggaataggggattatgtcttgtaatgttcataatgcctaataaacccctgtaagtggtttacatgtttctttttactttcaaaaaggtactgtaccccacgctatagtgagtttgaagagctcgagcggaaatactggaaaaatcttacattcaatcctccaatctatggtgcagatgtgaatggtaccctctatgaaaaggtgaggctcactggaaaccctctgtgcagtgtttttgtaattttgtaatacctttttttcggcccggcacgtagtaggcacctaaaagctgtttggtgaatgggtggatgaacagatgatctacccccagctgatgttgctgtgctggcctaattgtgggccattttgcatgtgactgaattttatttctcctgctttacatgtgaattggatgatgtggtgttcttttcaagggttgttagcatagtcggtgggtggtagctgatgagttcttgaaagggtgggttggctctcagataatgaaatgaggcagtgtggtttctgcagaaaaaagatgactgactaatctaatgaaaggggtatacatttaagaagagaaatacatttagatttttcagaaccctcaaacaagattctgtggcaaaagctattttaaccacttttattggcttgaaatcctgccttaaatatggtgaaaggggagaatatttgggaatatcttcagatgactgaaaaacagtagggcattcagggattatcactcataattgttttca

SEQ ID NO: 208 - DNA, 1204 bp, Homo sapiens
ggccccagtccatagaggggtcaactatgctggctggactggctgccttgttcctggcctaggacttagcttcataactatcacctgcaccgactaggctgaggtgctggtacttgccccaacccctacttttgtatttatatgtgtgtgtgtgtgtgcgtgcgtgcgtgcgtgcgtgtatgtttggtctggaccagcttctgccagcccctggcctttactttcttccttgcctatgcagggcaaacaaaatgtgaaattctgccctcagctgagctgagtaagggctcctgggggttggctggagatgggtgtggcatctgtccaggcctggaaccgtctcaagacagtgctggcaaagctgcagtattgagatgctaaggagctgatgccacctctttgtcttcccctaaaggagaacatggggataacatgggtgtgtgcccacaacactctaggtgcagagcccctgtggcaaagtattacagggtgtgggtggggattaccctgaatcggggattttaatgatggaagcaggcagagcctggtgggtgattctgtcaacagaaaattgcaatcatgcaggggctgggagggttaggatgaaaaaactggggccattggaggcccactgtaggtgggagggagctgattttggggtggggggtgggactagagggcaatactgaaggggttaaacaggtttttgctcctcaagaatttgtttgcctgggcccaggattggagggcttcacaccaataccctgtgtatacaagaatcagatttataatacttccccttttttgttacgtatgaacactataaaccaaattattttgaaaactggtgcatcaccttgtccttagcaataaaatgtgttgagcagaggattggctgtctgccccaaggagcccacgtggcccacgtcaggctggggggtgtatctagagtcataggctctggagcggggctgtgtattttaagacaaatcagtaaggcattccctaggaagttccagagagtgggtcctttgcttgtcaagctctgtattaggccaagtatggtgggtcatgggagcagggacacttctggctctgagcacctctttgttgtgcttgctctgccttagagacgggcaagatgaggtaacagaggaagcaccagaccaatgagtcctctcaacagagtatctctcactgctgc

SEQ ID NO: 209 - DNA, 1193 bp, Homo sapiens
tccccaaatgtaaggcctcttattggaccaggcccaaatggggattgaatgatgtccacctgcaccttcacctgttccctgttcaagcctgagagggatgcagagccttagcgtggactctgtcctgggagactcagtgcaggcctcctgctcccgagccagcattcaccacccagcccaggcttctcaccaagcctctgagaccagctcttcgaggattctccaccatttcctttgcggccatcaccagtggccgcagctctttctcccatgcctcttatccctgggagggccaggagatttcacgtcactgcctgttgccatatcttaaccattgctcctctacccccagataaaaatgctcaagaatggggactccctcagctcctcttcctcactgtcttctgtaagctcttggtcactgcctcataattattaccatgtcattctcctcctcctgctccccttcccgtcactcttcctcccgctccctgtcactcttcctcaccctccccctcctgctcctcttcccaccactctcccctcctcctgctcctcttcctgccactcttcctccccctcctcctgttcctcttcctgccactctttcccctcctcctgctcctattcctgccactcttcctcctcctcctcctgctcctcttcccgccactcttcctccccctcctcctgctcctcttcccgccactcttcctccccttcctcctttctgccactcttcctccccttcctgctcctcttcccaccactcttccccctcctcctgctcctcttcccaccactcttcctcctcctccccctgctcctcttcccaccactcttcctcctcctccccctgctcctcttcccaccactcttcctacccttcatcctcttcctgccactcttcctcctcctcctcctgctcctcttcccaccactcttctcctccccctcctcctgtttctcttcctgccactcttcctccccctcctcctgttcctcttcccgccactcttcctccccctcctcctcctgttcctcttcctgccactcttcctctcctgcctccttctgctcctcttcctgccacttttcctccccctcctcctgttccccttcccaccactcttccccctcctccttctgttcctcttcccaccactcttcctccccctcccccttctgctcct

SEQ ID NO: 210 - DNA, 1171 bp, Homo sapiens
ccgccactgtttctccccctcctcctgcttctcttcccgccactgtttctccccctcctcctgcttctcttcccgccactgtttctccccctccttctgccccccttcccaccactcttcctccccctcctcctgttccccttcctgccactcttcctccccctcctcctgctcctcttcctgccactcttcccctgccacttttccttcccctcttcctgtttctcttcctaccactcttctttctcctcctcctgttcctcttcctccccatcctcctgtttcctttcccgccacttttcttcacctcctcctgttcctcttcccaccactcttccccctcctcctcctgctcctctcccaccactctcccctctcctcctcctgctccccttcccgccactcttccccctcctccttctgttcctcttcccgccactcttcctccccctccccctcctgctcctcttcctgccacttttcctccccctcctcctgctcctcttcctgccacttttcctccccctcttcctgctcctcttcccaccactgttcctccccctcctcctgttccccttcctgccactcttcctccccctcctcctgttccccttcctgccactcttcctccccctcctcctgctcctcttcctgccactcttcccctgactcctcctcctcctcttcctgccacttttcctccccctcctcctgtttctcttcctaccactcttctttctcctcctcctgttcctcttcccgccactcttcctccccatcctcctgtttcctttcccgccacttttcttccacctcctcctgttcctcttcccaccactcttccccctcctcctcctgctcctctcccaccactctcccctctcctcctcctgctccccttcccgccactcttccccctcctcctcctgctcctcttcctgccactcttcctcctgttcctcttcccgccactcttcctcctcctcctgttcctcttcctgccactcttcctcctcctcctgctcttcttcctgccactcttccccctcctcctcctgctcctcttcccgccactcttcctcctcctgttcctctccttgctgcttttccttccttttgttctcctcttccttctgtcatcactatcattatcattatagctgtcacttat

SEQ ID NO: 211 - DNA, 1247 bp, Homo sapiens
ctggcttagcctcactgcacccctctctatcctcccaggctactccatgtttggggctggcctcaccgtaggcctgtctaacctcttctgtggagtctgcgtgggcatcgtgggcagtggggctgccctggccgatgctcagaaccccagcctctttgtaaagattctcatcgtggagatctttggcagcgccattggcctctttggggtcatcgtcgcaattcttcaggtgatgaatccccttgggaagcctctgtgtccttgtccccaacctagccttaccctccttctggagaagctgaagtgctctccttctctacctataactatagattcccccaaacagcttccacctcctcatttccatcttctggttttctcctacaggggctctctatttttgtctctgatttggtgtcactgacaacagccctgttctttttcccccctttctaatgcgttgtatctgtatagcacttagtcctccctctttctgttctctcattttatctgccatgcttttcatgtctccagtctgtatttgtgatctagactagaatggaattttgtctgtctatatcagtctgtcatggtgtgtttgactgtctctcggagctatgtgtatctccctctcacatgcctgtcagtaggacaccattgtctaaattgtgtgtgtctagtctgtctgacagtgtgtgagtttgtgactaaggatcagcctgagggtctgagtgtgactgtgggtgcttgactgagttgattcttagtgactagctttatccatatgccacttctctccgtctgtcccacagcgtaactctgtggttgtctgtccctgtctgccttgtctgtcacagtgtgtccatcctggttagtcatatatctcttgtggtctgtccatccaaccatgtgctagatgtcatcttctatcatttgtcactgccttacctattcctctgtccctgcctgatttctcctgttctttttttgcagacctccagagtgaagatgggtgactagatgatatgtgtgggtggggccgtgcctcacttttatttattgctggttttcctgggacagctggagctgtgtcccttagcctttcagaggcttggtgttcagggccctccctgcactcccctcttgctgcgtgttgatttggaggcactgcagtccaggccgagtcctcagtgcggggagcaggctgctgctgctgactctgtgcagctgcgcacctgtgtccccca

SEQ ID NO: 212 - DNA, 1184 bp, Homo sapiens
attgttttacacttgcatttgccatggttaccctttttcttccctttactcttaattgggagaatacctgcacatcttctgaaactcaactcaaaggtccgctcctctataaaacctttaccaactctccttcttatcccgcctcaatccctccatcttgtattctacgaaacacactgtctttatttctagcaaggcacctgtttattgcatttattggttaatatgcctgcctcttccatcatattatacatgagtcctttcaagccatgggaagccccttgaaggtagaggaattgcttcatcatctttttgttcttgcgcctagcacagtgtctggcacagagcaggatatgataaatagtagtaattgttattaatgttattactggtattgggtatgattgggtgccaatctgttttccttattagactgtaaattccttgaggagcctggtacttgggtggcatgtggtaacatttgtctagtgaattaataacttatgaaaaacttctgaaaatcacaattgctttaagcagtatttggagtaggaacataaaaacatgagtattaactttgcagagaaaaaaaagctggtttacatccatctcatgaagatgaaatcttaggctcaaactagttcaaagtaaaattttataagaacaaacgtaatgttttatgcttcggttaaaaagtaaggggtaaaagtggggaaagcctaacttgtcagttcatatagaaaagaagctcaaatctgttatatggtattgtctttcatctaaaaaattaagttttgcagtgaactgtaatttgtgtgtgaacgtgactgggaaaataaaaattctgctagagagagtatgatttgcttagcacctatgtctgcagtctgaagagcttgtcactgttaaagtgaaatcttatagatgtttcagctaagactgtctttgctcaaaaagagggaccgggccgttccttggagtaacctttttttttttttttttgagatggagtcttgctctgtcacccaggctggagtgcagtggcgtgatctcggctcactgcaacctccacctccgggttcaagcaattctcctgcctcagcctcccaagtagctgggattacaggcacatgccaccacgcccagctaatttttgtatttttagtagagacggggtttcacca

SEQ ID NO: 213 - DNA, 1123 bp, Homo sapiens
agagagagagagagagagaggtgggtggggtggggtgtgaggagacagtggggggttgtatgtgaaggaggtagacgggtgtatgtttatttcatttcccaaactgtctttgagactggagatagcgcactgaggaagacagacaagggcgccgggaagaggaggcgtgtacatgagagaaagaggtccatgtaagagtgagaaagaccaagaagtgtgcaaggagaaataaaaaagtgtggctgagagaggggtgaatatgtgcatgtgagaggcttctatgagacagagaggtgcgtgtgtgccggagccatctgggagacattcgtgagaaacggtgtgtgtgcaagagtgggtgtgtgaggggagatgagagaaaggggtgcataacagacatgttgtgtatgaaaagaacgtgagaggtgtggatgggagggaggggcacagcgtgagagagggaggtgagggaggttcgtgtgtgtgtgtgtgtgtgtgtgtgtgtgtgtgtgtgtgtgtgcatgagagagagagagagaagggcgtgtatgtatgttgagacagagaaggatgtacgttttctgtcttgttttcctttgtctcttcaaattctcccctccttgccccttttccccccaaagtttttggagccatgctaacctgggtttgaatttcacttctggctacttcattcatttatttatccattcattcaccaaattattacggagcatctgctagcttttaccttcctgtgcctcctttgtcttacctataaaaagaagataataattatacttgcctaacagggtgattaggataccttggtggtataacttacataaaatgtctcgaaagagcacagaatttggagctggatgcactctatagcacagcatctggcatgtgggtcaggaaatggtagctacagagctgcagctcctctgccaatccctttctctcttctttttccatgtcccttatcctcctcccttcctctctcccactcgcttgttctctctcaatcacagctgagccatagtattaattattagaaccaattgactgtttagactctgatgttttaactaatcaccactaatggcaaacactggtgggcaatcac

SEQ ID NO: 214 - DNA, 1231 bp, Homo sapiens
cctgcctcggcctcccaaagtgctgggattacaggcatgagccaccacgcctggacttttttttaaatttaaattttattttttttctgagacaaggtcttactctgtcgtccaggctggtcttgaactcctgggctcaagcgatcctcctacctctgcctccttaagtgcagggattacaggtgtgagtcactgtgcaccgggcactgctactctgaacacatgtggctacatggaagacaggacttggccatgtgctctccccagctcagtagtcaagtgcctctctccatttactggtaagagagagagggtttagaggaactcttgttccggcgctcagctcatttgcatcccagaatgcattgtagatacgagaattattaccagggttatctgtttgaataataatatttaaactttttttctttgtcaggagattttacccagtgagaacatgtttaggacacttttctacagtggaagaaaagcttctgtctgcaggtccaaaggcaccgtaagtagagggagaccagtcaatagctgggaagccaggcaaaaggctaacaggcagatctctggtttctcttcataacgaataaatctttcgccttttactaaagatttccgtggagaaaaacaactatgagtttatggttaaattttttgaagtcttgcctaggcaaggctgaatgttctgttactaaagagagacgtgtgggtggggtgtttcatgctttgggaggttggggtagctccacaaatgtcacccaggttgtagcggagtggtgtggtcgcggctcactacaacctccatctcccatgctcaagcaatcctcccacctcagcctcataagcctgtctaattttgtgtactttttgtagtgcccggcctactgtcatgtttttttagcttcttgtaaacatttaggaagctaaatgtttataagatttttttttttaaaagaaaacctagtttttgacagtctgtatctaataatttggctgaagtcttgtgagtctttctagtgtgctagttccaatttatagtgatgactttgtgtgcatgattatcttatactttggactggtctcatatttgaaaaattaagtgtaggaaaaacttaagagttaggatgatgatactttcttccagagatagttttcttttgtttttatcaggtacctggggacacaaacaattctggactacctttgtccacattcaaca

SEQ ID NO: 215 - DNA, 1227 bp, Homo sapiens
ttagtagagacggggtttcaccatgttggccaggatggtctcgatctcctgacctcgtgatccgcccgcctcggcctcccaaagtgctgggattacaggcgtgagccaccgcgccaggcctatgaatacaattattttaaagcttttaattttttttttttttactttaagtgccaattataaaataaagtcactgtctagttggaccaggcatctacagttctgtaaatctggcttccgctctgccccctggtggtggcctaacgcctagaaaaagtaacgaactatttaaggtatttctggaaaccgagggggtggtgactcagcgtcatttacatacccacaatgcactgcacacagaccacgtcctactttaaaaggagattctcccttttttccccctcttttcctttaccataataacgaagctcctttcacacaatcgtctgagacaaaaacagaagtcactcttttgggttaatagtaaccattgctaatctagtagtgaccgtcccccgaggactgtgtgcaaccattccaacacatgctctggtttctcttcaaatcgtataaatctttcgccttttactaaagatttccgtggagagaaaccgttttgagtttcaagcaaattttttgaagccctatgttggtggggttcatcaacggtgtttaaaaatcagatagaaagttgtgtgtttgttgcgaggtgtgagacaacattttgtttgaacatttattttgggctgttgtaatggtgtgagtgtgcgttttttatttttttggaagtggggttttagactagactgtagtgagcaatctttgcctgccggcttcaagggattttcctgcttcagtctctcaagtagctggggctacaggtggcaacaccattccctgttagtttttgtattttaatagagatggggatttcccacattggccaggctgatctgcccgccttggcctcccaaagtgctgggattacaagcatgagccaccgtgcgaaaatttggttttgttttgtggttttgttttgttttgtttttaattaatttattctagaaacggtctcactgtgtcactcagtctggagtgcagtggcacgattatagctcactgcggccttaaactcctggcctcaagtgatccacccacctcaacctcccgtgagccaccgcttcccgcttggccagtttagtttttaaagggtttttttttttttta

SEQ ID NO: 216 - DNA, 1962 bp, Homo sapiens
agcagcctctgaaactagtctaaacacgcccagatctgccgacgccgcagacccccttcccccagcccagggtcggaggcgagtcgccgggggtcggcagaggtcagcagcctgcgagaccctcctaggctcgtggccctaggcgcggcagctgacacgtaagtctcgtcgcccgacgttgtttcggcgctcagaaacaacgtaaagtaaaggggcggggcagcgttttacaaaccgaaccgtgaatctttgcggtttctctttccagccagcgccgagcgatgggtgagtgtcgctctgcattgaggcgggtgaagggaggttgagctcaatcaggccccatcctgcttcacagcctactgaggagtccagacgccccgacccccggccagggacagccacgaggagtggtggccctcgggtttcggccgcccagcccgtctctgggggctgcgaaggctctgggctccgggttccgggccgcgggctgcgggctccgagcggcgccaacatggctgccgcgaggaggaggccccggcctggccgcacgtgtatgatgacaactcggtaatgctgcatactcccgagtgcgcggtggggaagccaaccttggagagctgagcgtgcgaccggcccggcgcgggggtctccgggagctggcgagtcgctagcaccgagtcacagtggctcaagcttccttccccgcttccacatgcaggcatctctcgggacaactggcacaagcgccgcaaaaccgggggcaagagaaagccctaccacaagaagcggaagtatgagttggggcgcccagctgccaacaccaaggtgggtgcgagcgtgggcctgtccgcctgggaggtcgccttcccccgctctccagcgtgctcgggtctttccgtgtgacagttgtgcgttctttcttgggctctgatttctctgtagtagggcctgggtgtcctgtccccctttagctgttggataagtaagtaccaaagagggaatgctccctcaggcccccaaacctggagcttaggatttcagagagaaggatactgtgtggggacttgagcttctggagagggtggcgcctcgcgtcatagtcagaagcctagtcttgttttttttacagaggcttaattttcagcatttggggtcaggctttcctcttggaggcaagtagggtgatgaaaaagaatccttaggcgtggttgtggccgtcttggtcacctgtgtgccacttgccaatgcaaggacttgtcatagttacactgactgttgcctcctcccggcccaggttcctctccctcacttgccttgctctccttggtaacctagttcctgtaaccttgtgttttccagattggcccccgccgcatccacacagtccgtgtgcggggaggtaacaagaaataccgtgccctgaggttggacgtggggaatttctcctggggctcagagtgtgagtgaggccctttgggagtgggtgggaaaacgcacctaaacggtcttaagattcaccaagtgggcctggcgcggtggctcacgcctataagcccagcacgttgggaggccgaggcgggcggatcacctgaggtcaggagttcgagtccagcctgggcaacagagcgagactctcagtaaaaaaaaagattcaagtgcttttagcaagtagtctgtggcttagaccaaggcatttgaagtttctccttgctgaaagatcttaaggtagctggggagttctctccacccaggctgtcctgctccaatctctttttttgagattgggtctctgttgctcaggctggagtgccagtggcgtgatcttggttcactgcagcctccgcctcctgggttgaagtgattctcctgcctcagcctcccaagaagctgggattacaggcgtgtgccatcacacccggctgcttctgtatttttagtagagacggggtttcaccatgttgg

SEQ ID NO: 217 - DNA, 1962 bp, Homo sapiens; identical to SEQ ID NO: 216

SEQ ID NO: 218 - DNA, 1962 bp, Homo sapiens; identical to SEQ ID NO: 216

SEQ ID NO: 219 - DNA, 1722 bp, Homo sapiens
ttcttggctttaagtgatccacccgccttgacctcccaaagtgctggggttacgggcgtgagtcaccgtgcccgacctgctctgatctttctgaactctgcagcctgagagattggggctggtaaagactgcgggttgccaaacataactagaaacgtgggttagggggttgtggaagacgaactgatgccccatggcttgtaaaggctgagagttcccttatttctccttaaggcctcatggggctgaagaacctggaggagtgtgccagggccatttgtcctccagtttacttgatgccaaatttctcctgtgagcaggttgtactcgtaaaacaaggatcatcgatgttgtctacaatgcatctaataacgagctggttcgtaccaagaccctggtgaagaattgcatcgtgctcatcgacagcacaccgtaccgacagtggtacgagtcccactatgcgctgcccctgggccgcaagaagggagccaagctggtgcgtgttacttccctgtaggggttgtggggagggcagcctgactccagccttctcgtgatgaaaactctgtccagttctgctactgaagggagagagatgagagccttttaggctgaggaaggccagcactggggtgtgcagggttcgagaaagctcccagggcctgccttccttccctgagctcatatatttgtatccccttttcagactcctgaggaagaagagattttaaacaaaaaacgatctaaaaaaattcagaagaaatatgatgaaaggaaaaagaatgccaaaatcagcagtctcctggaggagcagttccagcagggcaagcttcttggtgagaaggctgttgtgttggaggtggggagtcgcagagattgagtgtgccgaggcacttttcccttgtctcagttcctttgactgccagccatgcagtctaaagggttcactgataacaggctgcgagcacaaaggggaacgtttggtcaccctattcgtatgaagctgaaatgggaagcattgggtagaagagtctgcataggcccgtgcttggagtctttgtatttggggaagtctctgcccaggctgagggggctgtctcagtgatgaaaactttgtccagttctgctactgacagtaagtgaagataaagtgtgtctgaggagacagctggcttcatgcttgcccccagggtacctgaacccacagagattcttaagcgggtggagaggtttgggtagggccaccttgtcgttgtgctaaggatcacctactctcttgcagcgtgcatcgcttcaaggccgggacagtgtggccgagcagatggctatgtgctagagggcaaagagttggagttctatcttaggaaaatcaaggcccgcaaaggcaaataaatccttgttttgtcttcacccatgtaataaaggtgtttattgttttgttcccacatttatgttgcctgaatatatgactgttttctctgctttatttccttgccctgcaaaactgatctgggtgggtggctgcaaccccttgccttaacctctgcctcctactgtcctgagccaggctcaccacactgtaaagtccctgttctcaactccatgtccctgaaggccagatttattatgtgggctatgtctatagtgggaacatttctcaccacattttggtggggatagggatgtggcagaggctatgagggggtatcccaaccttggggt

SEQ ID NO: 220 - DNA, 1722 bp, Homo sapiens; identical to SEQ ID NO: 219

SEQ ID NO: 221 - DNA, 1722 bp, Homo sapiens; identical to SEQ ID NO: 219

SEQ ID NO: 222 - DNA, 1227 bp, Homo sapiens
accccatatcacccttcgaggtgaattggatcggatgccatctcctccaggaggggtggggtcgtgcctcctgtgaggtcccagtgcccctgagtgtctgtgcccgtctgtttccccgtccctctctctaagcccggaggcttactgcgggtaaggacggcgggacaggaccttaacccctgggacgaacaccagctccgcaaaggactccgcacccggcgccgcccacggggtgcgggtcccaggaggaccagcagagaggagcataggagagcaaaggagatcagtgacccatggcttccccggtggcgcggaacagcccggagccgcctgtgatttgcatacccatggtgcaccacgaaaagataccctcaagatgcttgcactccctctgtgcgcgcatttctgcactgttttagagcatgatgcctcttacacgcatctgtgtgcataaactacatatagggagtgcgtaccacgcaggcatccaacaaccataagtgtgttaagtgttagttctccctgcgaggttcgaagcggaagtcacgaatatactcgggtttctcttcaaagcgcataaatctttcgccttttactaaagatttccgtggagagaaagttgtgagtttttattcaattttttgaggcctcttatttcctgaggctacatttttaagtattaaaagttaggcaactacaaccaaggaacttggtcatttgttatttgtaccaaatgttcacaaacttattcgggcgtggtggtgcctgtttgcaatcccacctattggagaagctggggcgggagagtctcttgactctagaagacggaggttgtagtgatccgagatcgcgccactgccctctagtcagagtggcagagactcctggggcgggagagtctcttgactctagaagacggaggttgtagtgatccgagatcgcgccactgccctctagtcagagtgacagagattcagtgtaaaacaaaaaaaaatcagaagtttgcgtgacaccttgttttgagctacatttggggtttattggcttctgcagtgtgcagtaagactggcttctattgtttatttcttgcgtttttgttgcatttcgttgcagatttaagagataaacagtggaaggcgctttcaagtcgtccggtcattaattaagccttattgtggctagaggttcaggggcggtatatcgcgccaaccaaactccttgttctat

SEQ ID NO: 223 - DNA, 1278 bp, Homo sapiens
gctactcaggaggctgaggcaggagaatcgcttgaacccgggaggtggaggttgcagtgagctgagatggcgacattgcactccagcttgggcaacaagagcgaaactccatctccaaaaaaaaaaaaaagagcaaactctgtttagatgacttttctcaaatccttaaaaaagatttatatccaagtcatcttgttggtataggtggtgacatacatctgtagtatctaaattggacttaagagttttgactctcaggaccttgatttcattatttaactgtgtctcattttagcagatatatgtatatatgatagtgattttgccttctgtgattttatgttttgttttttcatttacagagtgatagattcgtgtggcctttcaaatgattgtgaagtggtggaaatggatccaaaataataagtgacttctctaccaaagcatagaagattcttcatatctccttccagtggctcaatttagattttgggaaggagcagaacaagtgaaacacagaaaactgaagagaagaaatcctcattttggacctatatttctccttgactatttcttaatatccatcctacccatcgttctaatgttttaactttgctctgaatttataaatagtaaaggccaaagacatagaatatacatttagtagctttataccaagaaatttgccttgaaagctgctgttcgtggagggaaaagtgtagcaaattcctgtctatttttattttttatttttttttaacaaagacaagatttatgtccctagattttgaaggttaaggcaaatataaatacatatctgcacactattttttagcagttgcatgagtaagagtaatgagatttgtattttaaggactttgtcatgtggatgttttggagttgactgctcagatcttttatagggctttaatatttttgatctattaccttgatgacattatttgtccacacttgagcccatctgtctttctagctatgaccttgttatgaacagtatttgcactcggtgcaaatatccatgtcttacctaattaagcaacatcatagtgccataactcaaggaagttgaatgaggtgaacatagatacagctctttccccttccccccctttttaaatgtaacaaatactttttatgttccccttccccccttccccttttcccctttccccttttggaaacgtgtcaggaaccaaatagtttaagatgagcagttgaggggactgagagagtgatcgacacagaacctggcttctt

SEQ ID NO: 224 - DNA, 1150 bp, Homo sapiens
gagaggagggggagggttcatcctattgccaagctggtctcgaactcagggactcaagcaatggtctcgaactcagggactcaagcaatctgctcactttggcctcccaaagtgttgggattacaggcgtgagccacagcgccaggtctaagtagatactgttttataccctattttgtagttgaggaaaaggagtccagagattcatccagctggtaggtaacagtctatattcaggccgggcgcggtggctcacgcctgtaatcccagcactttgggaggccgaggcgggcggatcacgaggtcaggagatggagaccatcttggctaacactgtgaaaccccgtctctactaaaaatacaaaaaattagctgggcgtggtggtaggcgcctgtagtgccagctactcgggaggctgaggctggagaatggcatgaatccggaaggcagagcttccagtgagccgagatctgcgctccaacctggggacagagcgagactccctctcaaaaaaaaaaaaaaaaaaaaaaaaaaaaggcctatattcaaatttaggcaatctaagttgttgtgtttaacttgactgttatggtcactgcctttaaacatgaaagtaagactgttggtctaaaagatgaaaggcagacaaaattttaaaggattccaactaaaaaaaaaaaaactaatgggaaaggcaaattttggtgtatttatggttgttcagatagatgaggggaaaaataacataccccctaagtggctgtagttgctgttgtctggaatttaatacgtggttgtgctgttagagacctaattgcccaagttacttctaaatcagacttagtgtttcctatttcccactgaaatctgcctcaaacagcctataatcaaacttggaaaatagttcagtaagaggaactgaacttttgtccacaggtatactttaactgaggtagatatatttctaatgttatgtaaattgaatttttataggtgatttcaaacgtgctaggcaaacatttaaaagagcctattatttttctttactaaggcaaataattgatctgttagctgaatcatttttcagctaaaacagctcaatcatttatttttgttaagaaactagggattgggagtatctagatgacc

SEQ ID NO: 225 - DNA, 1226 bp, Homo sapiens
tggagaacccctccccctcacacacatactgccccaagatccagggagcctttgctctggaatcttcaacctcagaacctcctctttatactcttagaacacctcttccaacctccttgtccaaattcatattctaaaagatgctatctcttacaaattgaggtggtttctgaggaggggtgggggctgggccaaagggtcgtcagtgacccctccctacagctctctgacccatgtctctgtctccatcccaccctcactagtgcctccatatctgggacctggatgtgcgtggcaaccatcggggcctgtggagattgtttcggaagaagaaccacttcctgatggtgggggtcccggcttccccctactcgtgagtgacccttttctgccctgggaaacaggaggcctagtgagatccagggatatagctaatggcttcttctctatacattcttgtattattttcccagagtgaagaagccaccctcagtcaccccaattttcctggagccacccccaaaggaggagggagccccaggagccccagaacagacatgagacctcctccaggaccctgcggggctgggtactgtgtacccccaggctggctagcccttccctccatcctgtaggattttgtagatgctggtaggggctggggctaccttgtttttaacatgagacttaattactaactccaaggggagggttcccctgctccaacaccccgttcctgagttaaaagtctatttatttacttccttgttggagaagggcaggagagtacctgggaatcattacgatccctagcagctcatcctgccctttgaataccctcactttccaggcctggctcagaatctaacctatttattgactgtcctgagggccttgaaaacaggccgaacctggagggcctggatttctttttgggctggaatgctgccctgagggtggggctggctcttactcaggaaactgctgtgcccaacccatggacaggcccagctggggcccacatgctgacacagactcactcagagacccttagacactggaccaggcctcctctcagccttctctttgtccagatttccaaagctggataagttggtcattgattaaaaaaggagaagccctctggggatgtcttgtgattgtgattttgtgtgtcaggggggtgctggagggaagtggtggagagaatacttgtgttggatggt

SEQ ID NO: 226 - DNA, 1127 bp, Homo sapiens
aaactaattccgattggctaatttaaagacagtgagggggtgagtggtttggcgggaaaaatggttaccgcagagcaggaaatcggaatgaaccacggtgaagaatgagtgagggaggagcaggtaatcgaaaaatgttgctttatgaggaagttaagtttaaaagtagaaggcaaagaattgaagatactgacatattgattcttttaagataaatttagaactcatatctaacagctggcatgtctggcatggggctccggctggggcgcagtcttcagcatttggggctctggggtgcagggggcagaggacggccggggctgtggtgcccaaccggtgctaaactcaagcttgggaggtcgcccacgagaaacagtcgcccttccccacccgcctgctcggcttggcggggagcgggatgtcgctgggggcgatgccaggcgggccgcctctgatagcctctaggctctggcgcgcttccccgcccctcccgcgcaggcgggcgtgggatcccggctgatccagtccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggcggcgcagcgcttccggctccaggtgactgccggagcgtagtgggatgggcgcggcctgagggtactcgcagcggcactttcagccgccggacccgccgagggacaggggatggggcgggcagagcagatgtgtaactctccagaatctctccttgccctaagatattccgcactttctgagccaggtagagcacgggggaagaaaggaaacggtagtgtcaaggcaggtggtggaaggcctttccctcactgggtcaaagaggagttttgctttgtgccaaagaatctcacgattgctgcctattggaatgcgaaaacgcaagcgtgacaaccagtgggatgcc

SEQ ID NO: 227 - DNA, 1251 bp, Homo sapiens
cacagtccagaagttgaagctggagagccttccttgagaggaataccaaatcagttaaaccaggataaaccagctcttttgagacactgcaaagtaagacagccacctgcctataagaaagggaacccccataccaggaacagtattaaaccatcttctcataatgggccatctcatgatatatttgaaaagctccaaacagtttctgctggaaatgtacaaaacgaagagtatcctataagaccctccacacttaattctaggcagtcttctcttgccccgcagtcccaaccacacgattttgttttttcaccccataattcaggaagaccaatggaacttcagatacctactcccccactgccatcttactgttccacaaacgtttgcaggtgttgtcagcatcatagtcatattcaatatagtccgctaaattcttggcaaggagcaaacacagttggatccattcaagatgtccagtctgaagcccttcaaaagcattcattatttcacccaagtggatgtccagccctgtactgtaatgcattctgttcttcaagtagtcctatagccttgagacctcagggagatatgggcagttgttctccccacagcaatattgaaccatcgcctgtggcaagaccgccttcacatatggacttatgtaacccacagccttgcacagtgtgcatgcacacacccaagactgagtcagataatggaatgatgggactatctccagatgcatatcggttcctcacagaacaagacagacagctaagactacttcaggcacaggtttgcttggtgctttcctagttctattaatttcttggtattaagatttcttaaaaactggcacctctcctcagtaatgatgttttatagaagtatagaatgtcagaattaggagggaccttggaaactgaattctaggccctcttgttttacaggtaagtaaaatgaggattagagagaataatttaacccaatgccacgttgctagttagtagtagaaccatcttatgcatatcctaacctacaatagaattgtatttttattttttgcctctaatgaaaagtctgttataattaactaagcctttatatacagctaaatataaagtctggacagtggcttatacttcatctctagtttgtcagccctatataatgcctatctatatagttagagcctttctgcatatctatactggacttattctacttcttgttttctgaaatgttccc

SEQ ID NO: 228 - DNA, 1178 bp, Homo sapiens
ttctgggttcatatcctagctctaccacttgttaggtgggtgaccgtgatcaagttaattaactaagcctcagttcttcatctgtaaaatgaggatggtaatctctgtctcacagaagattattgtgtggggttgaataagattactaaactaaagggtctagtatgtaataggcactcagtaaatactagttccgtccctccttcaattattttcgtaatatagatctttattgatgggaaatagtacctgaacttaggaggctaaaaattatatcggtgtttgtttactttctagacaagtgggaaattggttgggttccttccctcttacaaatactgattccttgatgggaataatttcacattaggtataccaagtttcctcagatgttcctaagcctttgtcaagtgaagtaggagcttgccacctgtcttccatttttctcagtctgttactatggggactgggcaaatcagcttgtattatttggctctttggatcatttattgctcttttttcccctagggaacgacagttaatgctgacatgtgaatttttttttcttccaaaccagaattgcattcatgggtcgcctttattctctgtaatgtctttctttgtgccagatgttcttgatgaagatagtgggaaacatgacccaaggaggctatcgtattccttttgctttaattttggcccttgtgttctacccccctgccatctcttatttgaaaatttgtcggtgggcaaggtggcttatgcctgtaatcctagcactttgggaggctgaggtgggcagatcgcttgagctcaggagttcaaaatcagcctgggcaacatggggaaaccccatgttgacagaaaaattttgtcttctattcttagaagggtacagttgtgtaacaagttcagtgtattctgtttttaattaaaaaaatttaaatttttgtgggtacatggtgtatgtatttatggggtatatgacatatttttataaggcatgcaatgtgtaataatcacatatgggaaatagggtatccatccccttaagcatttatcttttgtgttagagacaatccaactgtacacttttaattattattatttttttttttttttggagacagagtctcactttgtcacttatgctggagggcagtggcgccatctcggct

SEQ ID NO: 229 - DNA, 1178 bp, Homo sapiens
tggctttctcactagaggtctatgtgactgtgggcagttctcctccccaatctgtcccagataaactatgtaccaatgttgaatggtcttagcagttccttcgggccctcagattccatgacacacatgcgtttgacctgaagaacttgagttttgctccatctagcatccaccacccccacccccacccactaccttgcactcccaatctgctgagaatcagagctccagaggaacacctattgtgtcccatctgttggcgacagagccagagagaggaatgctgtgccacatgtgctcttgtttattcctgatactttccagagaaccagggatgggggaaaaagggagggaggaagaggcctccacgcaggatcagttacaagcattgttgtcccactccatatgtagacactggacaagcacagcagacaatcagcatgtgggaaaacctgggccttttaccaactagcatcgtccaaaggtcaaatttgagacttggaatttaaaagggaaacaaataaaataaacgagcaagcagctctgaactggttgcctcagatgagagaacatgagaagaccacatccctgccctttgtgctagtcagtataggctgggctaggccattaatacagaaaaactcccaaatctcagtagctcatcacagtaaagttcatttatttgttgaacactaataaattttgccaaagctgaaattttgaataaaataatagcttccatctactgagtacctatttatgcccaggactatgctatacactttgcataaatcagctcctttttacacacgaagaagttgagattcagggaggtgaagtgatttgaatgaagttacaaatctaatcaatggtagactgggattgaaacccaagatgatctaggcctgaggcctgtgctctttccttactctacactgcctctgaaggggaccttgaagtggacccgatcccttatccacatcaatcaggcacatcttgcacggaagaggatgagtaaaagaaatcatctgacaaatggcttagggaatatatttttacaaaaataatttgcattgtcctttcagcttgcccactgtcaacagtggaggctactcagtgcccaactctctattgtggacttgtatccccagatcagaagcacctcaagcacaggggct

SEQ ID NO: 230 - DNA, 1176 bp, Homo sapiens
tacatctcatcttcagtttacaaagagctttcatatgtagtgtatttcatgttatccataacaatgtgaggatagtgtaccatatttcacaaagagaaacctgagaaccactgcagtaaggaagtggaaagtttagaaatgctaccattgcctccacctgccaaatataaattaatgtgagctttttgagagacgcataacttactttgtctctgacttctccagttgtacccattttctcatttgttttgcacttacttgtatactatatgctggggaaaaagacaaaaatccctgtctttatttagtttgtaagcattcttcatttcccgaaggttggagaccttcggtctacaggtatcacagaaagtttaggaagtatgtaagccttaaaaggaaaaaatagtaagctttactctagcaaatgagtttatttgataaaaattttataacgcttatgtcctgttgttattattataacttattcttagaatttgataggccaaaatcaatatgaaactaatcaggactttccttaaatagcaaatcaccgatgttcatatggttagtgatagcgatggagatgactttgaagatgctacagaatttggggtggatgatggagaagtatttggcatggcgtcatctgccttgagaaaatctccaatgagtgagtattaatagctctttgggtccagcaatagaattctttcttctagtacacaaacttatgaagaacattaaacttaaacatctcttactgacctccaggtttgaggagataagataatagagagtaggcattcttcattagaaccagagccttttgaatttagattttattaaactcaaaaattctcagtgcattaggaaaattcattaaaaatgcaaggtagtgtaacttttgttttacatgtataatgaattatgactgtctctctttaaacctagaggctgattaacaaacaggtgtactttctgtgaccgatacttgtttccccacatcttattagagatatcagttttaagagtaataatgttacttttctattcaacggtacccatctttggaaggaaaaaagtaaactaaatgtaccatctctttcacttccacttacaagatgtgtactatagaataacaagacatgctacgtgcaaaatgaccactaaaataat

SEQ ID NO: 231 - DNA, 1222 bp, Homo sapiens
acaatgggtaaaaaaaatggtagagaacttagtgaactagggcacaggaagtgaaagaggaaactgctggtcttgtccctggcttctgtgaaatctaacgtggtatgtatgaccttgtaagtaattctaattggctctatttttccactaagagaaacaaatctagaatggaggaagggggagtgggaaagctacatattttctcatttaaactctacccttgtggggagaatcatcatgggcagaaattttatcttccctgtgaacagaggcagaagcctgagaaaaagcaaaagaaacttacaccttctccctgaagccttttcagactctctgtgtttgttatgcactccactatacccattaagtttggtacaataagcgaaaaattctgaaatactctttatctctgcttcttataaccatccagcagcagtggtaataggtatctacctgtgctcctagccctcgtcctagcaaagaggtgcatgcatccactgagcaggggtgtgtgtgtgtgtgtgtgtgtgtgtgtgtgtgtatgtgtgtgtgtgtgtgtgtatatgtatatatatatggttgttttttttttttttttttgaaagacagtcttgctctgtcacacaggctgtagcgtggtggcattatcatagctcattgtaaccttgaaccaccctgggctcaagcagtcgtcctcctgccttagcctcccaagtggctgggactaactacaggcatgtgccatcatgcttggctaatttttaaattttctgtagagatggggttttgtgctgggtgtggtggctcacgcctataatcccagcactttgggaggccaaggcaggtggatcacctgaggtcaggagttcgagaccagtctgcccaacatggtgaaaccccatctctactaaaaatacaaaaattagccaggtgtggtggcaggtgcctgtaatcccagctactcaggaggctgagtcaggagaatagcttgaacctgggaggcggaggttgcagtgagccaagatcaggacattacactccagcttgggcaacctgagcgaaactcagtctcagaaaaaaaagaaaaaaaaagagatggggttttgctgtgttgcccaggctggtcttgaacttctggcctcaagtgattctcccatgtcaccctcccaaagcactgggattataagtgtgagccactgcacctggtcggaatgtgtattga

SEQ ID NO: 232 - DNA, 1211 bp, Homo sapiens
ttccgcggaggtttcggcagtggcatccggggccggggtcgcagccgtagacggggccggggccgaggccgcggagctcgcggaggcaaggccgaggataaggagtggatgcccgtcaccaagctgggctgcttggtgaaggacatgaagatcaagtccctggaggagatctatctcttctccctgcccattaaggaatcagagatcattgactttttcctgggggcctctctcaaggatgaggttttgaagattatgccagtgcagacgcagacccgtgctggccagcgcaccaggttcaaggcgtttgttgctatcggggactacaatggccacgtcggtctgggtgttaagtgctccaaggaggtggccaccgccatccatggggccatcatcctggccaagctctccattgtccccgtgcgcagaggctactgggggaacaagattggcaagccccacaccgtcccttgcaaggtgacaggccgctgcggctctgcactggtgcacctcatccctgtacccaggggcactggcattgtctccgcacctgtgcccaagaagctgctcatgatggctggtatcgatgactgctgcacctcagcctggggctgcactgccaccctgggcaacttcgccaaggccacctttgatgccatttctaagacctacagctacctgacccccgacctctggaaggagactgtatttaccaagtctcccgatcaggaattcactgaccacctcatcaaggcccacgccagagtctccgtgcagcggacccaggctccagctgtggctacaacatagggtttttagacaaggaaaataaagcgaattaagcgtaaaaaaaaaaaattgtcacaaatctcaaacaaaaattccaacatacttgtgtaaacaaattagcactgtaagtggacccacgctattcaactctatgttgttcaaaggtcaactgcatttctatacttctacacacctattaaaatgtctaaaataaaacagatctacaattccagagatctgttgtataacatagtgactacagcttagcataatgtattgtgtatacttgaaaactgctatgaaaatacatcttaaatattctcacaatagcaaatcataactgtgaggtgaaggatctgtaaattagcttgtctgtggtaatcatttcatgatgtatacatatattaaaacaccatggtgta

SEQ ID NO: 233 - DNA, 1180 bp, Homo sapiens
tatcaagcctctttctggaacattctttcactcaaaggaggccccttgagaagaggcattatcaaaacatcaaataggcagggcttctgggatctcttagtttcatctctcatttttatatgggaaagctgagacccagaaaagtcaggggtttgctttcctagccttagactcttcattcattcattcattcattcattcattcattcattcatttacctaacagatatttattaaaagcctactttgtactggatactagttgctggggatacagcagttaaagattcttgcttcctggaagcttatagtttagtggagggagacagacaataaacacaaaaataagtaaaatatatcacgtcagagggtggtaaaagctatagagaaacgtaaggactggaaagggctcaggtattctggaggagccattggcaaagtgaatttgaaaggccctgggcctctcgtttggggctgctgacccatagtgtgacagcccattgtgacaacgtcagggattctagagtccaggcctgggggagggaggaggccttggagaaggaggagggaaaaaggggctgtgggatttagtggctgggctgcaccccctgggggggcagcagagcccaatgggccagaagggccacaaagactccctttacccttgtggagggtaagatcattgattcctgaggcctctttgcaccttgcccttggcccctcccccacctccaacagatctctgatgacattcccttctgctccccctcccacccttgggaacaccaagaggtgggtccaaattgtccctgcgtcccagtacagagtggcagcctggaggagctcgtgacaggcacccaaggctggccagggaggctgagtagaccctgtgaggctctgttccagccaggagaggctggagggttggagggcccctgtgtcatgccccgcatctcttcccccaggactcctgagagcagcctccatgaggccctggaccagtgcatgaccgccctggacctcttcctcaccaaccagttctcagaagcactcagctacctcaagcccaggtgaggctcaagccccggttggggtagggggtgtgcatgacggtcagggagaaccagaggtcttgtatgagaggaaccctgtgtaactaaatgcctttggctttctgggt

SEQ ID NO: 234 - DNA, 1202 bp, Homo sapiens
aaagaactacaataaccagtgtcctgggatctcattgatttcagattccctgccccaagcctacacccaattacctgccatagttggggaatcaagtagcatcctgtggctggaagtaaatgcaaaacactagtccgtgagatataaatactgttaaatgatggttttttaaggtcctgatccattatatgaagtagacaaaattcaaatttatttattcatttattttctcaacaaatgaatatatattatgtgccaggatacaagtagtggcaaattagacacagttcttgctttcatgaaacgtatagcttcatgatttagtatagacattgtcaaatcatcacccaaatataattacaaagtactctaaaggaaaggcacgtgatgctgtgagaacactcaactgggaaaccggaatcacctttgagaaactgtttcaggggctcttggaagagtctactgctcccaaatatctctgctacccactggccattgctttacattcctcaactaagctttcaccttttagtactaacctttgatgactgatcaaatacaaatgccccaagaagactgaggataggagaaagaatatctctacctgtgaaacattgttagactgcctggctaggagttcattgttgttttctgaaggacgtaaccaaccactccaaaacttacaggcttaaaacaacaaacatgtatcatttcttatgattctgtgggttggctgggtggttcttctggctgaggcaggatggtctaggatagctacatccacatgtctggggtcccagctgagatgactggggctgttgaggcctttctccctgtggtgtcatcctccagaaggctgcccagatttgtccatatggtagcaggagtttcctcgaagcaagagagggcaagatccaacacagaagcacttttcaagctctgtttccatcacatttgccaatgtctcactgatgaacacaagttccatggccaagtccagttttaagaaatggagaaatagggcttggctcagtggctcatgtctgtaatcccagcactttgggaggccaaggcatgcggatcatttgaggtcaggagttccagaccagcctggccaacatggtgaaaacccatctctactaaaaatacaaaaattagctgggtgtggtggcgggcatctgtaatcccagctatttgggagg

SEQ ID NO: 235 - DNA, 1203 bp, Homo sapiens
acacttagttcagccccatataatttacccaagtccttgcttgcttgcttgcttcctttcttttatagctggtcactactatatttgtttattaatttttagatagcctttatgaggtataattgatacacaaaaaaattcacttatttaatgtatacaatttgatgagtttggatccaaaaccctggtttctttgcctcatttccatccacccttcaaactgaagccaggaatttttctaaaatgcaaatctaacttgtttaaacccttctatggctccccagtgcctatggtggtggtctccaacttacatccctttaagtaagaaaaatgtaggtacagcacacacagtatatgtgtattctttagattatatatctatatgtctacttctatacacaagatattaaaatatataaaattaaaataaacaatatttaaatgtttaaaatctaatgtattcatgaatagtccagaaaactttatttttgctgcataaaagcacatacacacacataaaaaccctttgctaattttccttcagcaaaagcaatgagattgaccatgtcatctatggctataccaccctgaacgcgcccgatctcatctgatctcggaagctaagaggggttgggcctggttagtacttggatgggagattgactatgtcgtatctaattagattatcattgattttacctcgaaacgtggctgacaatgaacttgtgttgggagttggaaaaacaccagttcagccattttctttatgctcacttggattcactataatcttctagcatagtcttcaatcagaggtttctttataggactctttaaaagccacatatccattatgaggtttcatttagttaaaactagaccatgtaatcaataaatccacttacccaggcacaagaaaaccacaaaagctcacaattggctgaacataaacaaagaagtgagtcagtccactgtcaacccctcagaagggcacaatgcctcctcctatctcaagattttttgagtgtaggctatctgaccatctgatatgggggtcaaacaaagacacttctgtcaatccacatagtaaatatcagtaaaaaatatcttatgttcaaagattaaaagtaagctctaataatttcttcagttccctaaggaatcatcaagcatgaatcctctgaccgatgacaagaactttct

SEQ ID NO: 236 - DNA, 1142 bp, Homo sapiens
gtccctgagttgaggataatgggaggacctaggaaggggctcactgctcctgccttggggtggcacaagcctaggtttgaatcctagctctgccacttaaggattgcagtgataggaaaattaatgttggaagtttctcagtttattcaatatatgaaaaggggatattatccatcttgcagatttgttttgaagctctgttggactttgaaaatctttacagatgtgaaaggtgttgttggaggttggagagagtggatggccatgtctatgtcaggctaccgtaggcagaggtgcagagaaaggagcagcttgttgcttggtggggggccaaggaaggtttccctgttgagggtcttttgaactgggtcttaaaggaagagcagttttccaggtgggactctgctgtgggagggaagagggatttctgcctgggtggatctaccaagcccctcctttactcatccctgaacttatctgagttgtgctgacttgttgtgacctttttcccccagcccccctgcccatggcccacatcgagaagttggcggcagactgtatgcgggatgtggaggaggaggaggaggaggaagggctggaggaagatgcagagctgctggtgtgtctgccaggctggtatcccagggctctgaggcaagcttgggcctggtggaggagagggcagtggagaggaggctgggggtgcccctgtattctctgactctgagtgagtgcttgcccctcctggctgtacagtgggtggcgtgtctctttgacttctggtctaagctctgcagttggggattctcagatttggagtaattactattttcaaggctatcctcggtcagattaaagaaatgttttggtgaaggggactcaggcacagtgactgacgttagggaatattgctgagagagagggtcctttactctcaggtcctgttgtgggtatggtcttgaggcccccaagctcctgggctgtgttttgtctccctagacggagctgcaggaggtcttaggtgtggacgaggagactgagcccctggatggtgatgaggtagctgacccaggcggctctgaggaggagaacggcctagaagacactgaacctccagtgcagacagccgtcctgacagcttc

SEQ ID NO: 237 - DNA, 1182 bp, Homo sapiens
tagtctacaaagcatctgattttggaagtacatggaattgttgtaacaaagtatattgaatggaaatggctctcatgtattttggaattttccattaaataatttgctttttcctgagtgtttgtgaagttattacattataatcattacaaacatctgattatgaaaccaaactgtccttcctacaatagtccttccatgtgacttttatttctgttactaggcctgccatttatttaatgctaacatatataaaatataagtacacgatttacttgtatctatataaaatagttctgggagagtatgcaaaaaactggttacactgattacctctggaaagaatcagatggaaagaatcagatggccagggttaggggttagaggaggacttttcactgtatgtcattatctgtcttaagtttcaaataatataaataaaatttaggccaggggcggtggctcacacctgtaatcccagcactttgggaggccgaggcaggtggatcaggagatcgagaccatcctggctaacacggtgaaaccctgtctctactaaaaatacaaaaaaattagccagttgtggtggcgggcgcctgtagtccagctactcgggaggctgaggcaggagagtggcatgaacccgggaggcggagcttgcagtgagctgagatcgcgccactgcactccagcctgagcgacagagtgaaactccgtctcaaaaataaataaataaataaataaataaaatatagtttataaaaaaggaactactggaaataatataaatcataagtaatctctagccacaaatagctagaaagtgtaatttttacaaaggtaccatttaccataaaaacaaaacaaacctttaaatacaaaagatttatatgtcacagaaaatataaggtacttagaaataaattgatttaaatatttatttatttatttattttttccctctgtcaccaaggctggaatgcagtaatggatcatagctcactccagccttaacctcctgggttcaagtaatcctgcctcagcctcctaagtagctgggattccaggtgtgggccaccatgtccgtctcctaggaataagtctaataaagagatgcaagtaatctctagatagaaatcaattccaatcaaaatcttggcaaggtttcttgtatgactttgc

SEQ ID NO: 238 - DNA, 1109 bp, Homo sapiens
gacagtagaaagagagggagagggagaccgtggggagggggagggggagagggagagggagaggggatttttttatacattaaggaaacaagcctttgactatgatattgggtgcatgtattttctcccattttactgtttatctatttttaattcatttatggcatggtttatgatgcaataattttttattttcacgtagttgaattcattctgttttactatgcatctgggatcgatggcacacctgcaaagtatttccctccatcatgaagtatttttaaaaaattctttgttttgttttgtttaagagacttgatctcatcctgtgctgaagctggtgtgtagtggcaagtggcatgatcatggttcattgcagcttcatcttcctgggctcaagcgaccctcttgagtagctatgtttgtagccaccacattcagcctcctcacgtttttaatcctgtgatttctgttcttttttttctttggaatttttttgagatgttgggtcgttcaagttttcttctctgtgtgtttctacttgtctttgcactgtttatgctacctttatcatattaaattcccgtgtatatatctatttttggactttattctgttccattaatttgcatgtctgtctactcactaacttttatcttttttttttttttgagacagagtcccactctgtcaccaggctggaagtgcactggcgccatctcggctcactgcaacctctgtctcccgggttcaagcgtttctcctgcctcagtctcctgagtagctaaccacaccaggataatttttgtatttttagtagagacggggttttaccattttgttcagcctggtcactaactttatcaatacttaaatatttaagatctgtcctcggatttcttttagttatccttatctatttgttgtttctgtgcagacaccagaattggcttgcctgtttctgaggaaaaaaacccattttctttgggattgtattatagattgatgtaggaaaattgacgtcctgtaatttcccctatcttggaacaagagtatgtttattcaagtctttcatgtcctccagaagtatgttcaagtgtttgtcattt

SEQ ID NO: 239 - DNA, 1130 bp, Homo sapiens
ggccaagctggtctagaactcctgacctcaagtgatccacctgccttggcctcctgaagtgctaggattacaggtgtgagccaccatgcctggccaatttaaaaaaaagatttttttttttttgagactcggtctgttgcccgggctggagtgcagtggtgtgatctcagctcattgcatcctccacctcctgggttcaagtgatcctcccacctcagcctcccaagtcgctggactacagctgcatgccaccacacctagctaacttttgtacttttagtagtgacagggtttcaccatgttggccaggctagtcgcaaactcctgacctcaagggatctgcccacctcagcctccaaaagtgctgggattacatgcatgagccatcatgcccagcctaatttttaagttttcctgttcgtccaaggctactgtttcctgcaagttgctttttttcctatttattttgttccattgtgttagagattttcctaaagttagggtgattctgagctgtccatggggacagctaagagtgggactgattgaaaactgcagacaggtagaatgtgtcagaggcttgctctgtcacccaggctggagtgcaatggcatgatcatagctcactgccgcctctgcctcctgggttcaagtgatccctccgcctcccgagtagctgggattacaggcgcctgccaccatgcccagttaatttttgtatatatttttttagtagagacggggtttcaccatgttggtcaggcttgtctccaactcctgaccttaggtcatccacccacctcggcctcccaaagtgctgggattacaggagtcaggcactgcacccggccaataaataaaattaaaaaaaaaattagctgggcgtggccgggcacggtggctcacgcctgtaatcccagcactttgggaggccgaggcgggcagatcatgaggtctggagatcgagatcctcctggctaacatggtgaaaccctgcctctactaaaaatacaaaaaattagctgggcgtggtggcgggcacctgtagtcccagctactcgggaggctgaggcaggagaatgacgtgaacctgggaggtggagcttgcagtgagccgagatcgtgccact

SEQ ID NO: 240 - DNA, 1198 bp, Homo sapiens
gtgagctatgatcgtgccactgcactccagcctgggcaacagagcaagatcctgtctctaaaaagaaaagaaaaaaaacacagctgaatccatttctcaaagtgtaatgtgtatttactatttaagaaggaaatctgatgcaaactgtggatattgacagtttttttctgggctgagaaaactctggaaccatttgctaccctatcagagtggtttgtccactagatggtggccatctacaccatccctggccctctcctatccggaaacctttattctgagcacccagtaacataggtggaagttgaagttttgtttttcaggttgacccagaaggtctcaactctgggattactcatgccagtacttgtttttggtagactggtgttttggtatacaaagctacttttaagtactgaaaatatcagtaattatatagtaccaatattttagtatatttggaaatctgaattattttgtgattgttatttagttaaggcaaaaagacaaaccctatagtctacaggtctagatatgaaagctgcaatcagccactccattgagtgacccagagttctgtattagttcggagactttctaaccaagtataatagaaacttgacagcattaatattgtctaggcaatagcatcagactcttcatttatatatgatgaagcttaaaaaaaaaaaagacaaatgctttcaaaaagctatagtccctcacctccaaattaaagaagatctgttttaagaagtattaggattatttacatttgagagacaggaaagaaaggatttttgttcaaaattatactattttattttattaacagaatcttgctctgtcacttgggctggagtgcagtggtgcgatctcggctcactgcaacctccacctcccagactcaagtgattctcgtgcctcagcctcctgagtagctgtaataaaaggcatgagccaccatgcccagctaaattttgtaattttagtaaagacagggttttgccatgttggccaggctggtctcaaactcctggcatcaagtgatcctcctgtcttgacctcccaaagtgctgggattacagcaatgagccactgcacccggcttcttttctgttttaatacaaatgaggtctcactatgttgcccagcctggtctagaacccctggtctcaagcagtcttcccacctcagc

SEQ ID NO: 241 - DNA, 1228 bp, Homo sapiens
tgtatagtaaactatagtcaccctactcctgtttcaaagtacttggtacagtttgcagttattttgtgtttacttctttttctcctccactggaagaatataaactaagtgagtgcaaggactgggtctgatctgttcactatcatatccccagtgttttgaaatgtcttgcttggcatgtagcaagaagtcattaaatatttatgaaacgaggccaggcacagtggctcacatctgtaatctcagcaccttgggaggccaatgtgggaggatcgattgagcccaggagtttgagaccagcctgggcaacataacaaggcccctgtctctacaaaaaatttgaaaaattagctgggcatggtggcatgcgcctatagtcccagcttacttgggaggctgaggcaagattgcctgagaccaggagttcgaggttacagtaagctgtgacaggaccactgcaccccagcctgggcgacagagtccctgtgggaaagagagagagaaaaagtatgaaataatagaaggaaaagggaaagaggaaggagaaatggatttgaggactgcagggagacatacatgagaggagaggggtagaaaaagacagatgcttattgaacaactgctgcactttttttttttttttttgacaggttctcactctgtcacccaggatggggtgcagtggtgtgatcatagctcactgcagcctctatctcccaggctcaggtgatccttccactttagcctcctgagtagctaggactacagacacatgccaccataataggttaataaataacttatttatttagaaatggtctggttccatcacccaggctcaagcaatccttccatctcagcctcctgagtagctgggactacaggcacgcaccaccacaccaggccaatttttgtgttttttatagagacggggtttcaacatgttgcccaggctggtctcgaactcctgagctcaagcgatctgtccgccttggcctcccaaagtgtaggattacaggtgtgagccactgtgcctggctaactatattatttatttttttgtttctaaattgtctcctccactaggatgtaagattcatgagggtagcttctttggtttactgtattttcaagaaaaacttctagctcctaatgagctgattatgtgttgaaaaaatgagaagaagagcttaattgtttctttgtttatgacggagtttcgctcttg

SEQ ID NO: 242 - DNA, 1179 bp, Homo sapiens
ttgggattacaggcgtgagccaccgcacctgggctcctttcccatatttatacccttaaatttttttctggccttactgcatagctagatctctaagacaataaatattagcaatgataactgccttgttcctgtctttaatgcttatcaattattgtaatcttactaaaacagaaaccccttccatagcatcctagataggtgatcattcagcctccactgggatgctcagagtgactgctaatcaccttacaaagctacttgctccatttttacccagctgtgttggagagagcttcctcctttaatcattaacatagtcatttattctaaatcagagcttgtgttgccctctgtgtctccttctagagatgttcttcttcaggtggagcctcacctttggaaataaacactctgcctggccccatcccactctccaccccccagttttgggagagaatcgttttcttagagaaatctagggaagcagcagcattagggcaaaggtgtggtaaaattcactcattcattcagcacatgttactaggcacctagtcagtgctaggaactgggcgtagagagtttaaaaacaaaaaaaagacacagtccctgccttgaaagagctatctagttgggagtacagatacataaagtaagatactgtgtgtgatctgggagcacacatgagagagcaactgactctgcccacagttggggaagacttcacatttgaacaggatcttgaaggatgaatagttagtaaaggaaagaagggatgagagatgggctttcaaacagcagtaaaagaacatgcagaaacagagcctgaggagcaaagggtagtaaaagtggagtggtgacaagccttgtacagatgtctgagcagtgggttggagcctgctggaggtccagtgtcctgtgtccttcctccagtggtgatagccctcctgtgcatgagtggatacctgatctggagaaactggaagcggaagaacaccaaaagcatgaattttgacaacccagtctacaggaaaacaacagaagaagaagacgaagatgagctccatatagggagaactgctcagattggccatgtctatcctgcagtaagtatttctcactgggagaattcctaccttccgaccatcttcccttccatcctttcttcccctcccatcc

SEQ ID NO: 243 - DNA, 1670 bp, Homo sapiens
acattgaaggtgctgggtaagtggtagctcttgttgcttcccgttcagcgtcacatctgcagtggagcctgaaaaggctccacattaggtcacctgtgcacagccatggctggaatgatgaaggggatacgctggagttgccctgccatcgcctccatcagccagacgaggtcctcacaggagaaggacagctcttccccaccctgggatctcaggagggcagccacggagtggggaggccccagatgcgctgtgccaaagccaggtccgaggccaaagttctccctgccatccttggtgccgtcctgccccttcctccttcatgcctgggcctgcaggcccaccccagccaccactgagtccactcggagtgccctgtgttcctggagaaggcattccagggttgaatcttgtcccagcctcagcctgggacacctaggtggagagagtggtctccgctctgaattggatccaggggacctgggctcattcttcttggctcaccaaccctgcaggcctcatctttcccaaaacccactttgtcttggtgggagtgggtccgcgctgctctgcagcaggggctggggagtggacagcatcaggtgggaaagtggagtccaccctcatgtttctgtaggattctcaccgtggggctggaagaaaagagcatcgacttgatttctccaaccactcatccctctttttctttcttccaccactccccaccccagctgtagttaatttcagtgccttacaaatcctaagctcagagaaagttccatttccgttccagagggaagggaacctccctaggtccttccctggcttgttataacgcaaagcttggttgtttatgcaactctatcttaagaactgcccagcctcagctgaaaacccgaatctgagaaggaattgcgtcatgtaagggaagctggaattaagggagctgagccagtcatggttgtggcgtgtgagtcaggagacctaggtttcagcccctctctactgtcagcgagctgtgcaacgtgggcaagtcattgtcctctgagctgcagtttcctcatctgtcacatcgctacagacaagacctccctggaacccttctgattgtcttagacactgtggttgcaaaacccacggaaagcctcatttgtgtggaaagtcagaggaaaaatgatccagtggacacttggggattatctgtcattcaagatccttccttcaaccccaaggtcagctcccatctcatttccagaaaggctcatacctggcttgcagggaagcatctgtcttgtcattccaggtgccagaatcctctcagagtcattgaagggtgttcacccatcccacccaaggcttggcacactgccagtgtcttagcagggtcttgtgagggctgggggcatccaggcactcagaaggcaaaggaaccaccctacccatttggcctctggagggggcagaagaaagaaataaacctcatcctatattttacaaagcatgtgaattctggcattagctctcataggagacccatgtgcttccttgctcagtgcaaaactgatgattctacttgctgtagatgaatggttaacacgagctagttaaacagtgccattgttttgccagtgaagcctccaaccctaagccactgggacggtggccagaga

SEQ ID NO: 244 - DNA, 1189 bp, Homo sapiens
agtgattgcatcactgccttccagcctgggcaacagagtgagaccctgcctcaacacaaaacaaaaaactcttcttgtcccttcttaaaacaaattacctatttgtaaactgctgatttctttgagtcattgttcccataaacttttcataaggcctcaatgatttcaccatacttccattaatgcttcgatataaatttgatgtttgtttttgctttaacattagcagaattcatgttgctttaatagggactctttttaaactgttgcttatccttcttagtgcctcaaactagatcctgttcagacatgtaatagtttattttggtacaaaagttttttgatatccatgcatagttttttcataatatgcatttccatgaattttttgaattttttaaatatttttctttttagttcagatgttgtttctggtctaatatttacttgtttatatttaataagttatttttactttaaaaatattttgatctttttttacatgcatgtttgtgtgtgcagtttctggtgtatttttaacagtagcaataggactgttcaggactcttaggaaatgcaaagagagcaaatttttttccccttgagacttgctttggagatagcaaggtatagctttgaatcacagctccaaaattgattgcttatatgcaatttggttaagtgtcttaaactctgcgagcctgggttttctcttctacaggaactcttgtagaatttaaattaaaaaatatataaagtgcttaatgcatttatatacatagaaacacatgtatgcataagtatatgtgtacacacacacacacacacacacacacacacacacacatatatacatacatacaaacagcttgctaagtatgaggcacgcattaccattactattagctgcctttcagaattacctgttttctattgatatcataactacctttcctcaattgctttatcttttaggccccagaattgtctggtctttcctgccttggatatccgctctagctagttcctatcttttttttttttttttgagacagcgtccaaaaaaaatccaggccagagtacagtggcactgtcttggctcactgcaacctccgcctccccggttcaaacgattctcctgcctcagccttgtgagtagctgggattacaggtgcccaccgccacaccc

SEQ ID NO: 245 - DNA, 1252 bp, Homo sapiens
agaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcacgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccacagccctgttgcggccccgaaacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggagggcttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtc

SEQ ID NO: 246 - DNA, 1177 bp, Homo sapiens
gagagagagagagaatagaataagggaaaagaatctaaaacaaattatttaatacattttaaaggatcatttcttttcccttgttttcttaaaatcatccaacaccattgcatcttggatatgtttctcaagtacaaaactgtttctgaaaatgataaaagactcatttccatgtagcataaggatgcttataagaataatgcagtttctaatctttaaagctccaacttcagcattaggtctgctgtggccaaacgtaaaaaagcaccagtgtgcaggcaccaagcccgacttcttggaagaccagctaaaatagtgaggggcagatgcatgccagcatggaaatcaaagccatacctggaagctaagcagagttggggttgttctttcagaattatttttcatgtgtttgaaacggaaacttttcagaaggctggaagcgttcctttaagtcacttgacctcttaaacacaaaactcttttcttcccccttagagaaaaaggggggctgaagggttggaaagacttttgaaaagccatagaaggctttacaagtaactgtcctggagcaatccctgcggaggaaaagaaccttaccactcaggaaatctgtctagcccgctaccttgccccactcagctgcccttcgtcacagatgttaccgattttataagatagcaattccctgctcccaaaacagattccaagtgagaaaataggaaaagtaattggttgctattagatacacattctgaagtagaaagaaatgtgggtagcgaggaatttctggcctggattaggggttccatggtaattaaaccataatgacaaaggagattcccaaaaacttacatgaaaacacaaatgggcaatgtgcttctttcaaatcatctaaggaaaataggctattctttctataaaaggattctttttcccaggaatagactattgttactgaatgtcactgatgcaacttcaattgtacacgtatttgttgagaagacatgatgtgacaggccttatgctagatgtggggtgcactgacgtaaaggacctcccttacctagccatactgcactcataatttcccagtttttaattatattttaggaggtgctatgatacattttaaggaggagtgaataatcctataaggaatactccttcccatgtagaa

SEQ ID NO: 247 - DNA, 1174 bp, Homo sapiens
agaaagaaagaaagagaaagaacgaacagacatagatagtctattcccacttcaagtagagtaaacaggcaaagtggggcaaggaagagcggatgaaaaagccacaaggcaattcattaacccattttaagacattttcaggcaacttgtgaagcttcaaaggtcaaactgaccaacatttaattcatcacagaaaaaaaattctgggagaagaaaaaagaaaacttgaccttcacggtttaacaagttttcttaaaatgtctttatacaatcttgatagagttctttgctaacatgattcatcttccaatctatgcaaatcagacttttaaatcatacttggttttatataagggcttccttctgattgactttggagcaggtaacacagagctcttgatggcagtgccttgctgtgtgttctgttatggtgacagagagagcaccccctgcaagggtgatttagtgtgaaagtactagggtctttgactgagaagtcaccaaaaatcaatggctgtattgttttgaatgttatctgggcttgcaactgagaataggacctgggggttttactctttttattccttttcattcgttcttcactctctatctgaattgcagtcgtggtcctctggcaggcagcgtctgtatgcgaccggaaggcagtgctgaatagtggggtgatgttggcagagcactttccaggcatgctagcacctagcgcacaagcagagaactttgcttctgccaactgtgacttcagaacccaggtctgttcctgaacctggatgcccagctgtcagtgtgtcgccatatgtcaccagcacatggcaccctaattaaaatttcaaattgcatgcatttgtgtttgctggctggcttgcttaaaaggcagagacctcaccaccccggcttgcccccctccttcatcactctgaagtattatgtttgccatccttaggaatgagttggaaaacggcctttgcccactaaaaaatcatcactctccaattctctcacctcccattttgaaataggaatagtccttattttaagggagaaggagtggtgtgaagaaacgtggctggtacccttcagtagaattctaaagaccagaaatgtggttctcgtgtttccagtggttcatacagatcactcttcaatgctgtcctct

SEQ ID NO: 248 - DNA, 1137 bp, Homo sapiens
cccagtccagagaaccctaaactcctctaatgtagatggggctctctaaattggtttcttttcttgtgtaacatctaaccctttcttggtgaggaagaacgagaaggaaagggaagggtagagtaaggtagggtaggggaggggaggggagggaaggggaggggaaaaagaaaggaaagaaggagggggaaactgtgtggagagaagaaaattctaaggcaaggagaatatacgcaaatatccatttggaaaaggaggagcatgctgcctcttctatccttggcttttccctttaaggcatccatacagtacttttcccattggaaaagtcttccaaaacatattcctttgaaaatagttaagaccctcttgtaaacactaacttagatatggagcaccaggggccaggcgcggtggctcacgcctgtagtcccagcactttgggaggccaaggcgggcagatcacctgaggtcaggggttcaagaccagcctggccaacatggcgaaaccctgtctctactaaaaaaaaaaaaaaaaaaaatcgaaaattagctgggcatggtggcacgcgcctgtaatcccagctacttaggaggctgaggcagggagaattgcttgaacccaggaggtggaggttgcagtgagccgagattgtgccagtgtactccagcctgggtgacagggcaagactccgtctcaaaaaaaaaaaaaaaagaaaagaaaagaaaaaaatatggagcaccagaataaatgtagaatttgaagaactttattaattttattaatatatttattaatttagccaacaaatctttattgagaccctttatgtgccaggcactaatcttgggagcagtgttgaataagatagataaaggcctttgggagctttcattagcattgagctcacctatactctcatgtttcataatctattaaaataaatgtcctctcttgaaatcatagcagtggtacaatgacagattaaagtatccatacaaggttacatacaggtaggtgcttagtataattgctttgtaatgataaaatgatgacaccattaaaactctgagtatagtcagggtaatttcttaaactttataaggcaatggaaaaaataaatttttatcaagaat

SEQ ID NO: 249 - DNA, 1244 bp, Homo sapiens
ctaagcatttccctttgttatacaaactggaatagccctggtttctcgcaagtcactgtgccattcaagacatagtttttatagtgagcatcaaacataagcctctgaatttattttctcctcagaaagctcttgaggtggtgtagagtctagttgtaactttggatgtatgtgcttttgtgagtttgacaactctgaaaaatgtttgtctttctctgttatatattcaattttaagatttgtgggggaagaaaggaaaaatatatattttagatatatattatttacaggcaagccctgttactattttgatcaacttctaggtgttacgtaagttttctctattaaactctattaaagatgatctttgcataggggattacagataaatttaggagtaagacaggctttgtattcagacttgaccatgtacttacaatattcagctttatcaaattaatctctcagaacctcagttccctcatctgtaaaatgaggatgtagttataaaggtcattgtaaatattaaatgagacaatatgttgcaaagcacctgagtgcattccaggcccttgggatacatggcaacattatgatacatagtacatccacacacacatcaacacacacacacacacacacacacgcataattagaataatatttatatatttaaatgctgctttacacatattaacaataaattttttatataaacatgcttttaatagctgcacaatgtttttgattggatgaagagtcttttaattggtttcctattgttggatacttaggttattttctatttttctttttagtggtaaccttttccatactcttggcaaactattttcttgaaccacctgtatccaaaatgaacaaattctgagattaaaaattgaccaaaggccaggcatggcggctcatgcctgttatcccagcactttgggaggccaaggtgggaagatggcttgaggcaagaagtttgagaccaatctcagtgacatagcgagatcctatctctaaaaaaaaatacatatatatatatatatatatatatttaaattagccagcagtggtgatgcacacgtcctagctacttgggaggctgaggcgagaggatcacttgagcccaggaattcaaagctgcagtgagctaggatcatgctactgcactccagcctgggtagcacagtgagactgtctctaaaataataattttaaaagtgaccaagatctatagc

SEQ ID NO: 250 - DNA, 1224 bp, Homo sapiens
aatttttataatgaatgttctgttacagtgaatgttcttcataggctcagagttcctcgattttaattgtatgttactggacttagtgaatagactgtatgacttgacctttagctggggaaattgagaaactcatttaggttttctgggtattagttttatatctgtgagattaaaaaactagattatttcctttttgtgcatgtaatatgcagctgtttaaaagcatccttttgagactaaaaataaattatggaggataatgtaattactatgtacacatccactcccaaattatcaaatggtaatattttgtctttacaaagtatgtacatagctagagccctcatgtagatctgttgaatttcttcagattcaaaaaaaatggtaaaaaggaacattacagataaagatgaaattcactttctactactctgattccattccctcccagcctccttgtctaggggcaggcactgatgaatttggtgcatattttccaatttatgcaattacattttgatagccattaaagctgttcacaaattcttgttctttttcttctgagcacaaggtaagatagtacttacctgtgcctctttgaagttgagagtggacttgtgatttgcttgttgatgaatgaagtgagagtgaaaatgacatgtatcccttccaggtgaaagatttcagagccagcatgtgatttcctgctcacacttccctgtgctaaagtaattggggaagtaacagaacctctttcaacctaggtctcagagtgactataatgagcaaaacgtccttccttccttaccttcagcatgggatatgcagcatgaatcagaagaaagccttttgttttgttatgccattgagattgtgcagaagtttgttaccacagtatcttgactaacctataattttaccatatgtgcctatatataattaatggtagtctctgttttaaacttttcataaatggcattctaatgtatatttcatttagcaacttgctttttttgggttaacgcaacattgtttttcagatctttccacattgatatatataactcaggttcattgatttaagctactacatgtaattatcatgtgaatttattacgattaatgtatttgttactgactggcattcaggaagctttacctttcccagtatttcaaacagtgatgcaatgaatagccttttagttgattactaatatacat

SEQ ID NO: 251 - DNA, 1149 bp, Homo sapiens
agtgaaaacctaatcatgcagttgttcatcctcattaatatggataagtcatgtgttcatctttcattctaatttaattcaactgggccttttaatatttcagcctcaccacttgctgggctctgatccttctttttcttctgcctcctcacgtctccaaccagaaggtgatcttttagtccttcacttcatggggagccttcagagagagtaatgcagccaccagaaaggatgccgttgaccgacacagtgactgacaggctgccctggctcagttatcacagtgctgatgctgtctattctaaaggtacagtactgtgataactgaaggatggcagccatcttaccttccatcagaggagcctcaccgtacccaggaagaaagaaggtgaaagaggaatgtgaaacaggtggctgggacccagaaaccctcttaccctgcacctctgtcatacttctcccggggcatagggagagttattctgcttctctttgccttgttttgtaacatggggtagttgttggtgcagccatgttgtgctgagtgaacatatattaagatctttggaacctttaggagactgaaaataggtaagtatgaattagtatttctggaatggtattcagagaacttcgtaccatttttataaatgtgaaaggtaacctaattagaacagcttggcacttgtcagtacactactagatttcaaaatcagattctacttacagggagaaaaaaaaagcccaatatgttgaacagtattgaaattgttgcataaataaaagtccatcattgtagaccagcttactgaagtgaagaaagaaaaaaagtatatctttgtcttgaaggagtagatagtgacatgtcatgtttctttcaggatatttaggatctggcctaattcaaaagaatatttactgaatgcctatgttattgctgctgctgtcacatttacatgaaaataaaatgtaaattattttatttctatcaaataaggactagtctgcagtgatatctggcacatatcgatttcaggaatacgaagctgtaaacaccaagccagcatcacgtgcatgaaagactaggaaattttttttttgttgcccacacgggagtgcagtggcatgatcatagcttacttcaacctt

SEQ ID NO: 252 - DNA, 1149 bp, Homo sapiens; identical to SEQ ID NO: 251

SEQ ID NO: 253 - DNA, 2024 bp, Homo sapiens
tagattataacccagacgttttggattatactgagacaaatatgtaaataagttttagcaagtctgaacatgtaccagcgagatcttcaggttaactaagaaaagcccagaaacttcattatttactgtgctttgtatggcataactggtaacaaggcagtaaaatgatacatatttgaactggaccatagtaattaaatgatttatcaatatcatttgcaagataattgtcaggttgagttaatagtaagtggcagcttcccagaaatttgggttatttggcctaagctgtgccctgggattacctcttcatcttccttgacttttaagttcaaatttggaggttatgtgaagtgattgaaataaatctttcaggctgaggaagtcggtaatttcaagaatatagtgaaaacaaggttgtaatctaaacatgagaagcttaagtttaggaaatggttagaatataaattgctaaagccatcatgattttggccacagatgaaaatatgaacactggaaatgagcgccatttaaatgagatgctgtatgtaagccaggggtcagcaaagttcagcctgtgacctggtgtgtgtgggggtgtgtgtgtgtgtgtgtgtgtgtgtgtgtgtgtccgtgtccctgagttaagaatggtttttaggcttgtataggattaaaaaaaaaaaaaacccacagaaaaatgtaggcagcccagcataagataccgcctttcacagaaatgtttgctgaccccggaactgtcactctcgggttacaagagtttgtttctttgaaacagtctggctctgtcacccaggctggagtgcagtggcatgatctcaggtcactgcagcctccacctcccgggttcaagcaattctgcctcagcctcctgagtagctgggattacaggtgtgcaccaccacagacagctaattttacaggtgtacaccaccacacccaagaatcacttgaacccgggaggtgggggttgcagtgagccaagatcatagcactgtactccagtctgggtgacacactgtctgaaaaataaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatctttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagatt

SEQ ID NO: 254 - DNA, 1184 bp, Homo sapiens
ttgtcttgatacattttacctagaattttaacagtaggatttttttttttttttttttgagatggagtctcactctgtttcccaggctggagtgcagtggcacagtctcggctcactgcaacccttgcctcccaggttcaagcgattctcctgcctcagcctcttgagtagtgggatcacaggtgcctgccaccacacccagctaattgtttatatttttagtacagacaggatttcaccatgttggccaggctggtctcaaactcctgacctcaggtgatccacccaccttggcctcccaaagcgctgggattacaggtgtgagccactgtgcctggccaacagtaagatttttttagagttctgtcttaatgtagacactagctaacaatgtaattttgaagaactgagaactgtggttaattttggtttttctttttcagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatgg

SEQ ID NO: 255 - DNA, 1191 bp, Homo sapiens
cgattctcctgcctcaccctcccgagtaactgggattacaggcatgcatcaccacgcccagctaattttttgtatttttagtagagacaggatttcaccatgttggccaggctggtctcgaactcctgacctcaggtgatgcatccgccttggccttccaaagtgctgggattacgggcatgagccaccacgcctgacctaaaatcatgtttactttgccagttatttgttacagtattgtggtttaaagtcttggattacaggttatttaggacagtgattcctaaccagaagcatattcaagttagttggggggtgggaggggcagatgttttctaaactttttcttttttcttttttttttttgagatggagttttgctcttgttgcctgtgctggagtgcaatggcgtgatctcggctcactgcaacctctgcctccagggttcaagcaattctcctgcctcagctcctgagtagctgggattacaggcatgtgccaccacgcccggctaattttgtatttttagtagagatgggtttctccatgttggtcaggctgatctcgaactctgacctcaggtgatctgccctccttggcctcccaaagtgctgggattacaggcgtgagctgccgcaccttaaactttttcttttcttcagaaagaatttgctcttatggtgagcactgttaatgatgggaatatcatattccgtggatttgttgggataaggaaaaatgatatactattggagggagtagataaaaatacatggtattgggtgatgttttgaacttggtaataaaaatttatgcaaaactataatggaatcataattttgcatgataaacaatgaagttgtgattggtgccttaacaaatgaaccctatgcaacgttaagtttctcatagtggtcaacacaacttttttttgtttctttgagacacagtctcctgtctcccatgctagagtgcagtggcgcgattttggccattctgaagttcaagcgattctcctgcctcagcctcccgagtactgggactacaggcatgctccaccatgcctggctaatttttgtattttcagtagagacatggttacaccatgttggccaggctggtcttgaactcctggcctcaagtgatcctcccgccttggcctcccaaaatgctgggattacaggtgtgagc

SEQ ID NO: 256 - DNA, 1363 bp, Homo sapiens
tcatagctagtttttttttttcttctaaaaaatgtcaggtttttaaaatcatttaccttattaaaatgaaaagtgccatacttaacttttaaaggaaagacctgacttgctttttctctatttagactgtttttgtactttactaatctttaaactatcaggaaaaaaaccaaaactttataccaatgatttagtaattttgaggcatagggtagcttacgtagtggaggatgtgccaaatattctcttcaaatgccaccttctcaatttataactaaaatagtgttatctgactaattcctctgaattttgatgtaagatctatataggcccccaaaatgatcgtagtacatgccagtcatttctcagtgaaataaatacaataccagagtacattatgggttttattgctttcttttatggtagacctgttaatggggaaaaaatacatcaaatcaaatagaatcttatatctgtatgttaaaatagagcacttacctgaagtcagtggcctggatcatagccctggatcatttcccagtctgtcctgtgctgtgtgaccttggacaaggcgcttcatctctctgggcctctatttctccatttgtaaaacaagtggctgcagtagatgatggctgagagcccttcctgttcccagatgccttggtccaaagaccccacccctctgctggtcctgccaacgtgttggtgctataagctgcttcagatataaaattggtttatctataatgtttgttcatttaatagcttctaaaaggcctttttgttatacagtgctttttttctagttttatggacttggttactgtaataatgtcttgtttttagccatgtaactacaaacagatattctcttgatgtcttagtaaatttgcatttgatatatcattgatgagattttgttgttatgtaatattctttggctacgcatctgtccagcatcttattaaccataatactgtgatcattatttggaaatatgtcctatggaaagaataaaagcatgtacttcacagctagcatgttcacagatttgaaagaagtttcattaaaagcaccattgctttctgtactgcgtcagtgcctcattgtatcatcctacttgtgttttgctcaataaatgaataaaagaccatttctcttcccctttcccttccttcactcagttaacattttctgagcacctcctgagagcaagctgctgagagtcaggctcccatgacacccaaatgaataagacttacaccagcccatgtcacagtctgagcaaggaggatgggaatgacagatatgtaaactaatcatcgtagtatcatgtggcaagtgctataactcaggtgaa

SEQ ID NO: 257 - DNA, 1144 bp, Homo sapiens
acatagatgttcatgtcatctttgaaaaaggcagttttatttcctcttcccctatctgtgtgtcttttatttcttttatttactattgcattacctgggaattgcagcaaaaagttgaaaagcagtgatgagagggacatcttggcctttttcctagtcatagagcaggaaagctccaagttactcactattaaatatgggctattttgtagatgttctttatcaagttgaggaagttcccctctatttttagtttacatagtttttttaaaaaaaaatcatgaatagatgttggattttgtcaagtgctttttctgcatctgttgatacgatcatgtgacttttcttttttagcctgttgatgggatggattccattaattgattttcaaatattgaaccagccttacttaccctgaggtaaatccgctttggtagcagtgtgtaattcttttttacattgttggattcagtttgttaatactttattgaggatttttgcatcttcattcatgagagatactcttaagttttctcgtaatgtctttatctgcttttggtcttagggtagtgttagcctcatagaatgagttaggatgtattctgtctgcttctgtcttctgcaagagattctagagaattgttataatttcatccttaagtgtttagaagaattcacaagtgaatccatctgaacttggtgctttctgttttgaacagttattaattattgattcaatttcattaatataaataggccttttgagattatctgttttcttttgtgaatgttggcagattgtatctttcaaggagtatgtccatttcatctgggttatcaaatttgtgtacatagattgtgcatttattcccttattagccttttaatgtatatgggatctgtagtagtgtcccctcctttatatctaatattggtaatttgtcttctttctttttttctcagactcactagatgcttatcaattttattgaccttgtcagagaaacagcttttggtttcattgatttttctcaatttttttttctgtttaatttcattgattttttttgctttgatttttttctttaatttgaatttttttattttatttttctttgtatattaatctttgcccatgcttaat

SEQ ID NO: 258 - DNA, 1198 bp, Homo sapiens
tgacctcttttatactattcccttttttgcttattaacaaggataaagtgaatatacatgctcttttgaggcccagagcattttcaaatttaaaatttgttagtctaaggtattattttttgcaccctgctgctttgggacagctgaattcagttttgtaagggtacctccactggttcacacgtgtattttctttgtagtttttatgataaaaacattatttaaataagaaaactttgaagtatgtaactccaacaatgtataaaacattcttatatacctgtcatttagttcaacgagaatcttaagaagttggaagggcaaattctatcagttttactttacaaataaatgaattgagactcagttacttttatgttcacatgactttaaaatgtcagaacaagaacagaacccagatgctctgtcttctgtcattcaattatacattttccagaatctttctgttttctccaaatggattcaatctaatacatacatttcattttttttacacttccatagtcaaccgacggtattaatgacaaaagtaacattcctaaacagcagtgcatggttgactgtagctttgcattagaatattgtacacaaagtacaagatggtgaatgtcctttggaataaactaatgactctttcaagtggcagacagctaatgctatgataatattttattattttacaaaaccttaaagtggaacattttaaataaaataacatttggtaaaaataaagttgattttaaaagtattggtgtttattactaatgtcaaatctttgttctatgctatcatggtatttagttttctagggctatcatagcaagttgtcacaaactgggtagctaaaaccaacaaaaatgtattctttcataattctggtgaccagaagtttgaaattatgatgttagcaggttgaagctccgagaatcaatctgttccatgcctctctcctagctgttggtggctcgagaatcattggcttacacagtcatggaccgtataatgatgttcaggttagcaacttatggcatacacagcagtgatcccataagattataataccttattcttactgtatctttttatgttaagataaattttgatacacaaataccattatgttacaattgcctgcagtattcaggatagtaacctgctgtacagatttatagcctag

SEQ ID NO: 259 - DNA, 1306 bp, Homo sapiens
aatatcattagtaatcggatagctctgtagatgattatcagtatataaagacatcgtgagcagtatttaataagaagagttgctgaagtgacttttgcaggaggatgaatgctttttttaaaaaaaaagtttatacgtgcctcttcgctcttccaaaaaaaaaagagagaagaaaaagaagaataaaacgagagacgaaggtggataacacctttctctagaccccggtgcctctcatttctcgggctgcaggcgacggctgctgggcctgcgcggggtggagccgacgctgacgcgccctgcgccgcaaagcattgtgggagctcgggcccgctagtgtcgtggttggaggcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggagtgagtatcgtccaccatcactgttcctgctaacgccgcctcagcctgggcctaacacacacaatttccttaggcccctgtcgctgcttccccgggccaggctgcttgagtggctggtggctggtggatttacttaagacggttgtgttccaggcctacaaaaaaatgcagagaggcagggccagggctttttggaattaggaaacactggctgttattctcgggaaattttttttttccgccttaaattgtgccaacgtggtcgtttggctttggggacttaacgcaagactaaccgcagtctgtacgtcgtatataggttaaatcccttttttaaaaaactgagtatttgttctttgcgttcttggaagaaaggtaacaaaattattcatgcctgtgttaatttggtgttaaactttgtaggttgttcacttattgttattgctgttatgtggttctggcccagcaatataattcaaagatcatattctttttgacagacgcttagttt

SEQ ID NO: 260 - DNA, 1190 bp, Homo sapiens
acccctctaaaaagctgtggctgattggtggcttttttttttcttggagagggggtgtcaaagatttctttaaaatcgttagtgatgtggtctcgctttaagatttttaatgggatcagaagaaaattcggtacttaatcacttccggtaatcttcatgacctgttatagtgactgcagtgtactctcaatgaggaagatatagatacgaaaagaactagagccgcatcacatggggacttctgcaaatacagagactcggattaaaggtggagaagatggagctaaaggaactgcttatttaatacatttgaacaacttttggggtacttagaaggtgctttgaaacctgcatttgattaagcaagaattcgcttgcaagttaagggttagatttttttattttttaaaaatatgctttctgccacatgtaaaccgtaagttgtcctgaaatgataagctttgatattctatggtgtttattttttacttatctttttgaatgaaaagtgaacaacaagaaatgctggtggtaattttttgggtcaatgatgagttggcatgtattctgaatctaaagttgattattactactttagctctagaattactctgagacctgaaaattacctgaatcgtgactaagacgaagcctgaatgatttaagttcttttttgttggatacaatttgttgttgttgttgttgttttggttttgtttttgagtcggtctccggtcgcccaggatggagtgcagtgacacaacctcagttcactgcagccttaatttccctggctcaagcgatcttctacctcagcctccctagttagttacaatttttaaatggaacgttttcctattacaagatgaaatcaagtgaaaattgagatgtatgttgaatctatgctgtggggcagaagaacgttgtagaggtaaacattgatgagattaccactttattttgaaagggcactccacagaaggatgttattatcaagtcagatgcaccggacactttgttattggagaaacatgcagattatatcgcatcctatggctcaaagaaagatgattatgtatgtataatttttttatgttggaaagtttattttaaagaagtgtgacagtcataagcagtgagacagtatttatgtcttaaaatggcatccaactccatgcagagaactgagg

SEQ ID NO: 261 - DNA, 1190 bp, Homo sapiens; identical to SEQ ID NO: 260

SEQ ID NO: 262 - DNA, 1224 bp, Homo sapiens
gatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaaacatggaaaggtggcagtgtcattcttgtgtcacctgcacagtttgcagtctcagagacttcagaggactctgagatttgcctgctgaggtatacccagtcatagggtctgccaggtgggaatcacatgatacgacccacgttcagttttctctcttttgactatggtagtgccagctttgactgtgctagagtttcagggacggacatgagcgaaactttcttagggggggtcatttaataaggtcataaatgtaaagcaaattggctgggcatggtggctcatacctgtaatcccagcactttgggaggcagaggcgggtggatcatgagttcaggagattgagaccatcctggctaacacggtgaaaccccatctctactgaaaatacaaaaaattagccgggcgaggtggcgggtgcctgtagtcccagctactcgggaggctgaggcaggagaatggcgtgaacctccggggggcg

SEQ ID NO: 263 - DNA, 1187 bp, Homo sapiens
agcactttgggaggctgagaataggggattgcttgagcctaggaattggagattacggtgagctatgaccatgaccctgcactccagcctaggcaacagagcaagaccctgtctttaaaaataaataaaattggctgggctcagtggctcatgcctgtaatcccagcaccttgggaggctgaggcaggcggatcacttgaggtcaggagttcaagaccagcctggccaacatggtgaaaccccatctctactaaaaatacaaaaattagccaggcatggtggcgggtgcctgtaatcccagctactagggaggccgaggcaggagaatcgcttgaattggggaggtggagattgcagtgagccgagatcgcaccactgcactccagcctggatgaaagagtgagattctgtctcaaaaaaaaaaataaaaaataaaaagtgcaaacctattattattctataatattagggttttttttgttttattcagcccccccccttttttttttaaacaaagcatttgtgttaacagaaataacactggaatataaaaataggtgcccttagtggattggaagctaagtgaagtttctgaaaaaccgaaaaagcagataggatcagatcaaagaagcaagccaagggccacaggaaatgactgtgtgggctttaattttggaagtgacagatacggatgatgaccttagcattctgcctgttgcactgtaccaggcagcaagtataaaggtatctgcctgggtagagcagtgagtgtagaccatgtgaagtatgattgatattcagggagatacataaggatattgtatcctaaataacaaaacaaaacctcaatagatgggttgattgaatggcaaaataaatactattggagaggaaatgagtatgctgaaagatatagcggaaagatttcttctaaggtgaagcacaaaaagataaacagaaggaagaaaagttttgacatgttggatagctataggatccattgtttttctattatgtattttttaaaagagaacagagtgagaactacatttagagtaaccatttagataaattttccagaactagagagaaacacatccttaaattaatgaggtaactgtgcttaactaaattttaaaaagcgcctacctaaacacataggaagtaacttcttaataccaaagata

SEQ ID NO: 264 - DNA, 1138 bp, Homo sapiens
agcagcatcttatcagttttgtttattcgatttctaaaatgtgctgatccttttaaaactcctgcttatctctgcaacaaagaaaaatattcaaaaatactgccttcattttcacacacagtgctgaagatgctgcaagcaccaaatcatagctcataaaatcaggtcctgagatagttacccataaagaggaatcctttgagtgtatgccattggtgagccgatgagcatggaccatagaagggctcaatgtagaaggtaaaattggcaaatcataattgagaaatatgaaatgtattcccatacataatatggtatagggtgtaatgtacctgcttttgatcacttttcattttaaagtgctattcacttgatcttaaatgttccatgaactgttaaatttcttaagttacatagttactacaccacatttatgtgtatgttatgttttaatagtcaatgataggtatgtacaattgataatataaaggggctcattgaaacttgagagcctgttgagttttggttagttgtagattgcatttttataaaaaaaaatacagatagattgatgataatagatattggggcattgtttctgtctcatgagaattcttttattcattaccataagccttcactgatactataagcattattttaaatgacgctgatcttaagtctgaaataaatggaaagcagaaaaggtgagccagttgatttgaatgcattggatattagtgttagaaacaatgtatagtttagattgaaactgaactgacttatttagcacttaaacaaaaatttgacaatgtttttagttttttttaagacagcttagtgtggtgatacttagaattctatggtttgatgtttcttttagaaatgagaagtatagttttattttttaatataaaaaatggttttaatactaaaactagtaatttgatactagttgtttataaacattgtaaaatatatcttttaaacaaattatcttggtagttaattcataagggtgggtttgggtaggaatagcagagtactttcagagggaaaggggagtcattcagaagtgatagcattttatttgtttgaatactctgccagtaaaatcagctgtacttagaaagttatc

SEQ ID NO: 265 - DNA, 1177 bp, Homo sapiens
ctaaaaggggggaaagaaaactagacaaggtaagtaaaatttgaaagaaattttttaaaaaattttttaaaaaaggaagttttgtcttaatagaaaacaatttattttccctcttttaggattgtgccagattgaaagtttgcacagacgtcttgttaataatattaaaaaacatataaattgcttagaagacacttcactggttttactcatacgtgaatggattttaatatgctgtattttcgtcatttttctatttccaattgcaccttaaaggttgaaattcctatagtttgctactctagtgtgttgcaggttataccattttttttttaatgttctttactttcagtacttttgtgtttcacgtttagctttaaacctgtggattaaaacagtggatttacagtgctatgtatttttaaaaatcgtaatcgttgaagcttctgaacttagaagtctgcatgtattttttgttttaggtttgatatatgagttttgatacattttctttttacccttttttttaaagggaggattctcactgaggctatagaatgtatttgtagcttttgaccaggagaacttggtttccttttatttaagtgtctttcatatttatagtgaggtttttaatgtagaaaaaaaatgagctaatgatgcttcagatgttgtatgtaatgtattctttttattttatgtgtagatggctcttggacaagtccgagcagtacaacacactgggagggaatgccctctccttttaaaggcaggaatttttatttattacctgtgttcagtatgtaaacgtgaaataaaccagtggattcttaaatggacacaaatatttcttggattatgtgtctgcgcatattttatttttgctgcacaacattctgatgtttaatcatttaagtttgaaggggggaggagaatgtagtactttgagctataggttgtctgttccaaggtatgcattgtattcatctgtgtaatggatttaggtgaaggtagtcatgtagttgctttgagattttatttttttgctaaagttttatgcagtgaaatgtttgtttataaataatagaacagtttaggttgagattgccttgtaatgttgtggggggtttttttgtttttttttttttgggcatagctttgtggtcactgtcagata

SEQ ID NO: 266 - DNA, 1244 bp, Homo sapiens
tgatgaaaccttaatgctaaataaaatagatataatataaccttgcacatggttctgtttttaattttgcagcatcatttttaagatcctacagatggatatttaaaattcaattgaaaagtttataggtaggcttcggccagtagtcaaattttgtatagttttccttctaatctcagaattcgtacttcaaaattgtattctatactttcagttttaaaaatcttagcattttagacaacttaaaagtttgaatattacctgattttcacaagctagtttgatagtattgttgtcttctttgctttttaaattatagaaaagatagagatgtcatttagtcatgttagttcatgggcgtttgaattatatgttttttatcagcaattttgctgatttgagacagtttttgtacactttcctcctttaaaaaaaaaggatttgccaaataatgaaactgctctttccagaacctcaaaagctaggtcattagttctgacagatttatatgttcaaactatcaatatttctaaaaccaaagggccaaattctgatagatctgctgtgtccgatatggtagtaatacattctgacacatgctgtgaaggcactctccatcttttctctgacacagttttgacaaattggctttttgtgttatcagttaaaggccaaacacagattatcttttcatccctgctctgtgttcatgtgttactgtgaaatggatgctttttatgttttcagtattttctgtaccatttgtaggattggaagcctactgagtacactgatctttatatcatttctcctgtgtagtgttggtggcttacgtaatcattctcctgtgccactagaggaacattgtattcttttgacctaaccaaaattttgttccataaagtcactttcacttgaatttagcatggtttctgtcttcaaattagagaagaaatacagcatccattcccaaacagtggaatcagtcagagctgccaagaattatctttctggagccagttcctgtaacctagtctatagaccaagaacagtgttaagcaaatattattttcagactcataagctatttcttgtgctgtttaagaaaggaaaatgtggatatcttctggaacatctaacttgcaaaattttactttttcagttccccagaagtattgtacgttgtgcactaaacttgcaaatagctatactcagagaagtatttgttccttttagtttttgtc

SEQ ID NO: 267 - DNA, 1197 bp, Homo sapiens
gaggtgagatggctttcatttgcatctccctcatgattagtgatgttgagcattttttcatatacctgtggccatttgtatgtagaaccaatgcttttaatcacatgtcaaactgcctatgtcccagtcctttccagagagccctctggaaccctttttctattgtaaacaaatttatttaaacctacaggttttccatggaatagaagtttattcctcagtaccttgcatctactagttgggcagttatggtgagcatatctttttgacttaattctagagtaattatataattggagataaagctgggaaccattctttacttaaaaagtctcaagtgggactctccttggagtgttctctaaaaacaaaacaaaaaaaatcgttttcttaaaggcatttagttagcagagcacagctgactgaaaatttcttaaatacaattcaggatagtttgtataaataaccaaaaggtaaataaccaatgtagtcctcatgagacattaaaattttttttcaactgaatctctcactgcactgttaattggaagtcttctttcttgaccattctctagaacagaatacaactgcggtcactcctctcttctggatgtttttttctggaccatccaattcatttccacccccttgttatggagagaaactttcctctttcatggaaaagtcattctgacatcgaggcaccacgacttttgacctagagtaagcatatcaaactatttttctcaactcaataatttacagaaaaatattaagaaggtgaaaattttccattcatcattacctacatgtaagaaaaaaagaaaagaagaaaaatctaccagaatcctagcatttacagataaccactgttagcatttatttatttatttatttatttatttatttatttatttatttatttactgagacagggtctccttctgtcacccaggctggagtgcagtggtacgatcacagctcactgcaacctccacctcccggattcaagtgattctcctgcctcagcctcttgagtagctgggattacaggtgcacgccaccacagcccagctaatttttgttctttttaggagagatgggattttgacgtattggtcaggctgatctcgaactcctgacctcaggagatccacctgcctgggcctcccaaagtgctgggattataggtgtaag

SEQ ID NO: 268 - DNA, 1178 bp, Homo sapiens
aagcactagttttaagtattaagagctcactaggctgggcgtggtggctcacacctgtaatctcagcactttgggaggccgaggtgggcggatcacgaggtcaagagagagagaccatcctggccaacacggtgaaaccccgtctctactaaaaatagaaaaactagctgggcgtggtgacgtgcgcctgtagtcccagctactcaggaggctgaggcaggagaatcgcttgaaccgaggcggaggttgcagtgagccgagatcgcaccactgtactccagcctggcaacagagtgagactccgtctcaaaaaaaaaaaaaaaaaaaaaaagagctcactatttgacttaagtcttcaattattatatagtatcttcttttgaagcaagagaagtactgttttattgtaagtacaatatttccaaagattgagaaaaccttcattaaaatgttctcaccatctggcacttccccccctctttgttatgtataggtttcccaggcagctgcagacttgaaacagttctgtctgcagaatgctcaacatgaccctctgctgactggagtatcttcaagtacaaatcccttcagaccccagaaagtctgttcctttttgtagtaaaatgaatctttcaaaggtaagtttccttaaatttaaaacaaaaacccacactgtaggaataactagtcttctctttctttgcagcacttaaaagatcatcccatgccctttcctttggccctccatttccagtatttttctgttttgcaaggaaagtgaggattcatgaaacttgctgacttagtagccatgaaggctaatcgtttctattttaccataaagaaggttaagtagaggatttaataaccataaagagggtataggagagttactacaaaatcccactgccgtaacaagccatgtgttactttttagagcattggcctaatggagtccccaagtactagttttgtttttgtgtacctggcaaatatttagacagtttttaaaaaatctgcaatgtttatggggataacttaaagtactaccaactgatttggattaactcttgatgttattgctctaactgaacccagctgtagagcagtatagcaaagattgggaattggaaatgcaagagaaagtcagatgtaattgagtaagccagtgtggtaga

SEQ ID NO: 269 - DNA, 1289 bp, Homo sapiens
aaggacatttgcactgagacctgacacttcaggtcttcaactcccttgatgggagttagccagaacgggcttagaaacagcaattgatggcttagtgactgattttacaaatgatatttgtttcttctttaaatttctttctaggatgttcacttctccacaatgaatgagtgtcactatgacaagcacatggactttttttataataggagcaacactgatactgtcgatgactggacaggaacaaagcttgtgattgttttgtgtgttgggacgtttttctgcctgtttatttttttttctaattctctggtcatcgcggcagtgatcaaaaacagaaaatttcatttccccttctactacctgttggctaatttagctgctgccgatttcttcgctggaattgcctatgtattcctgatgtttaacacaggcccagtttcaaaaactttgactgtcaaccgctggtttctccgtcaggggcttctggacagtagcttgactgcttccctcaccaacttgctggttatcgccgtggagaggcacatgtcaatcatgaggatgcgggtccatagcaacctgaccaaaaagagggtgacactgctcattttgcttgtctgggccatcgccatttttatgggggcggtccccacactgggctggaattgcctctgcaacatctctgcctgctcttccctggcccccatttacagcaggagttaccttgttttctggacagtgtccaacctcatggccttcctcatcatggttgtggtgtacctgcggatctacgtgtacgtcaagaggaaaaccaacgtcttgtctccgcatacaagtgggtccatcagccgccggaggacacccatgaagctaatgaagacggtgatgactgtcttaggtaggtaagaggacccaagcaagccatcattcccattcattcagcaaatctttacggagcatctgtggtgtaccaggcacttactaggcagtaagaatgcagcagtgaacaagaacggacataaatcgccacccacctggagcttacactctaataaggaaagataaaataagtattctaatgggggtaaacaaattaagtgaaataagatgagtctcctgtggaaaaatcaatcagggaaggaaggaaaaataaagcagggaagggagctggagagtgctaagctaagcaggtatcgtttgcactttaaaaaagtgttgtgagggatgcctggaagatgacttttgagcagaggtgtgaaggcagtcagggagtgaaccatactggtgtc

SEQ ID NO: 270 - DNA, 1223 bp, Homo sapiens
atgggtattaaatttattaaacatacctacaaaatctaagtaagacatgaatttaaaaaaagaacagtgcctcacactgtaataggaaatgacagctattgctattaggagtacggcatctattaacagtttccagcagtaaacacaaccattatcaaataataaagacctattataaaaatattcaagcaacagagatctattaaaatttttatctttgcttcaaaataatatggagtgaggagtgtaggttaaagattagtcatgtactgatctttataaacgctggggctggtaaaagtcccctctttgccttgcacacttgtcccttctcccattccatccctcagaagtaaacataatgaacacattgatggctacacttccagacttttctatacatacagagaaatgtgaatgttagtacaaatacacatacacagttttacacaagtggggtcatattggatacattgttttgcaacttgatttttcccttgataatttgtaaacttcctttcttgttggaatgaagaatgttcctcatcacagctgaagggtccttgtctgatgaacatattttgccattttcctaccgatggacatgtagatcccttccgcacattacaattttgttctggccaatattttctctctcttttttctatttctttttttatcatctgcttcatttttcatttatctattttctctctttagtaccagaagtcaacacttttgtcagcttctcggttagcactccccacccactgattccttgaatgctctgaagaccaatgaattccttattctatgagcctgacctttataggccaaaaaatagagagagaaataacaatgaaagtgaatttctactactgttatgtttaagtcacagtgcaggctgcttttgctttcctgagaaagtatgtcaagtgttttttaaattctttttttttaaattcttttctttaaaaccttatttttttcttgttctttcttttctcttttttttttttccttgccagcagaaagtgaaggaggcacactttcaagtttgctttttaatccacaaactcaacattttttcttttctgtttactaagtcacacaattcccttggaggcagacctttatgtgtcccgttattaatgttttgtcctttattttccacataaagtaataaactagtaagtaaaatctttattagaatttctctccaa

SEQ ID NO: 271 - DNA, 1212 bp, Homo sapiens
gacctcatggtaatcggaggtcaaaaaacatgtaatagatacacatagaataagaagcaagaaattaaatcataccatcagacaaaattatcttcactaaaaggaaagaaggaatagaagatgacaaaacaaccaaaaaacaaattacaaaatagcaagagtaagggcttacttatcaataataacagtgaatataaatggactaaattattcaataaaaagacataaagtgactaaatgaataaaaaaaaccaagacccaaggagctgttgcctacaagaaacacacttcacctataaagacacaagtagactgaaaataaaggaatggaaaaagttatttgatgccaatggaaaccaaaaaagaatacctatacttatatcagacaaaatagatttcaagacaaaaactataagaagagacaaagaaggtcattcaataataataaaggggtcaattcagcaagagaatatattataacaattgtcaacatatatgcacccaacactggaccacccagatatataaagccaatattattagggctaaagaatgaaaatacatgatgatctcactccaactggaactctctcactgattacttgataacaataaaatatctgatattctgcaaaaaacaaacaaacaaaaaacaaaaacaaaacaaacaaaaaaagaatgaaatagatcttaatacaataaatgttagagacttcaacactccactttcagcattgaacagatctcccagagacaaaatcaacaaagaaacattggactttctccactacagaccaaatggacctaataaatatttataccccaaagaaaggaaatcatatattcatttccatgtttattacagcactgttcataatagccaagatttggaagcaacctaagtgtccatcaacagatgaatgtatcaaggaaaaaagtggtacatatacacaatgaagttctattcagtcataagaaagaatgagattctgtcatttgcaacaacatggatggaacggaaggttattatgttaagcaaaataagccaggcacaggaagtcaaactttgcatgttcttgcttatttctggaagctaaaatttaaagcaattgaactcatggagatagagagtagaaggatggttaccagagtttggaaagggtattggagggttgaggaggaagtggggatggttaacaggtacaaaaaaat

SEQ ID NO: 272 - DNA, 1178 bp, Homo sapiens
aatatacccactagaggttggcaaaacacactctgagagcttgtggccaccttaatcaagttgctagatctatctgcaccccattttttgatctggaaaatgaagatgtcagactaggtgacttatgaggtccttctagctctaactggctgtgactgtactgtcattcatctatcttgaatagaatacaaaagatctttttcagtgttctagaccatcagtgttctaacctacattaggaaacaatgagggaaaaagtctgcatcctccctcaacaggacattctagtttctcttggttccttgatgggccttcagaaataagcatagaaactatcccagctcacccatgcttttcctgggcatgccttccctccttgccccagcctggagacttcacaattgggccaactgttcctcacctgcgagggcatatgtagtcctgattgaatgggcttctgtctttgcttctgctttttctccaccttcactgtgactcaagccactctttaaaaactaatagagagtgaaaaggcaaggtggagggacccaagcaattttgtttttaaactgtctttcttttttttttttttttttttttttgagactgtgttttgctcttgttgcccaagctggagtgcagtggtgcgatctcagctcactgcaacctctgccttctgggttcaagtgattctcctgcctcagtctcccgagcagctgggattacaggcatgtgccaccacgcccagctaattttgtatttttagtagagacagggtttctccatgttggtcaggctggtctcacactcccaacctcaggtgatccacccaccttggcttcccaaagtgctgggattacaggcctgagccaccgcacacagcctaaactttctttttaaactataagccacgtaactttgtcatcattctttgtatacctcaatggaagttgtttggttattttcctggcaaaatggtcaaggtgtgtgtttagatgggaaatatatatgtaaatcaactctctctttctctctccatatgtatatgtgtatgctaaagtcttaaatttgaaaaaatatatctgccataaatggccatggtaccagtcacctcattagtgcaatagacattgcctctcacatttaagacattagtatcttggcaaatgatattaatt

SEQ ID NO: 273 - DNA, 1230 bp, Homo sapiens
tttctttaaaagctaaacatattcttaccatatgatccagcagtcatgttccttggtgtttatccaaatgaactgaaaactttaagtccacataaaaatctgccgatacatgtttgtagcaactttatttgtaattgcccaaacttggaagcaaccaagatgtccttcagtaggttaatggataaacaaactgtggtacatccagacgatgcaatattatctagccataaaaagaaatgagttatcaggccatgaaaagacatgcacagagtctatttaataaaaaaaaaaaaatctacttggagattgaggttacagtgagctatgaccacaccactgtaccccagcctgggtgaacagagtgagactctgtccattaaaaaaaaaaattccttgaactatacaagcaataaaatgaactacagatgtgatgaatattacaaatacagtggtgagtacaagaaatcaagggaaaacatatactatgatgaaattttactatattgtttaatattgtttgaataagaatatattgttgataaaacaagaaaagctaagaaatgattaccggaaggatagtttttatctctgtggaagggagaatcaagaaggaacacttgagagatttctgagggtggtggaagagttttatttcccatcatcatggtggtgtgttatttaagtactcattttctaagtctttaaattgtacatatttttcttcaaatacattcttttaattgaggtgaaaatcacttcacagtcaaataatcattgtcaaatgtacttttctgtgttatttagtgtattcataatgtgcaaccaaaactaacagctctttctagtttcaaaattttttcatcacactccagaaacaccctatactccattaggtaatcattccctaacctccccctaagcaggtcccctcataacttttaatctgctttttctctatatggatgtgcctgtcctgaatgtatcataaaaaggaatcatacaatttgtgaccttttttgtgtggcttctttcgtttaacataatggtctcaagattcatccaagttatagtatatatatttgagttttttttatgactaatatttcattatatgtatgtaactgttcacccacttatcactgatggacatctggtttattttcatatttcgagtattgtaagtaatgctgccataaatgttctatacatctagtttaatgtattgcaata

SEQ ID NO: 274 - DNA, 1285 bp, Homo sapiens
gtgagaacagtcactttatggacattcagccgtacagtcacctggcttgctggcacatatgtaacaattggggttgggaggatccagtgcacaaggcacaagaaacttctttcttggatttgcttgtttattcaaaacaattgttctgcagtggtctatttttcctgataagatcttcaatctttccaatactgtcaacccagcaatcactgcattagtagtagcaatagcaggaataatattccctgccactgatttgatatcaaatctactcttcatattcatactgaaaatatgcatcctgaggtttgtagcagaggtaacaaaatccattgcatatgggtcatccttatcccatgtgagctcagctccatcccccttttctgctaaatgaactctcagagtctcagtgctgtgagctccttaagaaccttgtgctcaccggcttctcccacgtcgacctgattgatctggttactattgatgtcagcaacctcaacagtttttgtttcaaaagaaacatgttggaagatcaaaggcacaggttgccagggaaagtgcactgcagttttacctgaaagctaatatggttgcctaccatgacagcatcatgaaccctgactataatgtggcatatttttgacagtttatattggttatgaatgctttagataacagagctgcccaaaaccgtgttaatagagtgtgcctggcagctgttgttcctcttattgaaagtggaactgctgggtatcttggacaagtaactactatcaaagagggtgtgaccaagtgttacgaatgtcatcctaagccaacccagagaacctctcctgactgtacaatttgtaacacaccttcagaacctatacattgcatcttttgggcaaagtacttaagaagtatctcctgacagagctgaccctgaagctgcctgggaaccaacagaagccaaagccagagctagaacattctaataaagaaggtgacattaaacgtatttccactaaggaatgggctaaatcaactggatataatccagttaaactttttaccaagctttttaaagatgacatcaggtatctgttgataatggacaaactatggcggaaaaggaaacctccagttctgttggactgggctgaagtacaaagtcaaggagaagaaacgaatgcatcagatcaacagaatgaaccccagttaggcctgaaagaccggcaggttctagatgtaaaaagctgtgcatgtcgattttatttatttttgagatggagtgtagctctgt

SEQ ID NO: 275 - DNA, 1232 bp, Homo sapiens
gtgattatatttcctttttaataccttttcctcccttagggccactaaatacctctttgttttgttttgcttagttttctgcatacctattatttatccccaaaagctccagaaggactctgaaacaactctatgtaagcaggtatgcttggttatgtattagtccgcatttcttccccattagaagcatcctttctggggccttacatctttctgctccaatttatatagctgctacacagctttcatcttgagactttgttttactatcatcttgagaactctcttctacattggatcacttgagtcttggatcactccatcttcttgctttacctcctcatgctggtgaatcatatccttcattttcatgctgagaaaagggtgaatgaaataaagttttagagatgatatatgtctgaaaatatgtatattctactatcatacttggagtatagaattcttttaggttggtgcaaaagtaatagcggttttgccattacttttgattgcaaaaactgtgataacttttgtaccaacctaataggttggaaattactttcattaattttgagttgtgtaattattatttagcctcagtattacagtcgagaattctgtgtctcccttgatttttaatatttaatcatgatctgttagatctgctagatctctaaaaacttttaagattttatctttttttccccgggattctgaaatttcacagtagtgtatcttacttgggtatctttcattctttttggtggatattgtgtggcactttcagtttgaaagcttatttgtttcagatccaataaatttccttgagttatttatttgataattttctcatgtccatttttagtgttttctcttggtagttaaacctcttagattgatcctgtgattttcttttgtctatggtttctgtctttttgttctactttctaggaaatttttacaactgaaaaatttacatttgatgtcatatttttaatttttagaagttcatttttgttgtttagtttttgaaaaacaacaccctgtttttctctcatggagataataccatctcttaaaactgagaatatcagttttaaattttcttcttgaattgtctctactacttctgaggtctcttttaagatgtctgcttatcatattgtatatttgggcaaatgtgtggccatccatggctttcttaagaatgagacactaaagtaaccaattta

SEQ ID NO: 276 - DNA, 1136 bp, Homo sapiens
atacagagggtggactgtatatgtaaacaacccatataatataccactatttaaacttctttgaactcctgaactctggtatacctttactcctttgtcattttaaatgaactgtgctacacaaattgaaatcttaaattcgatatacctgttgggcacggtggctcacgcctgtaatcccagcactttgggaggctgaggcaggcagatcacctgaggttgggagttcaagaccagcctgacgaacatggagaaaccccatgtctactaaaaatacagaattagccaggcatggtggcacatgcctgtagtcccagctacttgggaggcttaggcaggagaatcacttgaacccgagaggcggaggttgcggtgagccgagatcatgccattgcactccagcctgggcaacaagagcgaaattctgtctcaaaaaaaaaaaaaaaaaatcaatatgccagcctttcaccagttctcttgttgtcctgaatgataaactacagaaagcacctagaataattagccaagtttggggcacaagcctgtagtcctagctactggggagactgaggcaagattacttgagcccaggagttgaatacagcagtgagctgagaccatgccactgcattccaggctgggcaacagagtgaaaccctttcattaattagctaactaattaatgcacctaggataataccttgtacataatggtattcagtaaacgatagctcttgttattgtttttcttctagctgttttttttattatcacaaagctagatatttgatcaaatatttccatttccttgattcttcaggatattttcatgctatcagccccttccaaacttaattttcttctctatttaccctaaaaccaatgttactctgaagcatttctttactgatactgccacagcatcctttgaccttatctttatacctacctgctgtggaaactcccaatagcaaataatttctattctgcttctctactctatatcctgaatgttgcttctctgctctatatcctgaatgatcacatttactactgcaaattttagttttcaatcttagctaggcttgtaaaagttatcccacattttacatttttatttcattaccagcaacttt

SEQ ID NO: 277 - DNA, 1244 bp, Homo sapiens
ttatttttaaaactacgtatgctattttgcattagcctttactagcaaatagtaaaaaactagtttttttaagtgacaaattttgtttgttcttcgtagattataaactaatggataagaatttttaaattatgacttttggttatacataaagaaattacttgctgtttttgtttttttcaacatctacaggcaaaacatttctcagagctcctcaaatgaatattaatattgccacttggggaaggctagtaagaagagctattcctacagtaaatcattctggcaccttcagccctcaagctcctgtgcctactacagtgccagtggttgatgtacgcatccctcaactagcacctccagctaggtatgtgtctgagattttaagcatctcttatacaaagttattgggacattcttacgtactgattatagcaggtgtactgagtcttgcttttttcccaagtagtattttgaaagtagtgttctgtttacttaaaaagtaaattgtttgctttaattttaaagctgtttaaaatacagactttctattactgttttggtgagttactttatcttctataagtgattctacagtaaccaaattggactttgatcttgagcctgaacctcctccagccccaccacgagcttcttctcttggagaaatagatgaatcttctgaattaagagttttggatataccaggacaggcaagccattttaaaccttgcataattcctcttcactgaatgaattagcaataaaagcatcatagtgaataaggcgtgtctttccatttaaaattgccactgaactgtgaatttatggttttttgtttgttttttgtttttgtttttgttttttgagacagagtttcactcttgttacccaggctggagtgcaatggcatgatctcggctcactgcaacctccgcctcccggattcaagcgattctcctgcaagccattctcctatctcagcctcctgaataactggggttacaggcacatgccaccatgcctggctaatttttgtattttcagtagagatgggatttcattatattggtcaggctggtcttaaactcctgacctcgggtgatcagcccgcctcggccttccaaagtgctgggattacaggcatgagccactgcacccagccgaatttatgtttcttatggtctagtctcagctaaattagactgagttggtaggagacaaccaacttcttaatgttggca

SEQ ID NO: 278 - DNA, 1216 bp, Homo sapiens
tgctaataacaaaattaagcaagataaagagatagggcaatgagagaagggggtgttacatggtcagagaaagcctttcatatacaacagtgtaacttccacctcttttaaggtcttctttatttctatatgttgtcatctgacactgtacccaacacatagaaggtgcttattaaatgtttaaatgaaatttttatttatttaacaaacacttatagaggacttactctatgccaagcagtgttctaagtgccttgcaaatattattttatttgattttcacaagaacgctttgtatactgtttcattttatgaggaaactgaggcaccaggatgttgaggaacttccgcaaggtcacagctaataatgaatgaatcagtttgtaaaggaatttaaaaaataaagattcttaaaggttcttagtgccacctcttgctttcaggaacaccagatagggtgggactccatattttgggatcatgttgggtagggagcatgtcagcccctgaggtccttttgaaaagctcctaatacctctacctcccaggccaggcagataccactcttctccaggcttccatccactcagagctctttcctgctggacccgttggaagcttcgtctgctctgctgacacctggactttcctggggctgaggttaagtgatagctttttctctgtggttgaggaattacagctactagaaaagaatgtatcctcttcatccattctcctacctactatttaaatggcaagtagtgtttttatactgtggtccacggacccccaggattaaaaccaccgtggggctcatttaccatacagattcctgggctccacctcagacccactaaatcaggctttgcagatggggcccaaaaatctctattttaagcttcttaaaaactactgggttagaggatgtgcacttcccgtgtgaggggaaagagatgaagaaaagagttatataagacaggtttgtctccacagagagtgcagagaggttctgtaattctgatggaattctttccctgcctggttagagcagagaggtggcagggtagtgggagatcagatattaagggaaaatccatgtgaaaactccagagtcatttagaataagggttagttaaccgtggtctacaggacagctgcctgtttctgcaataaagtttctttggaacatagccacattcattggtttatgcattgt

SEQ ID NO: 279 - DNA, 1392 bp, Homo sapiens
gtgataatttcctgaaggaaataattttgcaaataattgaatatattataagatgtattctttctcatctgccttgaaaattcatatgcagagggtatatgttggtgatcttttatgttttatctgtttatccttctagatttgttagattttctagtctacaagtaaaaagtgattgaggattgattaattgaccttggctgaagtttggcagattgttaaatttttataaccagagataattccccaaattttgactcctacagacacaatgaagcagtttgtgatatagattattgggagtgcaaaaggatctctctgtgtcacaaataacctacatctaagtagacttcaatttgtgtccctattgaaagccaaaatattgtaaatgttttgtaatttttaatattagggatagattcaaaaaagtttgaatagtttgtgaactttagcaaatgaccttttccaagactagggctgggcttaaataatgacagacaaatcttttcttcttcataaaatagaaaagctgctaagaagcagattttaaagctaagttttactaaactcaattcatatttataatctgactcagatagctttctatctggtctcacgttgaactgcccagccctaatcaaatgtgaacaaaagtagaactgtgcaaaccagtatggtataaatgaattttagttgataaatgtcatctgataatttgtcttttgaattgtctaacattagtaagcttacttttgttttttccctcactgtgcaacttttccaggtttggaccttatgagtcttacgactccaggtcttctctgggtgggcgagatctgtacagatctggctatggttttaatgaacccgaacaaagccgcttcggaggtagttatggtggtcgatttgagagctcctaccggaatagccttgactctttcggaggtagaaaccagggcgggtctagctgggaagcaccttactcccgttcaaaattgaggcctgggtttatggaggacagaggaagagagaattactcttcctacagcagtttttcttcaccccatatgaagcctgcacctgtaggctctcgggggagaggaacgcctgcttatcctgaaagtacgtttggaagcagaaactatgatgcttttggaggaccatcaacaggcagaggccgaggccgaggagtaagtacaacagaatcttttcagattcttttcactagtcactcttttaaaccctttcaagaccatcgttttcaactagaataaacactgttcatcccggtgtattttgaagcaaaagctgagtcataaacataatttttaggttgactgtaaaagtttttctagcacctcagaaaataagtggcagtttgagatgatcata

SEQ ID NO: 280 - DNA, 1180 bp, Homo sapiens
tgccattaaagcaagttaccaaagaaggtgatataattagcagtataattgtcttggggaaaagtattgggctctaggaaggataagtgcaaaggagcatggttggtgttctgaaggaaccggaagaaggccaccgtggctggagagaaacaagtggaaaagtgggagatagagtcagagaagtaatttggagctggtcatgtagggcttctgtgtcattgtaagaaatgtaagatcataggatgtctctaacaaacttagccttcaccctttcttggcctcatactctcatcatgatgctctaaaccttgtctgtcttcatgaaactgcagcctattttttctcagtttcaatattcctactctctgaactaccacttcttatccttctgattttactgtctcttaaaccctgactccagtaattcttcaacctcaccagggcctaacagtccattgatgttaccaccttttcactgactctcagctgccatccaccccctccatgttttcccttagttccttacccaaattatattcgtcggtctgtcatcaagatcactctcttataatcactcttcccttgtctgtctcactttctgtgctctcttggcaaaatcccaaccccagttaaaccattctccacacttactttcctccatcttaaaacaaaaaaccttttttttgacccctgccttctccagctatcagtcatttctgtttttccttttaaagcaaaacttcttgcgataaccagatagcattatgatacagagataaaatttataattataggtaatatttattgagcacttgctatgtgtcagacatcattctaaatattttacatatattaatctttattctcacagcagtccagtgaagtagaaaatagcatttttacaatgagaaaaatgaggcataaagaccaactttctcagtaactgatcaatagtaagcgaaattaaaaatccaggtggtctggcatcagagcctatgccctttactattaggatctcaagcaaaatgtgttttaaatgtcagttctcctgcaggcagctagcagtacactccagctcccaagagcgagtataccctactgcagttctcattccttatgaggagcagggctaataggtcctggctgttgggcattgtgtttgttataaggtggagttttt

SEQ ID NO: 281 - DNA, 1523 bp, Homo sapiens
cttacatttaccagcttattataaagggtacaactccaaatgaaagagatacatatggcaaaatatgagggagggggtgcagagttcccataacttctctgagcatgacactctgtcagcaccttgatgtgttcaccattccagaagctctcagaaccctgttgtttaggcattttaatggaggttctatttcttttttttgtttgtttgttttaaaaatcttttttttttttttttaattttttttttttaattatactctaagttttagggtacatgtgcacattgtgcaggttagttacatatgtatacatgtgccatgctggtgcactgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcatttccggggacagtgccaggtggggagtttgactggggctgtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctggaggttctatttcatagacaagactgatgaaatcactggccattgctaattaaacttgatcttcagcccctgaatggataagtcatctccattacttattctataagatgtgaatgttttattaggaaccttaacggttacttcatcccttagggatattgtgaacaagttacttcgatagattgtcttttgatcaaatataatacagtacagtcataaagtgtttccttgtttttagaactttgcagagaagtagttcttacattgaaatggttattggatatagtgtttgggatgatttaatctgctaatatacttagtttatatcttttcctttttggggggatacacaatgctgatttgattggctaggaaaactgtcttatctggtagcttctgtggcgtgaaatgcagttgctgacaacttttaattcataacaagtctgttaacttattcctataaattgaatatgttaatataattcagtaacttgaatcacttcagttaaatttaaatactattaggtgttatgaaatttactatttactgtgactatatttagtggctttttctctctctt

SEQ ID NO: 282 - DNA, 1217 bp, Homo sapiens
aggtgcaccttgattttcttctgtagttctgaaaattctctataaaaccaaagatttaaaatgtcaaaaacagggccgggcgtggtggctcacgcctgtaatcccagcactttgggaggctgaggtgggcagatcacgaggtcaggagttcaagaccagcctggccaacatggtgaaaccccatctctactaaaaatacaaaaattagccaggcgtagtggcgcatgtctgtaatcccagctacttgggaggctgaggcaggagaatcgcttgaacccaggaggcggaggttgcagtgagccaagactgcgccactgtgctccagcttggcgacagagagagactctatctcaaaaaaaaaaaaaaaaagccaataacaaatatgtcatttgcaaaagtatttgctataaaaatctttattagatagtcactgccctcagtctagtttgcttgagtgctattttgcatcttttaagataaatttcttacattacgcttttcagaaattctctgtttaattttagtgtctgtttgtttatgaagtttcttcattaagttttcttattgaaatttgttttacaggcagtttgaaaattgcaaggagggactttaagactacttctgatttgcaaagattgtctgtgctctgagcaggctgaagtgactggacgagacgcactgttggagaaataaaaatgacttcccattatgtgattgccatctttgccctgatgagctcctgtttagccactgcaggtaagttgcataatataaattgcatatttgttatatatttttggatatattttgtcccagtctctttagttgagatgaagtttcactctgttacccaggctggagtgcagaggcataatcatggcttactgtaggctctacctcctgggcttaagcgatcctcccacctcagcctcctaactagttgggactacaggcgtgtgccaccatgcccagctaatgttttattttttgtagagatagggtttcctatgttgctcaggctggtttcaaactcctgacctcaagtgatcctctcttcttggcctcctagcatgctggtattacaggtatgtgccactgtgcctgacctgtatttacatttttgtccctgaataaggatttcaagaaagcatttttgtcctttattagcaaataaatagatcttctagattgaggtgacactcttgacataggctgct

SEQ ID NO: 283 - DNA, 1118 bp, Homo sapiens
caaaaggactcctaccagtacctatttttgagcacttaagtgtgctaagagggtaattagtcagatgaaaagcagacacacagtcagaaatatgaacaggaagattaagaagagaatcacattcaaatacaaagacaacaaagtgattcataattgagtaataatccatttcttttcttgctattttgggttactgtcaactgacttattctcttcgtaagccctccttcctcaccctactatttcatgcctcttgtatctccttggttaagtttcaggcaccttctcttactcttgaatttcatataacttttcttgaatattatagtacaaacatgctcccatctttactggtaaaaccaacttagtttttataccaaatattatctatttaatagatatttaatagagtatctttaaataattattagttgtttcgaattacaataatttattctaatacatatccaataatcatgttatcccttaccttctgtcctgtgtactcatatcctttcccatccatctgtttactcatctttttttctaaaaagtttgtaattatagtatgtagaatgaaagctgggacaagggaaacaatgagatggcaaaggccacaggtaaatatcaggaattttaaaattgaattgcttagtctgtgtgagtgtgcttttcatttaggaaaaaactgtatcttgtataataaatacacatacacaaaattctatataatccatattttgggtgctcatttaagttttggttttttttcaatacttttaagttctgggatacatgtgcagaacgtgcaggtttgttacataggtatacacgtgccatggtggtttgctgtacccatcaactcaccatctatattaggtatttctcctaatacccctcccctagcccccgaaccctgacaggccccggtgtgtgatgttccccatcctgtgtccatgtgttcaaattgttcaactcctacttatgagtgagaacatgtggtgtttggttttctgttcctgtgttagtttgctgagaatgatggtttccagcttcatccgtgtccctgcaaaggacatgaactcatccttttttatggctgcacagtattccatgat

SEQ ID NO: 284 - DNA, 1200 bp, Homo sapiens
ggtcttgaactcctggcctcaagtggtcctcctgcctcagcctcccaaagtgtggggattacaggtgcgagctactgctcccagcaagagccaagattttaacctagatctccctaacaccaaagcttttgaaagggttcagctgaagaatttctcaattctctgttttgttttgtttttatttttgttttttgagatgaagtctcactgcactcaggctggagtgcagtggtacgatcttggctcactgcaacctccacctcccgggttcaagcgattctcctgcctcagctcccaagtagctgggactacaggtgcacgccaccacaactggctaatttttgtatttttagtagagatggggtttcgctatgttggccaggctgatctcaaacttctgacctcaggtgatccacccactttgacctcccaaagtgctgggattactagacgtaagccaccacacctggcaattccctgcttttttgacaacataatttaaatgaatttgatttaaatgtttcctgaatatatatacagatagatagatgagtatcaacacttacaagctctacacagtctgtgagtgtagatactacttactcgtaggattgtcttgtgctttggggatttttgttcggagttctatactatcagcccagaaagctatcaatgtccaagtgaagtgagatgatgcatggccacattattgctttgaccctcacatcaagaaatctgaatgatctggaccaggggtcagcaaagtgcagcctacaagctattgcagtcagctgccagtttttacttttttaaatagttgggaaaaaaattccaaagactgatattttgtgtcacatgaaaattatatgaaattcaaattgcagtgtccataagtaaagttttattggggcacacccatgctcacccttttaaatattgtgtatggccgctttgtgctacagtagcagagttgagtcattgcaagggagaccatatggcccaggtagcctaaaatatttatctgatcctttacagaaaaagtttgctaacccttgataacagatactctaaaatgcaggtttttcttcttcaatttagctcagtggtaggtcaaattgtttgcttttgctattaagcttatgatttggaaacgtaaaatttcatggtggatattataatcagaactattcaaaagggaaa

SEQ ID NO: 285 - DNA, 1483 bp, Homo sapiens
accttggagtactttagtcattttgaacatcagctctttctttttttttttttttttttttaagagacaggacaggagagtctctctctctctttttttttttttaagagacccttgctcaggctggagtgcaatggtacagtcatacatagctcactgaagccttgaactcctgaggtcaagttatcttcctgcctcagcaattcttgttatacgtaatatagactaaagcgcctgctctagaaatttatcttcaaaaatgaaacaaaatagaacaaaggttgtgattttagtttatctaaaatgtggagtttccttcctcttgccaccagatcagagaaaaaattttgtaatgatataagttgattgagattttttatggcattttgcgtaggaatatatattgcacaactaggcagttatccacatttattatccctgaactttgaattataattttacatatgatgaggctggctaaactttaatggtattttttattttagaaacctagtaaatacatatttacatttgtaattacttgctgtaatcttacattgaatcagttgtattctgtttcgtgtattgtgtcccccccccctttttttaataaaggaagcactgtgactgtttttattttaaagactttttttttttttttaagagcagatttaggttgtccccttctgccacacatgcattgcctcctccattatcaacatccctccaccataatggtagatagttataattgatgaagctacatcaatacatcattatcatccaaagctgtgacttcttttagtaataaaaagaagtttcaaaaatattacacttttggagataatatcctgtcatactgaaaagccaaaatgtaacattcatgtatcatatttttttcttagttgaatacggtataggattgttatgaagagaagataaaacttttgaatcattttagaagataatggtagtattacattgtttccttatgtagtttttgtacttcttttggcttggtacctaatgattatcatatagattgagtgtagctgtttgaggaactactatgttttggattattttctttgagatagtaaaaatacttaacatttgaaaccatgataaactttcttaaggtttttatgtaaaatgaagtctcatctgttgtatcagattgttttggggagtttaaaatgagatattagtactttttgtaatcgcttattgtcatttgtgtttgattcttaaagttatttgaaatcctagttctgtaataaccactcttctgtggtcttaaattttagaaaccctgaggttgataccagaataatttatggagtgctacttcacttctgagggaggtagggagaaaagcaaagatgaaactcaagaaatactgtggtagaaatgatactagaggaaaatatacaatagaggtggaataatatttataagtggaaattataagaaatctgaacaa

SEQ ID NO: 286 - DNA, 1388 bp, Homo sapiens
agactacaaaagcccaacttttctctatttacatatgcatctctcctataatgtaaatagaataatagctttgaaatacaattaggtttttgagatttttataaccaaatacatttcagtgtaacatattagcagaaagcattagtctttgtactttgcttacattcccaaaagctgacattttcacgattcttaaaaacacaaagttacacttactaaaattaggacatgttttctctttgaaatgaagaatatagtttaaaagcttcctcctccatagggacacattttctctaacccttaactaaagtgtaggattttaaaattaaatgtgaggtaaaataagtttatttttaatagtatctgtcaagttaatatctgtcaacagttaataatcatgttatgttaattttaacatgattgctgacttggataattcattattaccagcagttatgaaggaaatattgctaaaatgatctgggcctaccataaataaatatctccttttctgagctctaagaattatcagaaacaggaaagaatttagaaaaacttgagaaaacctaatccaaaataaaattcacttaagtagaactataaataaatatctagaatctgactggctcatcatgacatcctactcataacataaatcaaaggagatgattaatttccagttagctggaagaaactttggctgtaggtttttattttctacaagaattctggtttgaattatttttgtaagcaggtacattttataaaatgtaagccctactgtaaggtttagcactgggtgtacatatttattaaaaatttttattataacaacttttattaaaatggcctttctgaacactttatttattgatgttgaagtaaggattagaaacatagactcccaagttttaaacacctaaatgtgaataacccatatatacaacaaagtttctgccatctagctttttgaagtctatgggggtcttactcaagtactagtaatttaacttcatcatgaatgaactataatttttaagttatgcccatttataacgttgtttatgactacattgtgagttagaaacaaacttaaaatttggggtatagaacccctcaacaggttagtaatgctggaattcttgatgagcaataatgataaccagagagtgatttcatttacactcatagtagtataaaaagagatacatttccctcttaggcccctgggagaagagcagcttagatttccctactggcaaggtttttaaaaatgaggtaaatgccgtatatgatcaattaccttaattggccaagaaaatgcttcaggtgtctaggggtatcctctgcaacacttgcagaacaaaggtcaataagatccttgccta

SEQ ID NO: 287 - DNA, 1178 bp, Homo sapiens
gggcacagtggacgaccttccaaatcaaagcaagtaactaggggttgacaatggtaagtatcatagttgaagtatccttgaacaaggtttcaggaagaagaagaagggaatttcatgcagggaaacagccaaagctcagtgagtcaaaatatcacagcattcttggtaagcccaattgttttttctgttttgctattttggtggagagaaaggaacacataaaggaataacatgagagaaggctatttggggaagtgtagtagttaaggttctggctcaaacaacaactgcagctcataaagttgactttagtggaaggatactggggtatctcatggaatcttgggaactgttgaataaccagggaaactctgggaaactcactggtaggaatccataaactgtcctcctggtgggctgtaaacaactcaccctctatgcatctcacatcaaaattccagtttcttgggaaaacaagtctgtttgcccaatttgggtcatatttccacgtccatgttactcaggcatgattcatctgcaagttatgtgtatagatattttgctactgttccacccttacgctgtgctggggagggaggtgtcactgtgagctgtgtcggtgccttaagagatatctgttgtgtcttattacttggttgcttttccccacatgtacaatgacaaaaatgccttcaacctatttgatccagccgttccagtacaactcctatacttgccatctttccaagcccaaaggtacatccagctgatggaaggagcatcttggtgttaatattcttttagtcatggtctctgaaagtaaaatgtctattcttctaattctggcacaatcttatctagctatagttcctcatggtcctgcactccatggactaaattgtaagtataattactaccaatgtactctataaataacttttggggccagggtggcaatagttgctagagagaaaaaaaaaaaaaaggaaggagaagaaaacagtgatagttcttattttaaaaggaaaaaaagaggcaggaggctctcttgaggccaggagtttaagaccagcctaggcagcatttcaagaccctgtctctactaaaaagtaaaaaaaaaatttagtcaggcatggtggcatgcacctgtagtcgtagctactcaggagactgaggtg

SEQ ID NO: 288 - DNA, 1214 bp, Homo sapiens
tttttctccagacgacgcagaaacaggcacacggggttctgctttccccacctcccacccccaagcccaggtcccattcttctcactttcaatcctcatttgggctcctaaaggaatagcaaagagagttattttatcaataccagcgctcctctgtccccaaatccagctagggaaggtttcggaggcctcagctacttgagagagggtagagacgatccttcctcgcctatctacccagccacccaccccttcccagatgtagcgtccgggccccagaccaagcgcgtgcttggagctctccggtacagtgaggcgcgcgcttgcctggctagggtccctgtgaaggaatgggatcccgaggtgcttgccaggaccgtagcaggcggaagctgctggcagcgcgaacgggcggctcccgccggcgtgggtgggggaagggcggcagccacacccggaagtcggtccgggagggagggggaaatctgagggaacgaggcttccggtggcgcaaagggtgtcgggagcggcttcctgcaaaccttccctggcatctggagggaccaccgttgccgcgtcttcggcttccacgatctgcgttcgggctacgcggccacggcggcagccactgcgactcccactgtgcctggctctgtccatattagttcccaggcggccgtcgccgttccagcagcggcagcggcagcggcagcggcggacatgttgtgaggcggcggcgcgggtgtctgaaggatggtttggccgaggcggcggcaacggctgctggcggcggcggcagcggcagcggggcctcgggctctatagagccgagcccgctgggtacccgcccggtaccgcggcgaggccagtgcccctggatcttgcctctgctccgacgccgttggggaccagttaggcgacagcgcccgcccctctgaggagacacgaaggtggttccccagccgctcaaatttccggaccaccgcgctttcccctcctcagcctgggctgtgctctctctagaatcctcgggcccccactttcttcccaaactcatcctaaatctctcacacacgcgagtgttcccagccctcaagccagctgctcctccgttcattttctgcaccctcttcgcaaagcaccccccgggatcactctccgagggcgactttttgagaaatctcggtggagtagtggaccagagctggggagtt

SEQ ID NO: 289 - DNA, 1227 bp, Homo sapiens
gtccagccgcggctgggtcgggcgcggcggccgggcgcgagggaagagcccaggcccgagaggggtcgccgcttacgtctcgcagcccgaggggaggccgctcggcctcggccgctcacaggcgcgacgtaaaggcccggcgtcaccggcccggcttaacggtgcaacggctggcctgggcctgcaactctggggtcccggccgggctggagcggccgccggagagacctggtaggcggggcgcttggggcaggaagggagccggggagggaaaagcgcgactgtgattcgtacggctgggcccggaccgtgaaggggaccgggttgcggctgccctcacaccgaccaggtgggaccgtcggactgcggccgcccttggctcaactgggtcgccgaccttgttgaggggcgaccactgcggggagaccgagagcctgcggctggcgtttgaggcggatggcagtgccctgagcgcggcggctgggtctcggtgacactgacgacgggaggcgcggtcggaagagcgcggggccgtcgcctctggcttaacatagcagatgcgctgagactccaacaggtggctccgtggcgcaatggatagcgcattggacttctagaggctgaaggcattcaaaggttccgggttcgagtcccggcggagtcgtaacgcttttttccctcccccctacaatttattttctgcctccatcatgtctcttattttttttttttgctaaacggtttaacttctctctcattccctgctctcgcagttcactgcattcggttcttgcggtcctttcttaagcggctcgcagggtcccgagcccctcagctccccgggcctcggtggcccagggcccagctcagccgactgggcagtcgatgtaggtcctgagaagagcggcggcggcggcggcggcggcggcgaaggaaaagcgacactgaagcgaaggctcgcggtttcggcctaaaggaaagtgcaggggaggcccgggtctcgggtgacacccccacgccttgagcgggactgtggttgcgagggagggacgagaaaacacgcctacgccctgcgtgcgctgtgctgactacctctccagcatggaggcttccagatgagcagacacccgaatcccagcgggagcccgtcaaaaatggagatttctgccgtcactctgggactcttaattcggtccgtctggggtggggcccaggaatctgcatttc

SEQ ID NO: 290 - DNA, 1210 bp, Homo sapiens
tataatgatgaaagtatagtatagtaaatacataaacaagtaacatagtcatttattattattatcaagcattaagtactgtacctaattgttttatatgactggcagtgcagcagtagtttcatcaccacatacatgtgagtaatgtgttgtactgcggtatgatgtcagctacagagtcactaggtgataggaatttttcagctccattataatcttatgggaccactgttgtgtatgcatttttcactgaaatgttatgcagtacatgagtgtaatacaatcatggtgcaatactctaagagttaaggcaccttttattgtagattataccacagacagaaaactgcataaatacataaataatgcaatgacatcttttacaaaacaaaacacccttttaaccactacccagatcaagaaataaatctttgccagccactgcagaagccttccacatggcccttcccagtcacagcccctttcctctcacctaaaagtaattgctatcctgacttctgtataatcgcatctttgtgtttcctataatttcatcacccaaatgtgcattcctgaaaactataatttagttgtgtttgtggttttttttttatctatgtctcttaacctacatatccccctgccacctccctttccctttctttcttacagtttattccctgaagcagccagttattttgacctgtacagattctgtagtctagattatgctgattgcatactttttcttcatcctttgtatttcccataaattggtagttggatctaaaaccttgatcaaatttaggttttgctttgagttttgttttttttccacttcctaggagttagtgtggtatattcaccatcaggagatatataaagccaggcatggtggttctcacctgtaatcccagcactttgggaggcccaggcaggaggataacttgagcccaggagtttgagaccagtctgggcaacgtaatgagaccctgtgtctataaaaagtaaaaaacattagggaggtgtggtggtacatgcctgtaattccagctactgaggtgggaggatcacttcagcctaggagattgagtctgcagtgaactgtgatggcaccatgcattccagcctgggcaacagagcaagattctgtcttgcaaaaaagagagttatagtgtctagttttctctctttttgtgattttagcagc

SEQ ID NO: 291 - DNA, 1372 bp, Homo sapiens
ttttcagtatggtccttctcatggagaagcctcaagccacagctccagtagaaatcacattctggggtaaggaagggaagagtcagtgaagaaatggagggagcagatttagaaaaccgtgtttaaggccaggtggcagtggctcatctctgaaatcccagcatttcgggaagccaaggcaggtggatcacttgagcccaggagtttgagacccacctgggcaacatggtgaaaccccatctctactaaaaatacaaaaattagccaggcatggtgatgtgtgcctgtagtcccgaggattgcttgagccaaagatgtcaaggctgattgagcagtgatcctgccactgcactccagcctgggcgatggagtgagatcctgtctcaaaaaactagaaagaaagaaaccagtggaaggaagctgagaagggggcagtccttaacaagtagatagctgggttgagagaagcaaaagcgaatttatagggtttctaaaggcaggggccaggaaagctgaagaggtgagagttctgggggtggaaggggctggcaggagctgagggagtgaagtgctcattctggacatgaggaaggaagacagaccacctctccctttgaaactcctcctgccactttctctttctcatgatagctgtccttcctctcctcattcccatattcatttattctcactctctctctctttctctgtgtgtgtgtgtgtacgttgtttcttctctctccttgccttattcctgcttgaaacaattgggaatacctcactaattttatctattgtcgttcaggttcaaagacattgctgattctctaaatttggtgttaacaataaaacacagtgttttgacagcagccacaggacttggcagtcccaaaagggaattctggaagagaggagaggcctcagtcagggttgtctttttctggagttcataaccttcacaagacttttatgcaattatttttgtgtgtgtatgtactcacctacatttttagggaataggattctactacatttatttattgtcaaagggaaggaggatcagaaaggttccaggccccactgccttttataatacctctatcaaatacaggtgctcagttttagcttctttatgataatttgtgttcttgatttcgataaggatacagcttaaaagcttttattcgtaagaagtagggttaacatcaagaatctcaactcagcaatcttttgaaatgcagaatgactcacattccagtgtcacattccagtctttgttgcttatcaaaaaccttagataatttaagatggtatcaaaatactaatgcagtttaattcctttgtaaacagtgttcactctgaaacgtcccta

SEQ ID NO: 292 - DNA, 1227 bp, Homo sapiens
ctccacagctaacattgctccattctgaaactacacctactcatcagaaaaggcatttcttaagatatatacccaagtagggggtgacttggagaggggacaacagcaacaacatttttgaagttggaaaacaaatgaacaattggtaaaggagtttgcagacctgaagaagaatggaatcataaactagcaacagagaaagctaaaatccaacatgttttgtgttgcagaatcctccaaaagcctcaatctctgtagaaacaaggaagaggcgaaggagactctgaggaagaggattgattttaaaaagtctagtagtcggagccccttcccaacctcacacagctgggcatctgctcctctgtcagtacaatgaaagaataaagtcatattccctggagttaataaagcagagggtctccgtacagggagtgagtgttaaggtcaggggttctatacactgaacttagaaagcgtacgtgcgtatttacctggcaggggagacacccttatcacaaaggtggttttcccagggtgaggcttaaatgctgcatttcagatatgttgaccctatgatttaaccacatttgggaaattcgtctgcataatttgtggtagtgggagactgcgtttgcttctcccctggttaaaaaaaaaagaaaaaagaaagcctatgtgaatgtctgcatatgatccttgaaatcggggatccaattacttttgtgattcccagaacacaggcaatcaggctttcagcctaagtagaggactggggaatggattgcccccaaagagacaaagaatacaacatttgaggttctttaaataaatggctttgccagatctcctgcagtaaatacttcagtcagctaatctcacaccatgaacttccaaccagcctttaaaaaaaatcgttcttaaatatgagccatcaaggatcagacagtggaaaattataaaatgaagtccaaaacaatcaaaagtgaacactacttggagaacagataacgaaaagagagaagttgaaaagaaaaacacatcactatgattcataatcattagcaatataaggaaactactattactacgaaacaagaacagaggacttgtttttaaggaacacagaggaaacatgagccttgaaaagtaaaattataatagaaaaaatgtttaaattcaacagaagagttgaaagaaaggtgagaaaatctcctgaagatagaaaaa

SEQ ID NO: 293 - DNA, 1321 bp, Homo sapiens
taaataaataaataaataaaacaattggaatgtaaaagaaatctgtaatcccagcactttgacaggctgagacaggatgatcacttgaggccagaagttcaatttctgcctgggcaacatagcaagactccacttctttaaaaaaagaaaaaaaagaaagaaaatatattatttgtggtccttatatgctcgtttcaaaaaagggcatattaggaccacaaaaacatgagaaacctaattaaacagacatgtaggcccagaccaagttaaagtcaaaaacaacttttttgaaaggactagataaattagtaaaactcgacaaggctgaacaatgggaaataaaagaaagcagaaattggaaaaaggggacagaagacaaaatagggacagaaataaaatttttctataggcattaaaaagataaaaaaactattaaaaattgtatctaataaattatgtaatttatgtgaaatgaacaagttagctttttcacaacgggtttgctgccagaacacaggtgtcgtgaaaactacccctaaaagccaaaatgggaaaagaaaagactcatatcaacattgtcgtcattggacacgtagattcgggcaagtccaccacttctggccatctgatctacaaatgcggtggcatcgacaaaagaacaattgaaaaattgcagaaagaggctgctgagatgggaaagggctccttcaagtatgcctgagtcttggataaactgaaagctgagcgtgaacgtggtatcaccattgatatctccttgtggaaatttgagaccagcaagtactatgtgactatcattgatgccccaggacacagagacttcatcaaaaacatgattacagggacatctcaggctggttgtgctgtcctaattgttgctgctggtgttggtgaatttgaagctggtatctccaagaatgggcagacccgagagcatgcccttctggcatatacactgggtgtgaaacaactaattgttgatgttaacaaaatggattccactgagccaccctacagccagaagagatatgaggaaattgttaaggaaatcagcacttacattaagaaaattggctacaaccccaacacagtagcatttgtgccaatttctggttagaatggtgacaacatgctggagccaagtgctaacatgccttggttcaagggatggaaagtcacccataaggatggcaatgccagtggaaccatgctgcttgaggctctggactgcatcctaccaccaactcgtccaactgacaagcccttgcgcctgcctctccaggatgtctacaaaattggtggt

SEQ ID NO: 294 - DNA, 1242 bp, Homo sapiens
aataaccccacagagaaggctgaatcctaagaatatcagggtcagcaaagcagttgactcaagacaggctgacttgacgatgcataaaaagattttgtcctccaaatcgtgactcttaattcccaataaatgtaattttgatttgggattcagaaggtgctgtaccaaggtatgcccaagagttttggaagtaactagtggcaaaatgaaagcttgtctatccaatccctttctgcaaaaattttagatttctgtggaattttcaagccacatggacttcactggggataatgaaacagcagtgctcatatttaagcatagctgtgaaaaatgcttgaggggcatgttgcagtgtcaagttttagaggttgggtcaattgagggtctgtccttgctctgtctcttgctacttgttactgtttttgcacctgtaaaatggtgtgagaatgcgtgtctcatgaaactgttgtgaggatataagggaatacatttcacaatggtctccaggtgcagagggagtaaggataatgtcatttatgccttctgaccatggggcatattttaaaagaatatacacagagtaggaagttcttactcaatttttttctctgtagataaaaaagaagaaaaaaacctctttgtctggaaattatcttaaaagccatatttcttttttttttttttgcactgtcaatggaaatagaaactaggtggcctaatgtgacattctgtcactgaaatcatatagaaagcataaagcttgctctactgaagaaatttagagagattaagatgccacctccctccttgtgatacttgcttatgagagtgttgttctagagcatttgatttccaaatatggtctcttgaaacctgcctcaggatcatctgaggtgtttgttaaaaatgtagactcagggtctaatcccaaatggactaaattgaaacatccaatacggggccccagaacctgcattttaaacacacccccagatgatacatatgtaatctgaagctgaagaatctcaacctagtgcagcaatctccaaatatttgaccagccaccaatttgtaaaggttttgatatcctccacgtatgtggtgtatattcaattaccaattgtaaacattgtcatgaataaaattttagaaatctagtaaaggttagaaatataaatatgattacaaattaaacattttatttcttcctttataatggtcttataaacagtctgggatgta

SEQ ID NO: 295 - DNA, 1217 bp, Homo sapiens
cttttatttccttatcccgacctttcagcattcattcttgctcatacctgccaatctcatctatatgttagtagaaataaagattaaatggttactggcccccaccatgataagctgaaaagtagattgcaataaactctgagggtcctccctccactccacttcaatttatttaacaacagctactctttatggagcactattctgagaatgacaattctctgagggaagtctaattagcctcattttgtacataaggacactaaatcatagaaagctataaatctggcaacagtcatgccaggagtcacacataggtctttctgactccagacccttcccaccagacctcacactgcttattcttgattcattccatgaacattattgagaacttgccatatgtaagtctttgagtcttacagagaagattccatataaactcccacccaaaaaaaaaaaaaatttgtttttctctctttaaatcccttaacttttcaaaatgcatttacatttattatctcacttcaaatggtattcagtgccttgaaatacaaatatgacaccattagcagagttgtcataaatctttggctgtgctgacatgagtaaagacaaaacaaaggagcaactgaacaatccagaaagtgggaggtgaattagtttcagtgacccgttctccaagccttggtcataaaggatgaatgttcaagagcagcgactcattgtaatagagaaaggatctgtgctgcctgccaccaggcctagacttctgcattctgcaggagagtttcccgtgactaattttaccagctcaaaaaacttccacacccacccccttgcgatgcatcttttgtctgccataaggcaaatgtcacttcgtccatttagaccacccaaggttatctgattcttgttggttattctatgttttattaggattggaatttatatttgttgatcttcaaacaatagagtcctgttccttggtatcaaatatgaacagttaacatcaagaaacaaagcaaaaatgaagtagataaaaaatagaaaatatagtgactgctgtataatatagtcagggataaatgttaagggttaccaaggcacaaagccaggaattatttctgaaaggaaagagtcactatctacatcattgaatactttttgccatttcattatataattacaagtagtttattcatagaaatgttttt

SEQ ID NO: 296 - DNA, 1184 bp, Homo sapiens
tgtgttcacattttgtgctgaaagtaatgatgtaatattttcgcataggctgttttgccagttgttattcccagaattttatagagaatgtgatagtatctcttttctcctaaaaagggaatgccttttataattatggctttaataaagagaagagcaattagcttgtaattcataagttaatactaaaaggtatgtagtttctccttatgagtaaaagtatttgtgtaaaaatcctaattactttattcttcctcagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaa

SEQ ID NO: 297 - DNA, 1195 bp, Homo sapiens
tgcaactctgcctttttagcagaaactaaggaatatagttttaaattagtatcttctgcatttatgtaggaatgttcactggttctgtaaacagctaattttctattgtttctcattggtgctgccttttttttctagctgagttgccatatgtttaaccattgaaaatttaataaaagctaaaccaccatgtttgtttaaacttattgtttaatatatttattctgtattacatcatgtttctgaagtagggctcatgtgtacatattccgcattcatcctacagtgttctatttggcctttagaaccaaatttagaaataaatttaaaatgcaaaaagcctcagatgttaagagttccgcctcctttgggatattaagacagccccaaatacagagtttaattgcaacatgacataaagtactggcttactgatgagttgtattgaatgatctgcatttgggtggttgccaacatatgcaccagtcccaaacaaagagtgtgtgtgtgtgtgtgtgtgtgtgtgtgtgtgtgtgtgtgttagaatggtcacctgctgtctctttatcttgatattggacttatatctgtaggaagagttttatggaagaaaattggttgttgctgatagagaagaagtggaacaagaagcagataatattttaaaggatgctgatatcagtgatgttgcattccttgtggttggtgatccatttgggtaagtcaaggcagatattttgagtttttaactcatttacttttttttaatcagtaagaattattctattgcatttaacacttttacctgccaggtcctgataaggaactctggttacttaagcgctatctaaaatgtcatagtttaaactttcatgatctttgagattagtgaagaaaagctagttggtaaatatatcatcatatgtatcactacattatcaagtgtcaactctaaagtttgtatcattgcttctgctgttttagaaggtcatgtagggcaacaaatgccttaactgctatatcattattaaatagttcattacattatcaaaagtcatgcctgccattttctgctgataatttcaggcatcttcgacttcttttgtcctaggttttttttccttttgtaatcatctactatttggcaatactgccgtcactttgcttgccttgaatttatcatttatcaagtctc

SEQ ID NO: 298 - DNA, 1414 bp, Homo sapiens
tggttatggccttcaaatatagtgaaccattaagaaccatttagaagcataaatggacagatgaaagggacatgataatcaatttatgagaaccgtgatttaggcctgaataatatgcaaaacaagcctttaaaagttactggcgcttttccttgctacctgcagaggggtccatacggcgttgttctggattcccgtcgtaacttaaagggaaactttcacaatgtccggagcccttgatgtcctgcaaatgaaggaggatgtccttaagttccttgcagcaggaacccacttaggtggcaccaatcttgacttccagatggaacagtacatctataaaaggaaaagtgatggcatctatatcataaatctgaagaggacctgggagaagcttctgctggcaggtcgtgctattgttgccattgaaaaccctgctgatgtcagtgttatatcctccaggaatactggccagagggctgtgctgaaatttgctgctgccactggagccactccaattgctggccgcttcactcctggaaccttcactaaccggatccaggcagccttccgggagccacggcttgttgtggttactgaccccagggctgaccaccagcctctcacagaggcatcttatgttaacctacctaccattgcgctgtgtaacacagattctcctctgtgctatgtggacattgccatcccatgcaacaacaagggaactcactcagtgggtttgatgtggtggatgctggctcgggaagttctgcgcatgtgtggcaccatttcccgtgaacacccatgggaggtcatgcctgatctgtacttcgacagagatcctgaagagattgaaaaagaagagcaggctgctgctgagaaggcagtgaccaaggaggaatttcagggtgaatggactgctccagctcctgagttcactgctactcagcctgaggttgcagactggtctgaaggtgtacaggtgccctctgtgcctattcagcaattccctactgaagactggagcgctcagcctgccacggaagactggtctgcagctcccactgctcaggccactgaatgggtaggagcaaccactgactggtcttaagctgttcttgcataggctcttaagcagcatggaaaaatggttgatggaaaataaacatcagtttctaaaaaaaaaaaaagttactggcaattttttttctgtatttcaaaaaaaaaaaaaaaaagaacacgggatacatgtgcagaaatacatgtgcagaaagtgcaggtttgttccataggtatacatgtgccatggtggtttgctgcaactattgacccgtcctctaagttcccccacctcaccctccacctcccaacaggccttgatgtatattgttcccctccctttgtccatgtgttctca

SEQ ID NO: 299 - DNA, 1180 bp, Homo sapiens
gtgacacacatactggttattcaaatccttaaacttactgtttggtcatccagatatacatataaaatatatatttcatatatatgatgtatttcatatatacattatatatatatttcatatatatgatgtatttcatatatacattatatatatttcatatatatgatgtatttcaggtattcattatatatatttcatatatatgatgtatttcaggtattcattatatatatttcatatatatgatgtatttcatgtattcattatatatgtttcatatatatgatgtatttaatatatatcatatatatttcatatatatgatgtatttaatatatatcatatatatttcacatatatgatctatttcatatatatgatgtatttcatatatatatatatttatatacatgataccaatttctatattaggtcttcaagtagatggtgtttccccaacttctcatattcttttgggttcactctgagttcccacagaaaacagaactctcttcaggtagtttcagaagtttgagcagggaggctgggaaatctagtaattagcattaccttcctgaggactaaaggggcaaggggcataaatactgatacagtgctcagtgaggagctgtagttctgtagaagtactttctagcagtgtcaatagtgataagggtcccagactactgtgacaagctaggaaagtatgggggtaaacaatgccaacctttttcccttcccaacttccaaactcctggtggtagcttccatgtctgtcccggaaaccaacctgcgggagagtctggtgatgcagactttaggggtcagattcttgcaggcacagagtaagagacagaaatgttagtaataggaattggggtgccaacagtgaataacaagtattcctttatttaaaagaaaaactgaccactttcacataaattatgccaggaaattctagataaatcctctaattttctcaggtgaaagttatttcaaatttcttatatcttcataattggaatatagcaggtagtaaagaaatatgtgtctcatatcttatttatttgtgtataataatctgaataaccagtctataagtatttgagaggaggtttattttcctcctattcatagtgtcggcatgatactttgcctccataaatatttattgaat

SEQ ID NO: 300 - DNA, 1175 bp, Homo sapiens
catttcatgggcctgggggtttcctagcagaggatattggagcccctttttgtgacattaccaattacatctttgtccacgtttaatactttgttttggaaaatttaaatgctgcagatttgtgtagagttctaataccaaagacagaagtaaatgttttccatatactttgtcttgcctgtatgcagccctcgtgtaatacggtgaattagagtggtatttcactttgtattattttgtaaatatgtcaatataataaatagtgactaaattgatttctaagagttggagtctttttattgaatgatccctgtattagtcagggttcccctgaaaatggatggcactggattgttgggcctgtaccaggccatcgccagcagtccagagtgaacagaagcagtgtatgtgtggaggtcaccacccccccgcccgccagccccgtggacgctatgcgtctagtaggagggccgctgcggtgagtcttgaagcccagggctgggcccgggcagagccgccgcaggtgcagatgttggtggtagtagcacatattctaaagagaacttcaaaggccgaagtggagaagggttccatgtgaacagcagttggacatgggtcattcggtcctgagaaataggtgagcgccattctgaatggacaggcgatggcctctgttgccctcagccaatcgaaagggagtccggttcagatcccgaatccggagtggcggagatggacactgccaagcgtccagcacagtaatgcgaaggatcccagagaagccaatggaagccccggggagagttcttttctccttgtgaagggcagggcgccctggaattgggttcgcctggagagaggggtccgcgccttggaaagcgtcgcgcttccagcggcatctggtgagctctggagggcccttgaaagtgcgggggagagggtgtaaatctcgcgcccggctgtacccatatccacagcattcctccctctggaactaagacctctaggccagcacaacagaatgtcgcgggaacaggaagcaaaaattttgctagtggatcacttagggtgatggtgagtggtgccacttccacttccaccccctgattcctggacccttgaatcctggccatgggagaaacagtaccatacattggacactgattcagagcata

SEQ ID NO: 301 - DNA, 1710 bp, Homo sapiens
cgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatatagtgtcctttttttaaaattcagaactttttttattgataatggagattgctgtttgagtttttaaacttaatctagaacagaggagtattaaaagtaatgctg

SEQ ID NO: 302 - DNA, 1214 bp, Homo sapiens
ttattattattttttaagaaagcaagtttcacgggccgggcgcggtggctcacgcctgtaatcccagcactttgggaggccaaggcgggcggatcacgaggtcaggagatcgaaaccatcctggctaacacggtgaaaccccgtctctactaaaaatacaaaaaattagccgggcgcggtggcaggcgcctgtagtcccagctacttgggaggctgaggcaggagaatggcgtaaacctgggaggcggagcttgcagtgagccgagatcgcaccactgcactccagcctgggcgacagagcgagactccgtctcaaaaaaaaaaaaaagaaagcaagtttcacatgaataatgctgtgttggaaggctttttgatttaaaatcttttcggatttataacatcctgttaagttttaggagaacccgttttcccagagcagattcaagcttctaaaaataaatgctttcagtagcaggaatggcattgtttaaaaagctgatggcagggtaagcatttgggttagtgttttattaacatatttgtaagtacttgttcattgtggaaatgtgtccttgactaaaaccatacgtggctatggaaaccatgtttgtagttctgaatacacaggttttgtgtgtatttactctatgtattaaattattattgcccttagtttaaagtaaggattacaattggatttaagtagatcactgaatgttattgtttatgaaacttaactttttgtatgctgcttataaacatgatctataaatcagtgcttgggaaaattttactttcttaatctactgatacaggaataaaatatgaacaattaaacaggttgatccttgaatctgactgatttgtgactttttttcctcccagaatattatgcccattactggtaatatgataattcttgctgcttagtctagctgaaaattttttttatttcagtgagtatctgggtgaatcttttcatttaaaaaagcaggactgggccgggcgcggtggctcaagcctgtaatcccagcactttgggaggccgaggcaggtggatcatgaggtcaggagatcgagaccatcctggctaacacggtgaaaccccatctctactaaaaaatacaaaaaaacttagccgggtgtggtggcgggcgcctgtagtcccagctactcgggaggctgaggcaggagaatggcgtgaacccgggagg

SEQ ID NO: 303 - DNA, 1557 bp, Homo sapiens
taatcccagctactccggaggctgaggcaggagaattacttgaacccgggaggcagaggttgcagtgagccgagaccgtgccattgcactgcagcctgggcgacagagcgagtctccatttcaaaaagaaagaaagaaattgaagacaaattaaagtcacgatcacagaaaaactaaagatatgtatataactatgtagttatacaaaggtcaaaaggctaagtgccgtggccatcgcctgtggtcccagctactcaggaggctgaggtgggaggatcacttgatctaggagcaatgagccgtgttcgcgctactgcactccagcctgggcgacacagcaagaacgggtctccaaaaaaaaaaaaccacgattctgtaaggtggaaattagtactgccttttcctgggacctatgttcccctccgagccacgcgagggcagcaacgcgcgcactctgaggaacacccccttcctcaggactcgtccgcctgtgctcggtggtttctcccagaatcctccaaggcgcgggagggggcggagagcttaaaagtcgcggggggagcggacttccgctgttttagggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgggcacggccaccgggctgcgggctgccggtggcgtaggggcgagcacgtgaacggcggcggcgggcggggatgctgagcgcggtggccaagggtaaatgagccgctgcccctccccctggagctggaaggtcgcggaggcctttttggccgctgatatactttcctcccactttcccatttctccttgtttttcttttttcttttgttcctttttttttttttttgagacagggtcttgctctgtcgcccagactggagtgcagaaccgcaatatcggctcactgcaacttcgacctccttggctcaagcgatcctcacatctctgtctcccgaataggtggaactacaggcgcgcgtcaccacgctcggctaatttttgtatcttttggtagagacggggtttcaccatgttttgccaggctggtctcgaactccagcctcaagtgatccgcccgcctcggcttcccaaagtgctgggattacaggcatgagccaccgcgcccggccccttttttagtttttctttctttcttttttttttttgaaacggtctcactctgttt

SEQ ID NO: 304 - DNA, 1352 bp, Homo sapiens
aaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctctcttgctctgatgcttgcctctgggcctctccatgcccaaggtggtctttcatccttgacaggctggtaatgtgctggccacctccagctcctgcatcgagtctgtaaaccagagctggttctcatggccttcgtcacgataccaggatacggaggggagcccagggccatccatacccaccccagggtaacggggctggcctggcattagtcattatttagtttccaggccaaccatccagatagagattccctctttcctttgagcagtgctctcaagagctccgtgcctgtccacaatgacctagagtgcatcctgctcattgtcagtgtagcccctcgcccctatattcatccaggatacttggaagtgctaaaataggaagggattcggctttcaactttgctaccatcttccctgaagcaggaaaatgaacatggacttaaatgttctttgaaaaaaccaaagttttaagatttgctgtgtgatgaagtgacagggagggccggagtcagcaggtgccagactttctgttctgtctgccatgggtttgtccagctcaggtagctctaggagcaccatcctgccctagcagagcccaggccttgccctcatgaagcatcattgaaatagcagga

SEQ ID NO: 305 - DNA, 1236 bp, Homo sapiens
ttggtctgcgatgggaccaaatttacaaaacattattttgtaaaacctccccagattattgtaatgtttagtcagggttgaaaaaacactgactcattcctgggaacaggcggtaacaccagaaatggcattgtcagagaccctgtggaagaataagggagactggtgccctggggaatgactgcagggatcccacccaggctggggaggggccctggagaaggtgctctgtttccgattgttttttggaattctcatatggaagacataagtgttaaccaatcactctctctctttacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatgtccagttcagagatgtgtataatgagcatggcttgttaagatcaggaggcccacttggatttatagtatagcccttcctccactcccaccagacttgctcatttttcgagtttttaactagactacactctattgagtttaattttgtcctctaggatttatttctgttgtccaaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatac

SEQ ID NO: 306 - DNA, 1102 bp, Homo sapiens
gggaacccaataacagtggttgggcgggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgaatcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaaga

SEQ ID NO: 307 - DNA, 1152 bp, Homo sapiens
taaatgttaatgatgatgttaataaagcctttcctgacacatttgaggagctcctccgtctccaggggcttcttaccagagttatgcagtgatgggtttagttctgaatggatgaagagttcctgagagctagcgtttgtaattagaaccgttacttggtatctgtgccttatttgacctttggttccacatgccttggatgtgcatgcaccgtgacggtttcataggtacgaacgcacactcaggcccagtcacttcggttggtagtacagattgtgaggaaaaagatggaggcatccttaaggaggaaaaatgtttgcctttagttcctgcattatcctgtacagaggggctcctgagttttggaagcctgttcccagtacaggagaacaactcccctgtttgcagcaggagacttcagtgcacggtgacaacgctggagttcaagaggaagccagcaatgctgcaccattggcttcagacaccattgttgttgtttgccagttttaaacttaactagttgcagacgaagaccaccttgaaatgcaggcttgttgggcttgttttgaattttaacctcggatggaagagccctagtgctgtctgtctccatgcgggatgatgattgctaggcaacaggtgattatcaacaaaggatgccacggttatactctgcaaggtggtgttccagtggcaaacagctgtataaactcttgtaaacaggtaagagggtttttagaggtcaaaatgcattataattaatagggtgagggcttttaatgttttgggtctgtttctctagatggaagccttaaggcactctgctgccattactagcttccttcaccgaagtgtcatatttcaggtcagaacttttgttctacttgatatttttaaatttatttttaacattaaaaaaatacttttaatgtgggagccaaagttttaaaatcttggttatggatttgggacctatagcctttatgtcctttaaaattttgacatttgctgttaaccttggcctttacccttagtcatgatttaatgatgcaggaggacttactgctgtaaaaacgttgcttgtttacgaatactgatttctaaacttcagagttaagacattacagtgtataacagcaacaaaagtatgcc

SEQ ID NO: 308 - DNA, 1152 bp, Homo sapiens
ctgcccctcatcactgtcttgttctatccagcatttcttcatctatgaaaatagaagactggattggatgactgatgacatccactgtggatagctacactgctatcctggcgatgaggccatacagttggtgaaatgtgtgtaacacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaatta

SEQ ID NO: 309 - DNA, 1148 bp, Homo sapiens
caccattatttgtagtaccaaaaaatgaattatagaataccagtatagtggaatccagtgtaacttaaaattgaggtaggtttgtgtgtcataattaataaaagtgatgtgtatatgcctatattttgatgggtatacctatatttttattaaatatttctgggagggaatacaagaaatacaggaagttaatggcctatgggggaggctgaaggagacttatttcatacagcatcacttttaaatatgtttttgccatatgctgttataatttctaggtacatattacctattaaataaaagaatttcacgtaaaatacaaaagaagtgggcattctcactggcagaatcttcagagtagaagtattccttcaagtatacaaacaatatttatcatttcttaattttgccccagaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggtacacaacatttttgtaggttctgatgttgtactggtatctcttaacaagtatctgctgatgttttgttaaggtaggaatagctggcaaggagtctttagcctagaagtagcagtgtaaccccggtttgtttttctggatagtgataagcaggaagatgctgcatacctgtcaggatggcttttctctttccttaaatttgggtaacattaactgatatatttaatttctctataaaatagactgggctgggcacggtggctcacacctgtaatcccaacactttggaagggcgaggcaggaggatcacttgaggccaggagttcaagaccaacctgggcaacatagcgagatcctgtctctacaaaaaatttaaaaagtagctgggtgcggtgacaaacgcctgtagttcagctactcaggaggctgaggtgacaggatctcttgagcccaggaagcataggctgtagtgagctgtgattgcagtattgcactccagcctgggtgagagagcgagaccctgcctcaaaaaataaataaaagactgaacaag

SEQ ID NO: 310 - DNA, 1221 bp, Homo sapiens
ttattgacgataatctccttaaagtcagctgattgtggatgttaaccacatttagataataccttcatggcaacacttccatctgtttgaataactgggtactatagtctagccaagttgacatgtccaactaaccgttacatggttcaatatatatttgtccaataaaaggaagaacaaatggctaaaatggttaatttaagcagaaaaatgtttatttggaggatgttgaataacagaatttaagtaaaaagtgagcacttaggcctcaagaagtcccaagaagaaccagagcagtttgcaggggtagggacctaggtaatagtaaggaacaatgccttcagtgtaccacagtcataaaaaatcagctctagccattttgcttcctcacatcactctaagattcagcttcccgggaaactcagcctgattggtgtaggctgagtttaggtcacatgtctcccttgcccagtgaaaggtgggtacaccttgattgacattctcaccacaactgcattcaggaagacaaggattgtttcccaataaagtgtcacaaggctgttaccaaaagaaggaggaatactagacatgcacaaataaaagatatccacttcgccaactcttgatatctcacatagatggtcagctggtaaaactaacatggatcagagccagattatgtagaatgttacaaggcctgataatgagcttgggccttattctctagaataatgaaactttttttggggaagggggagggtcatagatctctttgaaattttgaaattttggggccacatattgggccctcttctctcctagaagattatgcttatgctttaaaaaagatttgtttttgttttgttttgtataacatttcaagagtttgttttacctcttgaagtatatccatagttggtgggaaaaggagctagtctcaacctgaaaaacaatcagaatattatatctctctcagcttctgatatttgcactgctgattctccttaatctctttgatttctcttggaggaatttggttaagagatgatgagggtcttattaacacagtgtggaaatagggataaaaataatttgcaatttaaagaattatttaggaaacaatatgcagaactagctcgactgttgattatatatggggagtacagtcaagtatgacttataggtttttagcttgtaggaattgcaggggaaatatatagg

SEQ ID NO: 311 - DNA, 1203 bp, Homo sapiens
ttattgcaatatctgttaaaatagttatgaaaaacttcagtgaccttggagggagatgaagtaatatcggcgggggtgggggttggtagtaataaaaaacaagactcagaattgcaacaccttaacctctaatgtcaagcagtaaacctagtcttgagaacagttcattctggacaaatacttactgagttgctcttaaatgtttgattaataagtatctactataaaaataaataaggcaaaaccctttttgaaaccacattcccctttcccttgtagtagtgaccacctgatttttctattcctccttaaagcaaactcctcaaaaaaattgtccataatgccatctcccaatttcttgcctcccaatctttcctgaacccagttgtgcttttgtcctgggttattacactgaaattggtttatccagtctccagtgacctccagtggtcaagttctcagtcgcatcttaatttacatgtcagcatttgataattgatcaattcttcctctttgaaatattttcttctctttatcccaagaaactatatacatggttcccccccgccactgcctcactcactagttgctctttcctgacctgctttgatggcttctctgctctgattgttttttttttgttttagttaatatggagaattgtgttgtatttttttatattgtggtaaaatacacataacataccattgtaattatttttaagtatacaattcagtaaaattaagtacattcacattgttgtgcagacttcaccaccatctgtttacagaactcttttcattttgtgtaactgaaacttgattccattaaacagtaattccccatcccccttctccgcccccaacaaccaccattctattttctgtctctgaattttttactacaataggtacttcatataagtggattagggatacctatatgtcaaaattgcaaacttctgtgcatcaaagaacacatcaaggttgagcgtccaaaatccatatccataatccaaaatccaaaatccataacttttgagtgctgacatgacaccagaagtggaacattttatatctttccccatgtgggttgcagtcaaaatagtagtcaaaactttgtttcatgcacaaagttgttaaacatattgtataaaattactttcaggctgtgtatgaagtgtttatgaaacagtttagactt

SEQ ID NO: 312 - DNA, 1531 bp, Homo sapiens
gtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatctttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaggtgacccattgagctgtgtatgcatttttgtttatttcaataaaatatatttgtattatttgtccttcatactatccatccataccacactatcttctgtatcaggtagtctaatagaaatatacctgttttgttctaaaattgtctgagtctctcctttttgattcatcgcttcagccttggttctcaaggtaagatattcagctgtatttgatcttatgttgagaatgtttaggg

SEQ ID NO: 313 - DNA, 2859 bp, Homo sapiens
catcattttgggactctttaaagattggattgacatctttctgaatggatccttaagctttgcttgggggaaaaaaaaactgtttactcttagaaacaactgtttgtgttgttttacatatttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagatggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttttgtttttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatacagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagtttggactctgtaattttctttggacccaagtctgtaacctctgcgtacttcttctctcttaccttctataaaaatgaggattactgttggtgagggaataaggaatgtaagtaaaggaaatctgaaaaaataaaagtaaagcaagtataaataactttttcctcatctttattgttgaagtcatatccacatagcactttccgtttaatctctgttcaatagttgaatcttgttagtggagtgagggttttgtgatgcagattaaccaccacttatcacaagggttctgaagttgctgtattcagaagcaaaagttagtaccacatgctgggcacagtggctcaggcctgtaatcccaacactttgggaggctgaggtgggcagatcacttgagatcaggagttcaagaccagcccgaccaacatggtgaaacctcagctctactaaaaatataaaaattagccgggtgtggtagtggacgcctgtagtcccagctactcgggaggctgaggcaggagaatcgcttgaacccaggaggtggaggtttcagtgagctgagatcgcgc

SEQ ID NO: 314 - DNA, 1280 bp, Homo sapiens
catgtcctctaataatgaggatttatatcctattccttccattatttatacctcttattatttatttatttatttatttatttatttatttatttatttatttattgtcttcacaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtatagtatatctccctactaatgtgggtctattacaaaacaagcatgtaagatgggaatgctgacagaaagcaaacattagtgagctatttgggtaagaataaatctttctcatttatgtacccttgatgctgggacaatgcttggcacagcataattgctcaaatatagaatctaattaaatggaaccatcaaggcaaaagggggatcaaatattgttacaaatgtcagtgttttttctttttttttgagatggagtcttgctctgttgcccaggctggagtgcagtggcaccat

SEQ ID NO: 315 - DNA, 1180 bp, Homo sapiens
tctgcctcagcttcccgagtagctgggactacaggcacctgccacctagtagaggtagggtttcaccatgtttgccaggctggtctcaaactcccaacctcaggtgatccacccatctcggcctctgaaagtgttgggattacaggtgtgagccactgtgcctggcaagaaggaacatttatgggtgcttgggtgtagtagttaagagtggttccacagaggccgggcgcagtggctcacacctgtaatcccagcactttgggaggccaaggtaggcggatcgcctgaggttgggagttcgagaccagcctggacaacatggtgaaacatggcgaaaccccctctccactacaaatacaaaaacttagctgggcgtggtggcaggcgcctgtaatcccaactactcgggaggctgaggcaggagaatcacttgaacccaggaggtggaggttgcagtgagccgagattgtgctatatagcacttcagccggggcgaaaagagtgaaactccgtctcaaaataaataaataaacaaatatggaaagggggatggctagaatgaactctgcagtgctggatcagaattggaaatatcaatgggagcacatagttttataaatttgtgtgtgtgtgtgtgtgtgtgtgcgcgcgcgcatatgtgtgcatttgtgtattagtgtgatagtctgtcctctgaaagggcctacaagccatgatactccagtacaaattagtacacctagaacccagattgttctaaatacaattctccctaaaggaaccagggctttttttttttttttttttttttttttgagacaagagttttgctcttgtaacccaggctggagtgcaatgccacaatcttggctccttgcaacctccgcttccagagttcaagcaattctcctgcctcagcctcccaagtagctgggattacaggcgcctgcaaccacgccaggctaatttttgtatttttagtagagactggtttcaccatgttggccaggctggtctcaaactcctgatctcaggtgatccacccgcctcagcctcccaaagtgctgggattacaggcatcagccaccgtgcctggccttttttttttttttaagacggagtctcgctctgttgccaagctggagtgcagcagcgcgatcttggccactgcaacctccgc

SEQ ID NO: 316 - DNA, 1246 bp, Homo sapiens
ttaagccgtcaaattttgggtgatttgttacacatccttaagaacccagccaggcgcagtggctcacgcctgtaatcccagcgctctgggaggcagaggcgggcggatcacgaggtcaggagatagagaccatcctggctaacacagtgaaaccccatctctactaaaaatacaaaaaattagccgggtgtggtggtgggcgcctgtagtcccagctactcgggaggctgaggcaggagaatggcatagacccgggaggcaggcctgcagtgagccaagattgtgccactgcactccagcctgggtgacagagcgagactccatctcaaaaaaaaaaaaaaaaagaacccagaacacatagtataaggtcatgtatgaagtaatgggataaaagcatgacaatgagaaactgcttaaaggggatcctcttcatgtgggacagaagatcagagaactcctaagacaaggggcgggctcacatcattccttggggacatctaagagtcaggactgaatgaaagatcattggtgaggtcatttaaaaataaatgtggccctttcccccggctggcagcgcagaggccgcaggatgcctggagttactgtaaaagatgtggaccagcaggagttcgtcagagctctggcagcctttctcaaaaagtctgggcagctgaaaatccccaaatgggtggccaagcataaagagcttgctccctgttatgagaactggttctacacacgagctgcttccacagcgcggcacctgtacctctggggttggctccatgaccaagatcgatgggggacatcaaagatggcatcatgcccagccacttcagtcgaggctccaagagtgtggcccgccaggttctccaagccctggaggggctgaaaatggtggaaaagggccaagatgggggccacaaactaatacctcagggacagagagatgtggacagaatcaccggagaggtggcagctgacaacaagaagcattagaacaaaccatgctaggttaataaattgcctcgttcgtaaaaataaataaaataaaataaaaataaataaataaatgtggagggcagaatttatccattattatctcttgtgaagcagacaaaagccacagtattcaaaatatatttataagaatctagaacctgtgtaacttccctaggtttgttgtttttgttgccctggtctaattatccagggtgaaaagctcttgaatgtttgtctggggtaa

SEQ ID NO: 317 - DNA, 1216 bp, Homo sapiens
aagagtcttgagaaagcgaggatcaaatagaatctttaactttttccaggaggcaataggcccaggattttttttccccactcttagctaccgggagaggtaactagaggctgaaaagcgtggctctcaacatttcttattgtttgaaggcctagaattcacatcagtagtattccatcatagatgttctcaactctgaaacactgtgacttcgtatagggaactgcagaccaaattgtttatagatctgcataagatagtttttccttcttctctggatgttaattaaagaggaatcttatatagaagacatttgctgctgggcgcggtggctcacgcctgtaatcccagcactttgggaggccgaggtgggcagatcgcctgaggtcgggagttcgagaccagcctgaccaacatggagaaaccccgtctgtactaaaaatacaaaaattagccgggcctggtggtgcatgcctgtaatcccagctacttgggaggctgaggcaggagaatcacttgaacctgggaggcagaggtcggagtgtgccgagatcacaccattgcactctagtctgggcaacaagagcaaaactccatttaaaaaaaaaaaaaaaaagacatttgctgtcttcaatttaaaaaaaaaaaaaacttaactcactggcattcagttaggtgatacattaaaaacttttaatttctagacaccgttccccctactactcaaaagaattttggatttcctttccctgccaccagtaggcatcagagaaaaggaactttttttttttaattttaaactaagtaattcaattagaaaggcaaatgatcctggtaattattagatggtatattctagtaattattagaaaaggtgcttctgggtgattgcagttttgaatttttcatttcactcccattagtcatttcataaacacatattgagtgtttgcattacccaaagctttatgcatgctactgaatgagttgggagagtgactcaaaacaaataagatattatcctccctcaaaatgaccagacacatgcacaagttcaaagggatgaatagagaagatttcacagaataggtggcattgacaggtgcataggatttcaatagggagaaattaaggagagaaaacattccaggctgaataaatgagcaatggcgtaaaactaaggaagtataagtcatgtacagggaacttcaaatgg

SEQ ID NO: 318 - DNA, 1304 bp, Homo sapiens
actccagctagtaattttgctaggtagctgcagttagccctgcaaggaaagaagaggtcagttagcacaaaccctttaccatgactggaaaactcagtatcacgtatttaaacatttttttttcttttagccatgtagaaactctaaattaagccaatattctcatttgagaatgaggatgtctcagctgagaaacgttttaaattctctttattcataatgttctttgaagggtttaaaacaagatgttgataaatctaagctgatgagtttgctcaaaacaggaagttgaaattgttgagacaggaatggaaaatataattaattgatacctatgaggatttggaggcttggcattttaatttgcagataataccctggtaattctcatgaaaaatagacttggataacttttgataaaagactaattccaaaatggccactttgttcctgtctttaatatctaaatacttactgaggtcctccatcttctatattatgaattttcatttattaagcaaatgtcatattaccttgaaattcagaagagaagaaacatatactgtgtccagagtataatgaacctgcagagttgtgcttcttactgctaattctgggagctttcacagtactgtcatcatttgtaaatggaaattctgcttttctgtttctgctccttctggagcagtgctactctgtaattttcctgaggcttatcacctcagtcatttcttttttaaatgtctgtgactggcagtgattctttttcttaaaaatctattaaatttgatgtcaaattagggagaaagatagttactcatcttgggctcttgtgccaatagcccttgtatgtatgtacttagagttttccaagtatgttctaagcacagaagtttctaaatggggccaaaattcagacttgagtatgttctttgaataccttaagaagttacaattagccgggcatggtggcccgtgcctgtagtcccagctacttgagaggctgaggcaggagaatcacttcaacccaggaggtggaggttacagtgagcagagatcgtgccactgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattcc

SEQ ID NO: 319 - DNA, 1727 bp, Homo sapiens
tgggtcaggagtgcttactgtggattttctcctctaggaaagaattagtactgcataagatgattaaaaataatgcttttgtagtttcatttcggaatagtgaatgtactatgattgttgtgcgctcaaatcattaactgcagggttttttttttctcccccccacaggggtttggtgcagaaagaaagatccgtcaagctggtgtcattgactaaccacatccacaaagcacaccattaatccactatgatcaagttggggggaatctggtgaagggttctgaatatctccctcttcatccctcccgaaatctggaatacttattctattgagctattacaccagttttaacaccttcctcgtgttatgtttaaaaaaataaataaatttaagaaaaccattttaaataatgcacagttgcagcctggaaaaacttaaggtggcgccttatagtatcaattttaggagctttatttggtgcatttaacgcaactggtaattgcagaatccactttgcctgtgtaagtgaaaaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggcctgccgcatgactcgtggttcggaggcccacgtggccggggcggggactcaggcgcctggggcgccgactgattacgtagcgggcggggccggaagtgccgctccttggtgggggctgttcatggcggttccggggtctccaacatttttcccggctgtggtcctaaatctgtccaaagcagaggcagtggagcttgag

SEQ ID NO: 320 - DNA, 1727 bp, Homo sapiens; identical to SEQ ID NO: 319

SEQ ID NO: 321 - DNA, 1178 bp, Homo sapiens
gaatatcttgtatttgaaagcagcttattaaaagtgtctgtcaagctctttgttaatcaaagccttgttaatctagctgtttaaacgttagataaaacatgcttaataaaatcgttattggtaagaaagttaaaacagttactactgaaacattatcaaagtaaaagcacaccaaagattttacgttgttgttcattttttctcatacttaatatgtttggtttttggatagccctctagagaaattcagaatctataaggaatacagactgaaagataaaagtttgatcctttgtgaaaagtgggatgagacataaatgttttggtgaaaatcaatttcattgaagtaataacaaaggatatttggaatgaaaagcatgcgctgggggagttataggtcttgttttctgagttaaggagattggtgtggaagtgatatggtgttaatgagcatccttaattttcacaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacaggtaaggcgtgactttcaggaactttacagctaacttaccatccattctttggtgttggaataaaaaacatttagtattgattgattatacttgttgaggttcagatttcatattggtagaattatggcaagatataaactgaagttaatcactgatcttactatatacagagcctgtggccaaaagaaatagaaaggcctgtgccaccttattttttgtgttggtaccatagagttggccatttggtgtataatgtagtgtaagagtaaggggtctgactgggtgtggtggctcatgcctataatcccagcactttgggggctgaggcaggtggatcccttgagcccaggagttcgaggccagcctgagcaacacggtgaaactccatctccacaaaaattaccaaaattagcctgacatggtggtgcatacctgtagtctcaccaactcaggaggctgatgtgggaggaccacttgatcctgggaggcagaggttgcagtaagctgagatcgcaccactgtactccagccta

SEQ ID NO: 322 - DNA, 1229 bp, Homo sapiens
acagctgtaaaaatgtcttattccagcattttctaaaagattattcatatgaataaaaggtagtcttgccttaagcctagctcagtctgctgtaatttttaattggtctttcaatcttaagaatctaatttttgctattgaggagaaaaaagcttactgaaaatgtttaatacacctgcgctcctcatagccaatcagaaattaaactgggcatgttacttccaaggaagtggaaattctataagggcaagaagctttagtatttcctaaagaagctgctgaagtatcctcttttagtagcacacagcaccttgcacagtatttaatatataatgtcaatcaatatacttaacaatgcaggataatttggtgtatgatctagcacagttcaagtacttgacataaagtagatgattaaaaattatgacatactagtatttcaacaattttttttaataccagacttcaaggagaaacaacatttcagtcatcgtacgtgtaagaatgattaactcttaaaaaatctaagggctggtctgaaggtagtgggttatctcgattgttcagtcagttacagatcgaacttccttgttctcctctttccccccttctcactactgcacttgactaaaaaaataaaagtctaagaaagttcaggtgtgtcgtattgaatcacaccgttaagtaatgacagtgtacagcaactacataaattatactgattttatggtttcaacatttctatgaagataatgcccatgtccctactctagccctgacttccttcctaaactccagtcctcattacaaactacgatatattcaaaaccaattcattttcctcttctaccaatcacattccttccataactgctatataataatttattgaacacttacaacattaccaggtattatgtattatcaaattaatcttgtacaaaatcatctccatagtttctcttttccctcattttacaaattggggaaatctgaggaattaagtaaaccttaccaaggttacaaaacccagcgcaaaataatccagaggatttgagtttggttaagaacaatgtcagtgaactcaggtctgactccaatgtcatcaacttttccacaaccaaactcaaaagcttactgttcaccttttgctcttaactcaccaacttcaacatcaacagctgacaatatactatacatcaaatatattaaatagagataggagaatc

SEQ ID NO: 323 - DNA, 1258 bp, Homo sapiens
aaaaaagagaaaagattgcatatattttattcttcagatgtaaattttaactctttcctgggcctaaactcatgcaatttttgaggtagagactggagaagtgcctttgtctactttggaattatggtctgtaaattagtgaagtttctggagattatattgtcattagacttgggcttttatgaaatacattgtgttcacgtgtttacgttcacatgtggtaattttttctagtgcatatttgccaggaagtagcaattggagagtcttagaaaattgctcaggttaagttactttgttgaaagcaatgagtttgtacttaagtgagaacagttcaaatgtggatacagtatttgtgtcacatcagagaaaattcctgatgaatttaacttgatggtggttgtaaagttgaatgttgccttcttgacaagtttcacagccagtgaaaatattatttgggtttcagggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgtgagttgtttctgagaaaagttgggaggtgtttcttgatgctttctttttcaattgaaagttaattttgttttatcatttttaggatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggtaggttttgcataatccaaatgatttttgtagctgtttatttctcttctgctttaacagcacatagtaatagagtacatataatcagcggaagtttgtctctttcagaatttctgtcatattaacagtgaactaaacaaagtaaggtttcttaaccttgggattattgacattttgggatgaatgattctttactgtgggggatgggatgtttagcagcatttctggcctctacccactggaagttagtattctgaccccttttccctgcctcccattgtgacagccaaaaatgtgtccagacattgccaaatgtcccctgggaggcaaactcattccaagtagagaactagttatataaaatgatagtactgtcttccaggcaatttaaaactttcaaa

SEQ ID NO: 324 - DNA, 1160 bp, Homo sapiens
tcttggcaatttttgagtgtgagatgtttgtgatatatctgggtagagatatcaaatctacagttgcgtgtataggtctgagacttagacctattaagtctaaggtctatttcctgcctataggggaagtatatagagctgtagaattcatcagcatacacagttaaggaaaatgtagttaagaaagcccagggagaatattatttttatcttggcataggagagatgagagatgcaagaggagaaggaaattaaaatagaaagttggagaaagtgctagtaatgtaccttccagtagcatgtggagggaaaagtcctaagagcatgtctgggattatctgccttgaaccttatctctttcttggcaagccttgaaggaatcagattgtgttgtaggtgtggttattattagttacagtctgaaggcctcaatttatatagttgttaatctcagaacagccttacctggtaagtttcttcatctgtaaaatgacgtataagttctcacaaagttacttgtcgatgttcatactgcttttaaatagcaggcatttaaattcccatctgactctaaagcgttttcactgcagtaagttacaaaaacaggtagaatttttctggtgtctttgttagtctgtaacatttttttaaataaaaagcacattttgggttatttgtctgtgaaaaattaagggaagtaattgcttggtgtataggtcttttcttaaaacatttagactaacagtaccattatgtcttatacagtctatgttatcttaaaaacaaaattgaatttacatcgctgctacacaaatatgaaggcataaaagcaacatgtggtgtctctaacttgtttccattctccaatggaggtggatatcattacttttaaaagcatagcaagttctcttaaagtcacttcatttactcaacttttatggctgtttactcagaaataattaatgagatagctactaaatttagcactcactgaaaatagagaccatctcctatttatctctgtatcaccagtaccttactttgccgcagattatacctacacaaatgtttgtttaatgaataacctttataagactttagtattccccacctttggtagcattcgctttgtggctttatttcagttattttgttgaaat

SEQ ID NO: 325 - DNA, 1402 bp, Homo sapiens
attccacagaggggcggagtccctcagtcaggcgctggctgcaatcacacccgagcgccagccccctccagcatccctgagtcccagaggagatcgccgaagcgctggaaaagccgttccgcccacgacttctggtgccgggtcggcggcgactgggggagcccagttccgagaccgtaccgcacccactgcggacctcctgggccctacatagtaggcgggtcatgcagggcagcgggaggaggggcgtgggagggccaaggccgccgagtccccgctgttcagccagcaggagcgccccgcagccctcccgggacacggtggacacgcttgtcccagacctgggcgccctcctgccgggagccaggactggccgcagcaggcgctgtccgggcccgtgggcggggtttcgggagggggcggagccaggcccacggccggtgtcaggttgctccggtaacggtgacgtttcgcggcgtgggcggggccagcacgcaggttgcatattttaggaagtgaggaggaggcgcgggctggagctgcggcggggtctggggcgcagagcagcggcgggaggaggcggacacgtggcaacagcggtagcagcccgggcggcggcagcaacagcggcggcggcatcggcccgagccgccggccgccctcccaccctcccgccccgcggcagccctagctccctccacttggctcccctggtcccgctcgctcggccgggagctgctctgtgcttttctctctgattctccagcgacaggacccggcgccgggcactgagcaccgccaccatggggaagggggtgagtgtccggcgcgcccggggagggggctcggggagccctcgaggggaagaggaggaagtcgggagggcgaccgcggccagcgggaggcggcggaggaggaagcggcgccgcgtggagtgggctggcagagccgcgcggcttaaaagacgacgcagtttggaaatggagggagcgcagtaacggggggcgggggaagggagcgccgaggggctggagcgcggcattgcttaggggggtgggcggaccctgggcgggggctgcgcgccccggaggccgagcgggccgggggctccgagaggcggtgcttgggaagcctcggggccgggaggagggggcttgcagcagcgggggcggccccgggactgagccggcatccctgagcctggctcccctccctgcgaccgccgtcacctccttctccttccttttccctccgccctccgtgccctgaggaaaggcgcgctcctccccttcccctggggcgctccgccggggcctcctcccgggcctccgttcccgccgcggccccggttccggcgggggcagcctccgggttcggggctccttctcctggggacgctggg

SEQ ID NO: 326 - DNA, 1202 bp, Homo sapiens
gcatttagatgtattgtatcatttaatccttaaaaacatgaaatgaggttggcactattctttatctccacgctgtggaagaggaaattgaaatgtagaagttagtaacttgcctaaggatacactgctggtaagtggtaaagcccaggattttaactcaaggctgtctgattgagaatgcggactcataagcacaatattgcactctaagttaataatgtaaagttagtttcattctttcagtagggaagatggaaggctgcagaatagggattttgatagcaaaaatctcctcattaaccccaaaaggaagtggcactggcagggccattctgaagcctaccggtagcttcagtattgttcttaatgctcttggatggagagaatgtatcttgagccaatgtattaatagtagattgctttgcttatgtagtaggcaatatatgggtatacattttcctgactattatcttaatgactattccaaattatgactaccttaaaaactaccaaaatcccctgctccagaattttcagtttcagatgaggttcataattcatggcctcacttttcccacattctcctacaggttggacgtgataagtatgagcctgcagctgtttcagaacaaggtgataaaaagggcaaaaagggcaaaaaagacagggacatggatgaactgaagaaagaagtttctatggtaagtactaggaggaatattgtattccatccttattaaaaatccatgatttttaatcccccaggcctcactgtattcttcaaagaactgctatatattaaaagagatcatagcagctgtacagatctcatctagtcgtagaggttaatgttgaacatatactttttaaaagctgttagagggtaggaaaagttattcagtcactctggcataaccagagataacagaaggaacttaggttgataccatgagtctttgcttttctctgtattatatcaaacattgggaaattcagcctctccaggcgatggaagcttccatagacttaacctgtctagaatcgacctggtcatcagagaaggcagataaggttttactagatccctgagagctgctgggtttctctgaagtgttatggcaaatagtaatgggccacggtcactcagctttagccattctccagtgaagagctgtcaatgataactgtgtggttgcaaagcc

SEQ ID NO: 327 - DNA, 1205 bp, Homo sapiens
gctggccactgtcacggtaagaggcaggtgatggtcaccctgactcagatcagcttgcacgaatgttacactcttccgctatcctattctaaggtattgccaacttatgttttattctggatgtttgatatagttcttcttgagagccacatcacgtggtgaattttgacagtgagaaaacctcagcatttgtttatacgtaagataaccccaaagcatacattttgcttttaaattatcacgtggtcctgaacagtgcagtggagaaaggagaagaacttgggatcaagtagggggatagaatatggtagaatcctgttattatttttcttaatagattgcttttctggaaggaaggggaagcctcatgtatgggttccccttattatttcttcaaacttcagaagaaggttggagagatttaattttagacaaatttcttccacattaggatatagcaagaatctgtatagaattccagcctggttgagtgaagtaataatcttcctaatattttttaggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtaaggccagggttaccacacacctcagccacctgctgacttcgcttggttttttttcttttaagaaattgcatgaaatttcttttttttttttaagctcatggcagctttttctttcttttttgttttttttttttttatcatttagtgaagagtcaagggtatgggatattgattttttgcatgtcagtagaaactttaaattgccctacaaacgtgactgaagaatgcctaaaatgtgattggtttcattaattgggaaatgagatgtatcactgcagatttctatgggactttaataggagaactgagaacacagcctttgaagttaatgcattgttgttctgttgtgttttcttgcctccatcaggtgtctcttttgacaagacttcagctacctggcttgctctgtccagaattgcaggtctttgtaacagggcagtgtttcaggctaaccaggaaaacctacctattcttaaggtatg

SEQ ID NO: 328 - DNA, 1215 bp, Homo sapiens
gtgccttcccctactctcttctcatcttcgtatatgacgaagtcagaaaactcatcatcaggcgacgccctggcggtaattatgggcattctgactttggttggaggaggagtgggaggggctatagttctattggttttttgtttccctcaaggtgtctaggctccctcagtggtcagtctgattagctaaggtgactggaccagcaaactgaccatagtcacatcttcagaatgtagatctcagttacagtttgaggactggtcatgttttagactttaaaatacaaaccaagtatgatttagtgaaaacttgtcagaatctaaaccatctttccaggtaacttggtattcctaaaaacatgtaaataagtacagttgaggtcccatgtttggattttaacacacccgacccccatcatcctccggttggttttcatccctgtttccctctgtaatgctggagcgaggaagactcactgtagtgtgtcttgtctgtctctttgccacccacaggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaatttgtctgtgccctcgtcgcttctttggtacagatgtctatgtgatctggagctgtggttttcaacatgagtccctgaccagcagtttatcagcatcacctggttgcttgctaggaaggcgggcccagacccactgagtcagaaatgcatcagcaatgtggcttaataagccctcaggtgattttgatttacattcaagtttggaaaccactggctaagaggaagcattctgcccgtgctcttttagttggagtaggtgagtttacctgacccattttttctggctgctgcctggggtgatagggctgtaactccacctgctgccttagcatctggctttt

SEQ ID NO: 329 - DNA, 1198 bp, Homo sapiens
ggcacctcaccgaaacacttaaggcctctgtatggtagaggttggaatccgtggcctttaaaagtcctttcagctccttcgctcctatctgcataatttttggcataggccaagcggctggttggtggggtgtttagctcaggacgagaggccgaacgagcggggagttggctgaggatagactagacacgcgtgggtgactccagcgtgatggaacgcggggtgtcccgggatagggctaaagcgatgggatttccagacgagtctttcccaggccaacttttaaaggtcggaggaaagtttctcgtggggtgggggcccagaggggatggcagggtgggctccgacgcctcctcgcctttaagcgggtggccccggctcttcctccgttacctggagcggggaggggcttgggaaagtttgtgtttgttgctggcaaagcgccggatgggaggcgcgggcgggcgctgcggttcttcccttctgctttcgggaagcggtcggggctgcacactcggatcggcggggccggctcccgggcccggccggctggaggagggagggaaggaggcgggagggagcgagcggagccaggggcgcacgtacgccccagcgctgggatttatcggctcgcgaggagagcggagcaggcgcgcggcccaggcggaggagcgccgactctggagcagccggagctggaagaggaggaggaggagaggcggcggggaaggaggaggagggggagagtcgctcccgccgggcgagcatggggcgcctggcctcgaggccgctgctgctggcgctcctgtcgttgggtgagtgtgcgcggggctcagcggggcacacggggactggcgaggccctggagggctcggcggggcgcggctgcagcgcgcggcctggggcgccgagggtgcccgggctgctcccgggaaacccggccggggtgcgcgggttgttcggcccggcggggagcggccgcggggccgcccggagcctggcgcgaatccgctcgggccccgcgcgcggggtgcaagtggccgctccgccaggccgagcctcgcccccaacatgtgccggggggagtggcccggggccgtctttcccccaggtctccctacctgttggccgccgggagcccggctcaccttgaactcccggcccggaaggtgctgcggtcccggcccgggtcctcggc

SEQ ID NO: 330 - DNA, 1199 bp, Homo sapiens
gtgttgctaacagaaaatctcataatgagtaccagtttctggttttccagttatgccaatcaaggattgctgctggggattgtcattggtccaattctccagacagcccagatgggtacaaataggtcaacctgttatcatcttccaggagaacgggtttagttcttacttgggactcctctgtacacgtgagtgaggaaagcatactaggaatcatgcttttttttttttttcagagatagagaaatgttatccaagattttaaagaggtaagatgagaaactaatttggagttacaatgggaatcaataaagaaggaaacaaattaagtctccttaatcgaatcacagaatattcaagttgaaaaaggcagctagtcaagatcattagctggcccttcaatttccaagtagcaatctgaagcctagaggactgaggttaaataacttgcccaaggacatctagctacctagagaccagacctgagttttggtttcacctctgttacttaagagttgtcaactgatgatagtgctaagagctattattaacagtctgaccctagtttctcactagaaactaggcaagaaggtatctggcaccagcttgtcttaggccagtatagcttaggacagggatcgacagattttttttctttgaggcttttcaggccacatagttctctgtcacatgatgtgtgtgttttgttttgctttgctttcttttcttaaatccctttaaaactgtaacaataatttttagctacaaaaacaagctgtgggctggatttggcccatggcccatagtttgccatttctgatctagtatgtcagttcctttgagctttagctgtcttctaacaggaatccatcacttgaagatcaagcttgtgaccgaatttaccgagtagggcagcagaaagatgttgtcatacacaggtaagtaatggtccccaggacccaggacccttctcaacttgtactttgtgaaagtctttctttcttaggtagtgttttcatagaatttaaagtatttggtgatgactttactgatgatgcccctgaggcataccttcaggcaaaccacagtcaggagaaaaacgagcaatttggggtaagcttgaagttggtcactgcaaaagaagagcaaatttgtgtatatggtgagggcagtccatgaaaggatgctcctatctttta

SEQ ID NO: 331 - DNA, 1148 bp, Homo sapiens
ccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacagtcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacaggtttgtttatttcagaagttctggtactaacatttggcagagcaaggtacggtgattggatcgaatctgtcttttttttttcttgcagtaaaatgtaatttttcgagtcataaatattgtattgttacttcaagactggctgaataaaaccatagactggagggactctacctccagtctatggtagagtccatagactggtaggactggagtcctacctaagtcgttcttctcttcggttttatataagaaaaacatttgcgttcagagttgtgtctaatgtggacatctggg

SEQ ID NO: 332 - DNA, 1406 bp, Homo sapiens
atgcccacatctgttgggaatgttacattatagtatctatgcacttttgaaaacttaaaggttttagaagcatatgctgtactatataaatgaaaaacttcctgttctcttatcttttcctcttatttttttctttggccttatgtttatatttttgtctcttctctgttacttattctatttttgttttctctcctccatttagttttcactggtgtctgttttttgcaagtgtctatggataagttactgttatctttgctcttagtctggaaattgtataaagagattataaacagagtttgatcttaggcatccagggttccttttctttctcattccagatctgaatgtgtctcactgataattctttccttttaatggcaaaagtagaaaacaagttcctgggtttaatggagaaacctttatgttttatatttaaaggttgacattcttaagtaggctcactgttacgttttatttccttcttttctcacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagaggtaataagctgagttttgtgatatggagtgtttatggatttgtatttggatacaaacaaatatatataatctatggtatcctgttttgatctgtttattcttgggtcatagttgtagtatagtttccaggttggtaataaggactagaactctttcttgtttttttttttaatgttaattataatgtaattattggacacttaaaatatttttgatacaacttttggatggttagtgccactcattctttgttcagagatcttttgaaattcagcgttttattaataatatatctgtatataacttattgtctaagcagtttcttaaatgttcagttacaaagggactctgctagatactatgcagatcacctcataaacatgcttctaaagagctagcattatatctccaattttttaaggaacatgtcatggtatccctcaactatactgtagattaagaacacattccttccaaaaagtctccatggattgaaaaatgggaaagaattgatttcaaaattctttaaatttatttagcctcagaagtctttcaatttgttattctgtagttacttaaaagtaaagagaataccagatgggaaaaatctagtgaatatttgggttaaactttgttaattagaactcctaa

SEQ ID NO: 333 - DNA, 1230 bp, Homo sapiens
ctctgctaggggagggccgaagggaaatgtggggttggagccccaacacagagtacctgctggggcaccacctagtggagctgtgagaagagggcaactgtcctccagaccccaaaatggtagatccaccaacagcttgcatcatgcacctggaaaagctgtactcaatgccagccagttcaggcacccaggaggttgggctataccctgcaaagccataggggcagagctgcccaaggctgtgggagtcctcctcttgcatcagtgtgacctggatgtgagacatggagtcaaaggagatcattttggagatttaagacttgactgacccaatggatttcagacttgcatggggcctgtagccctttgttttggccaatttatcccatttggaatggctgtatttacctaatgcctgtacacccattgtatctataaagtaactaacttgattttgactttacaggcatgtaggcggaggggacttgccttgtttcagatgagactttggaccatggacttttgagttaatgctgaaataagactttgggggactgttgggaaggcatgattggttttgaaatgtgaggacatgagatttgggaggggccaggggccgaatgatgtggtttggctgtgtccccacccaaatctcatcttcaattcccatgtgttgtgggagggactcagcgggaggtaattgaatcatgctattcttgtgatagtgaataagtctcacgagatctgatggttttaaaaaggggagttttgttacacaagctcttttctcttgtctgccaccatgtgagatgtgcctttcaccttccaccatgattgtgaggcctccccagccacgtggaactgtaaggccattaaacttctttcttttgtgaattgcccagtctcaggtatgtctttatcagcagtgtgaaaatggactaatgcagcatgatggtgcatgcctgtagccccagctacttgggaagctaaggtaggaggactgtgtgagtccaggaggcggagcttgcagcgagctgaaattgtgccactgcactccagcctgggggacagagccagaccctgtctcaaaaaacaaaacaaaacaaaaaaacagaaaaaaacccagccaggcacagtggctcacacctgtaatcccagcactttgggaggccgaggaaggtggatcagctgaggtcaggagttcgagaccagcctagccaatgtgatgaa

SEQ ID NO: 334 - DNA, 1196 bp, Homo sapiens
ccaaaagtgaaatacaaactaacgtatttttttaaacaaacagttccaggaaataaacagctgttgcatacctgacatgttaattaaaatgatcctaaatcaatattttcccatagtatttcctaaaacactcatctatgagaagactccaccaaaaatgagtttcatattaaaataagtttggataatgcttcatattgtcttattttcttagtgagtcacaatgacgttaattaattaaagatgcggaaaagtagtgaaacctatttaaccttggataaatcagtgtttcccaagctcatataaccgtgaaacatgaaaatcttttcctctttttaatctcccattgacatcccaccaagagcgtgttttgtgaataaactgagaatcgctgcctaaattgttgaacaaccattgtcttataatcatgttcttagattcgggaacaggaaaatatccagaaaaacaatttcaatgttatggttaatttgttttaaggtttgctgcttcagatatgaggaaattcagttaagtagaacaccacttcccctaataatatgggataaatgagatatcactgcattttacattttgactataagttgtgtgttttctagtaggatatttcataaaagtagtctagttttctgttgtattacagcttggtcatgtaagtcctagtaaacacttgatagattaactatataggctcttaacaggcatctcaaatgagtaattgtgtactgattgtgtgttgccctataaagaagtggggataaaagttaaatacatctatgtttaaagttgcagctcacctaactgatttattcaagcagtctttggctacgcctccaaaatgcccaccagacacatttggtaaagatttctttgaaaagacatggaggtaagctaatccaataatgtgttctaattagtattaggtatgcagtgattgaggaaatggaatatgcaggtgctataacttttggtgactacatcaatgaattcacagcccttcatctcccatactattaataattcatcatatagtggtgagggtttttggttttgtttttaagctgaaatcattgccccttttcaccatactttcctttcctttcacatagacacacagcatcctcaaaacgctggaaagaaaagatagacaaaacgaggtaattataccccaaaacgca

SEQ ID NO: 335 - DNA, 1215 bp, Homo sapiens
ttggacgctgattcagagcatacacagccttcttgagaactttgccccaaccctgcaaagtattctcacctagttggcattgtaattgtgactgcaaaaggccattccaccgttctgcttcaggatgttggggaacatggtaagaccagtgaattccatgagcatgagcccactgctgcacttctttagccataaagtgaatgccttggttagaggcaatgctgtgtggaataccatgacagtggataaggcattccatgagtccgcggatggtagtcttggcagaaccattgcatgcaggataggcaaacccatatccagagtaagtgtctattccagtaaggacaaacatctgcccttttcacaatggaagaagtccaacataatcaacctgccaccaagtagctggctgatcaccctgaggaatagtgccatatcaaaggtgcagtgttggtttctgctgctggcaaattgggcactctgtagtggcagtagccaggtcagctttccaccggcccatcttgttttctgcactgggaagttggggcatgagcacaaatgttaggacctgaaaggtggtgaactctgcctgggcagggcaaagccagaggaaactctggtggaggtccgtagcagtcctgatgtgcaaatcggtcatccaacctgggtgtaggggcgaaagactaattgaaccatctagtagctggttccctccaaagtttccctcgggatagttggcactctggcaaaaaccccactcttggtaccaatttactgtattagtccattttcacgctgctgataaagatatccccgagaccggaaagaaaagaggtttaattggacttacagttccatatggctggggaggcctccgaattatggtgggaggcaaaaggcacttctttcgtggtggtggcaagagaaaattaggaagaagcaaaagcagaaaccctgagaaacccatcagatctcatgagacttattcactatcatgagaatagcacaggaaagactggcccccatgatacagttaccccactgggtccctcccacaacacatgggaattctgggagatacaattcaagttgagatttgggtggggacactaccaaaccatatcattcatcaaaaggtgttggtggggtagagggtagttaggatgatccattatctccatcatgacgatgatggtattgatgatgtaagtcact

SEQ ID NO: 336 - DNA, 1262 bp, Homo sapiens
cctaaatccccaaggataacaactgtcttgacttttaacagcagagattagctttgcttggtttcatactttatataagtagaattgcacagtatgtactcttttttgtttggtttctttcaatattatgtttgtgagatttattcatactgttgtgtatagttgcagatcataggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctggacaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgctctccagcctgggcaacagaatgagaccctgatagtttgaggatgcagtgagctgtaatcatgccactgcactccagcctgggcaacagagagagaccctgatggtttgaggatgcagtgagctgtaatcatgccactgcactccagcctgggcaacagagggagaccctgactcctaaaaaaaaaaaaattgattcattctcttttggctgggtaaagagcctctctgctttctagtaatgggcaaacaaacattcttcataccacaccccagttttttaacctcttttgtttagagtgtccttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttg

SEQ ID NO: 337 - DNA, 1343 bp, Homo sapiens
ttttattcaaatcaggaaccacttctgttcagtttctctaaagctgagctttcaaactctcctgccagctatttctgggtcatgttaatctttgtttttctgtggttcttgtagattctcatttatctgacagtaaccttatttgtcaaatgaaggtgacaataacatgattatgctgttttggcaattcaataaaaaaacacatgtggtccaccaagcaaaccgcctgaccaccaggcactgctcagcttacattagttggacaccttgccctcctctgggctgccctgatggttgtggtgttcagttatgtctccaactcttccttctaaccaggccttcttctctcactggcttcccatacagcagccaagactcagccccactgatgcagtccctgcccctctttctctagcaccccggaggcctgagctggaaagcaggcactgggccacacttgcctgagcaggaccttttctaccttctttgtgatattttccaattcctccaccatagggttgctttttagtctccagcaagacaatgttaacccaccaagccttctgtctccgttcttctcatacaagtcaatttttttcagtattacctcatcagaatgatgactagaatgttgagtcccccatgaatccattcattccttgattctttgattctagattttaatatgtactatgtatatttatacatattacatttagttacagggcatcatattagataccacacacaaattatacttaagactcggtttataaaaatacacctaataatttttcaaactagaagttacgttctcatggaacacccctcaattacaggaatatctttttgttctgaagaatggaaacattctgaactcagtgactcataggcttttgattttgctttggcttgtggggtatggataattctgtaagaggagagtcctgccaccttaggtctcagtggggacagctaggtgtgcatgtgcttcatgtgcagtgtgttccagggctcctgaaaactgtggttgcctttaccccctagattcagctgtgtcccctccagtccgggatgttggtatgaattccccagctctggtcttccccagctctgcttcctctactcctggctcagaaacgcccataatcaacagagcaaatggtaaatatggcaactaaagggcccagggactgatgatggaaagtgattaatgcaaacaaccttttgttgtctctaaacatattatctgtatttagagagttttctctgcatgccccaaggcctttagccctactccctgcaccttctgtggctgcctttcttgccattgttcatcctcc

SEQ ID NO: 338 - DNA, 1173 bp, Homo sapiens
aggcattggcatggggcaataaaaccaatggctgcccctgagatacttaatattgtcgggaaagatggcacacaaacaggtaattttaacaggatgtggtaactgctgtaacatagggatgcatcaggttatgaggcagcccagacaagtggtatgtaatgacatcccttatcactgccatttttttgtcacagctcatcacaggtgtctgttcctgggcttcagatgggttactgggatcctctttagggaaggagccatgctgaagattcagtgaaatggagaatacagggattctgagagaatcaatgggacagaatgtgaggggagatgagtggtctctttttgaccactgagaaaacatttcctgagagctcctctgtagacttgattggtgctgtgctgtgtgctgtggatacagatatgaagaaaacattatcccagcgctccaggagctccatctggaaagcaagtcactgccaaatggcatgagaagtgctgtgacagacttgagtaaagtccacagggttcagaaggggcggtggtcgtcactgcatgggggtgacctcagactgtcctgatccctgtattggcccctttcacagttggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttagtaagtaactatgacttactagtaaagaaaactagcctatatgtcttataagttctgtatgttctataccgacataacgtggttattgagcacacgaagtgtggctagtgcaacttggacatttggttttatttaattttagttgatgtagtataaagtggccatatgtggctgctaactaccttattggacagtacaggtctagggtcttgggactctaaattagttcagctccattcaacatttattgaacccctgcggataaagcacttgccagcttcaatggggctgctagagatgatagtgtacaatccctgacttacagatatctggtcccaactaaagcctgggttatctgaaggggagataatggca

SEQ ID NO: 339 - DNA, 1154 bp, Homo sapiens
tactggggaagcactctggaatcttctgattaagtcatttgcaaaagattaatagccataagccttactcttaatggatctgccatttcagtttcaatggcttttgaggaaaaaggagtcatttaaggaaggagataggaagtgtaggccgatccatccacttttcttagtctcccaattttaagagaccctttcttgcacaaaattttttgtaactttccataagtaaagaggaaggtaatggagccgtagaaatgtcaacccatcaaagactagtttgtcgtgtcattacaacaaggcatttagggaacatctttccttaattttactaatagaccaaccaaggaagccttctgaatcgctagtaagattcagctctgggtgattcttcatttctaatggctcatagtgattacagtttatgttaataatcactcctacttctgtcaacctccagcaagagtaaattgatagcaggataaattaaaagtctgatcttaatgtcataaatgtgactagaatatggtactaactttttcgggtctagatagctggaatgaggcttgcaaacagtgttatctggagagagcttgctggtctaacaactttgtgtgataatttggcatctgattagagagcatgagtctgataaattttataatccacacagagatcatgctgtggttggacacatcatttaataatatttagcatgatataatattccattttctctacaggagcacagactctttctcatactggattattttacctttgacagtcatttttcaatgacagtaattttaaataaagcatcgtgtgcttatagaacctgtgcttgagtaaaaatagtcttcaaataaaaataatgaagtaaatttttacttaggccatgcttaattggaagcatagaacttaaattgagaaaaaaatccatatgatagattttgtttttctcatgcttcccttttgaataatagcaaataatgcagagtaatggttctaagagttcagggtagatgaagtctgtaggttttagaagtatagagttgaaaagaacctccaagaggacttatttaatgagtgaaataaatgtccttagatagatattgtccctaaactcttttctattgaaagtttatagtattgaa

SEQ ID NO: 340 - DNA, 1388 bp, Homo sapiens
aaaaggcactgagataggaggtctgtgttttttattttagcttaacttgttactactttctagcccatgaattttaatgtctggcttagaagaaaattgctacaatttgggatgctgaacttgtggcctgggtgcccttatagtgccctctcctatgctagatagcagaagctctttggtccttgtataagggatccatattagaaaccacttgcctacttggtccatgtggacaagttcctagtatggctgccatcatagagagatcacagtgcgtgaaaattgagacaatttagtattgaaggaagtatttcatttctcctgctactttttgttgctgattgacttaccactttaatggttactctatgtaggaaaaataacaaggtaatatcccctaagaaattctttaaatcctagatttgaggaaaggctttattcatttgaggctaaaagacatcattgacctaaaaaactgtttttctttgctgaattcagattcttcaagagaaacttaatgaaatgagctatgaactaaagtgtgctcaggagtcgtctcaaaagcaagatggtacaattcagaacctcaaggaaactctgaaaagcagggaacgtgaggtaacatatttaccaatcaaggacctgtgtggaaacaattggtcccttcaaagtagacaagtattttatattttgtcaaaatggatattgtcagactagcatgtcttagcctggagaagttgtagcttaatctcaattgatattttggaatagtcctgttactaaaatgtgtacaggtgatataatggaatttataattagtttactaacatatttgatattccctctctcattttcagactgaggagttgtaccaggtaattgaaggtcaaaatgacacaatggcaaagcttcgagaaatgctgcaccaaagccagcttggacaacttcacgtatgtgagggtcacgtaggacaggagagacttcagttggggatgtgccattttggttgcagtcttgattttatttttagtctttgtgggagctcagtgcttgccctccttgtgattgtgatttctactctcttttcagagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggtaaatcattaactattttattgccctaaatgctgactttgccctgatcataactttttagcaggacagtttgtgttgaacccttg

SEQ ID NO: 341 - DNA, 1121 bp, Homo sapiens
ccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatctatgtagttaattaaagttaaagtttctgcagatcaactactcaaactactaaatacatttacctgagaa

SEQ ID NO: 342 - DNA, 1222 bp, Homo sapiens
ttctagtctgagaattaaaagccattgttcgaagaagggtgcccagggtccagctggtcgccgaaagcttgctccgcaatacaggctaaggaccagcttctttggaagagaacagatgagggaagcaggagagaaaaaaggaagaggcagacgtcacttccccttgccggctccggcagcgggttggtcggctgagcggcagaaaggcagacggggactgggaaaggcactgtcggtgacatcacggatagggcgacttctatgtagatgagccagcgcaggggctgctgcttcgccacatgctgcttcgccacgaaggagttcccgtgccgtgggagcgggttcaggaccgctggtcggacctgagtgtcccagctgtgtgtcagggctaggagggctggggggagggggggtgtgcgcggggcaagtgaccgtgcgtgtaaagggtgaagcgtgtgaggctgccggcggggcggagagtgcaataactcatacttacctggcaggagagataccctggtcacgaaggtggtttttccagagcgagtcttatccattgcactccggatctgctgacccctgcagtttccccaaatgtgggaaacttgactgtataatttgtggcagtggtagactgcattcgcgctttcccctgtatttttgtcgttttaaaaataggttttgtttgctgcagaaacgcatactgggcgtcagcgtaagctgagaatcaggtctttgttcccatctgtaacttcactgaaactaaaaatttgggacatcgtggttctcacgtttgtaatcccagcaatctatgaggtacgtcgataggttatgtttatgttaatatcgctcgacctcaggcgtgtgtgggcaaatatagtgaacccgtctctactaatctcttatctttttttgttgttgttctatagaaataaaactaagcttttcttttccctatgggattaacagcaaacagtccgctggagtgtatggcgcgatctcgccttactgcaacctctgcctcctgcgttcaagctattctccttcctcaaccagagaatactcagcctcccgagtaactggcattacaggctcaggcaaccaaaaaattaggtccggctaattttttgaatttttagtagagacatggtttcaccgggccgggcgcactggctcgcgcctgtaatcccagcactttgggaggcggaagcgggtggatcat

SEQ ID NO: 343 - DNA, 1206 bp, Homo sapiens
caatagttccagttggctcacactgcggctcgcccaccaaggtgctaagcagcccaggcgggaagctttagagcgatatggaggcccacggagctgggaccacggttgttcttttggccttcacttgagcagaggagagaacccttcccttgtgactctggaactcagtgcctcttccaggatggagaattaaaatgctttgcagagaggtctttgcgcctctcatctgagtttccttgggctctttcgcaccctcctctgaagtgggtgaggaggttccctcagtggaaggaatgtgcggaaaacactaaggtttcaggcaggactcgtgattcccgagtcctccgcgagacttcctggctctctgcagcccccatcgctctctaaaccccgaattccttcatggcaaaaagctattatgaaaaggctactgccgtgtccaccagtcctaggtcctgaaacttctttcacacgcaataatatgcaattagatcatacaaccgctccgtcagtggaaaatgattccacataagaagacgccagtaatcagtgcccggctagctcagtcggtagagcatgagactcttaatctcagggtcgtgggttcgagccccacgttgggcgctgtgtttttatttaaccctctcgcttagctaccatggaaacatgaacttctaaatcgccacagcggctactgtccttttatggtaactgattccagaaatcatctccattcaccccaaattcatcaagaaaagaggaatctgggccgggcgcggtggctcacgcctgtaatcccagtactttgggaggccgaggtgggcggatcacctgaggtcaggagttcgagaccagcctcaacacggagaaaccccttctctactaaaaatacaaaattagccgggcgtggaggtgcatgcctgtaatctcagctactcgggaggctgaggcaggagaattgcttgaacctggaagacggaggttgcggtgagccgagatcacgccattgcactcggtctcaaaaaaaagaaaaaaaaaagaaaagaggaatctggggattctagtgtctgtagtgaccacatacttcgaatccacgatgggcttctcaactgggcgaaggcagacaagctgagcagctctgagaagagtccaaaatcgctccgacactgctccagggagaacagccttaggacggctccagaggga

SEQ ID NO: 344 - DNA, 1213 bp, Homo sapiens
aagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggaggtaaaatgaagagggcaaatactgtctgggtgaagggaatacgaacgaaacagaatgaggacttagtattatgtccctctaatggactcctctccctgcttctttttccctagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcaca

SEQ ID NO: 345 - DNA, 1243 bp, Homo sapiens
gagaatgttgcaaaccgttttccccttcccaacctgggactatatgatttcttacccccagggattatgatagaaatatgaagccaccaagtctagacttgatggtgttcaagaataaataatactgattgcctccctagtccttgtccagctaactcagctgtttataattgaagggattcaacaaaattatctctagcatcaggtgctagacatggttagaatctcaccatggtttagtgactggtagatagctattaggtaggtagataaataaatgatgctagaggcaacaggtctagggttaaggattaaggcctgggaattggagtctcaccatggctccccttccttgtctggggcctggacacactgaggacaatgcggctatagcagatggccatggcagtcagtggcagcagaaagaggcagcagaaggtgaagaggttataggtggtctcttgccattgagccttgaagctgcctttggtgacacactgagtgaaagggactgggccagctcagtggaccgtgtggaacaggaacagctggagtggagttgaggactattagaactggttcccctcaccacccaacctacccacctatgtcatactgtctcctcccaattcatccttaattccaagtgaagcagcacagtgctgagaaacagttcatccatggtgccatgttaaagaagttggaaatatatcttgaaaatcctatcttccttttaggcttgaatatgatgctgaacagtaagtttgttaaatcttggaacttaaaacaatcctgctttctcaagtactattctaacattgcgctttataagggatgatatttctaccacctcactcatatttttagctgaaatgattttcctggtatgtctgttattttgtggaaaaagaaatattgtgtaaaatgggtgctgccaaaattccaggccattttgcagggactctgaagtgacctttagtagtaatagtcttatgtgcagtaactataatggtaaagaatgttaaataataaaatttaacattttccaaatgctattgggctgcccctccccctttttgttaaattgctgggttttccaactgaatcagtaaaaactatttctgtttagagctacaaggttaaagtgcctgctttccagtaatggagattgagtcactattaatttgataaaaggtaagctcagtaggcatcagattcctagatacaaggcatttgggaaagt

SEQ ID NO: 346 - DNA, 1222 bp, Homo sapiens
ccttctccctgtctcctatcctgttcccaggaggctgggatgggtttgagagtctgagaaagggcaagagaggagataagcagcttaaagcagagtccagggatggaggcgggaggctgcatggactcggaggtgtgtctgagggtggcttgctgtctgccattccctgccccactctggctgcttccaggcctggggaaatagtgttgctcaagctcgggggtggtggtgatgatgctgacctgatggttgctaaagtgggactgagatgtccctttggataggtcgactacctggcagtaatccactagctgcgaagcatcatctttcccatcagtgctggagagaaaggcactgcccacctggtagctcagcccatgtcttggcagggcaggcctgtgcaagggaggatgctcaagcttctctgtttttctccacagcacatggtgatgagtttccgggtgtctgagctccaggtgcttcttggctttgctggccggaacaagagtggacggaagcacgagctcctggccaaggctctgcacctcctgaagtccagctgtgcccctagtgtccagatgaagatcaaagagctttaccgacgacgctttccccggaagaccctggggccctctgatctctcccttctctctttgccccctggcacctctcctgtaggctcccctggtcctctagctcccattcccccaacgctgttggcccctggcaccctgctgggccccaagcgtgaggtggacatgcacccccctctgccccagcctgtgcaccctgatgtcaccatgaaaccattgcccttctatgaagtctatggggagctcatccggcccaccacccttggtatggctctttgtggtcccttagtcttctggactccctacctgttccccaaacatttcttaggctttagtcctatgggatcagtgacctgggatgggggcgatttctgtggctgcctgtgcatgggcttggaataactgcccctttgtatcctcagcatccacttctagccagcggtttgaggaagcgcactttacctttgccctcacaccccagcaagtgcagcagattcttacatccaggtacatctcttccagtcttcctgcctcatccctggtctctgctttctgactttcttctcttctgccctgtgctcttccctatccctcctcctatacctacttgtctcttgttcttctgtgtg

SEQ ID NO: 347 - DNA, 1173 bp, Homo sapiens
agtgagcggagatcgtgctactgcactccagcctgggcgacagggcgagactccggttcaaaacaaaaaacaaaacaaaacaaaaatcaaaaccctcttccttgggggagaccagcggcgcggaagggaggaaaaagaaggagaggcaaacgtcacttctcccgcaggctgtggcagcatgttgttcggctgagtggcggagggtgggatggaaaagctgactgggacggggaaggcgctgtcagtgacatcagggatagggcgacttctatgtagatgaggcagcgcaggggctgctgcttcgtcaccggcggcttcgccacgaaggagttcccgtgctgtgggagggagtccaggaccgctggtcggacctgagagtcctagctgtgtatcagggctaggaggcctcgagggtgcgcggggcaagtgaccgtgcgtgtaaagggtgaggcgtatgaggctgtgccggggcggaagcgtgcagactcacatttacctagcagaagaaaaatcgtgtttacgaaggtggttttcgcagggcgaagctaattcgtgcaacttccccaaatgtgggaagctcgactgcataatttgtggtagtgggagactgcgttcgctcttttcccccgttttttttttttttgcagtgtggaaagatagactgcatgcagtctatcgtgttatatcctggacggcatccgaagtgtttttccttgtagttaggaggctatgaaatagaaagtaacgcgttggttgttgtccttgccgccggagaaattataaggtcagccgaggtgagattgtttaacataagctaactagcgcgatggccccagagcgctttcctttctacgtggggctgcttttagcagagattggcccgtggtctccagtctcctgggttctcacgctctgtgaaaatcttcgtgtttttccgcagcctctagagttacctttaacagcctctgcttctaaccgctgccccacaggagtttataggatttctgtgctggcggggaatgtgttctcacctcatagagccaggtagaaactgtatgccgacgggctcagttctttgcgatgaaagcagggcctttggggctctgtgacccccttcggttgtagacataacatgcttattttgtggatgggaacggctctgcccgcgcccag

SEQ ID NO: 348 - DNA, 1211 bp, Homo sapiens
gctatgcggaagcctgaggcaggagaatcgcttcaacccgagaggcggaggttgcagggagccgagatcatgcgactgcactccagcctgggcgacagagcgagacggcgcaaaacaaaaaacaaacaaaaaactacaacagaaacacccgcttctttggggaagaccatgggcggggaagagagggaaaggaggcagaggcagacatcactgcccccgcaggctctggcaccatgttggtcggctgagtggcggagggtggggcagaaaagcagaccgggacgaggaaggcgctgtcggtgacatcacggatagggcgacttctatgtagatgaggcagcgcaggggctgctgcttcgccactggctgtttcaccacgaaggagctcccgtgccgtgggagcgggttcaggaccgctggtcggacctgagggtcccagctgtgtgtcagggctaggaaggctcgggggtgcgcggggcaagtgaccatgtgtgtaaagggtgaggtatatggagctgtgacagggcagaagtgtgtgaagtcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgtccgcgctttcccctgaatttttgtaatgaaaaaatagactcccctataagggttattcttaaaactgcagttttgtggcttgggtggcatgttaagtgttctccttacagtcgcaatgatgggaaacagaaagtaacgtgttatcctctccgccgccgtgagctcttttaacactaagtggccgcagggctcttctcttccctttctacttggggctgctttttgcagatcgcttcatagtctccagtcttttgggttctcatgctctgtgaaaaccttcgtgttttttcatagcccccagagtcacccttcacacagcctctgcttctaaccgcagcctccgcaggagtttgtaggatgtctgtgctagcggggaatgtgttctcacctcctagagccagggaagaaactacgcagtcgggtgctgttctttgggatgaaagcagggtccccgttcggttgttaacataacacgcttgctttctgtaggggaagggaggtctctcccggcgcccaggt

SEQ ID NO: 349 - DNA, 1199 bp, Homo sapiens
aaagctggagggagctggggaaaatgggtgtgggggtagtgtgaggaagacagggagcaggagagagaggggactggaaacagaaggagaggaggaggagaaagaggaggagaagaaggcagaataagaagagcagaaattccagcatatcccaaatcttgttccagaaatggttatcagtgccccatggataaagggaaaaggaaatttgcaaagaaaaagaaagaaaccccagcgggtagagggtctcggcagaatgtttatttcagagcaggaaactctggcaacccaggcagaactgttggctttagtggaggcctaaatatagctcttctctgttcctaatcctgaaaggtgcttaatctcattctctgagatagaaacctaaagagaagggcagagagaggtaagtctggggtgactcctcctattgtagattaaaggtactcaagtcctgtgtgacaaagagaaaaaaatacctgaaaaggaaattctggtgactatggaggctgagaattcacttgtcaaatgctcataactgagagtattctcaacagctggttccatgggttaatggtgagcaccctggactctgaatcaagcgatccgagttcaaatctcggtggtaccttggtgtctgctggccttttactctggagccagaagccactttgggaagcaaactccaccctcaaagacagagtgaaagggatgtggtttacatttgcccttcgtaccaagtcctgggttaaagaagagaaaggaaggtttgggtcccggggaaggaagctctgctgctgcaaatcccctagtccctcctgctccggcctcgcaatgcgtcccctgcaatgtccctcctcctctcccgtgtccctcctgctccggcctcgcaatgcgtcccctacgatgtccctcctcctctcccttttcctcctcagtggtctgggtcccagaaaccggcttcttgcagtggcctgctccacagggaaattgcccaaacatcccatcggagtcaccaatcctggtcccagtcctgggcgagcctcccggccccctgcaatcggaggcccggaccccgcagccagcgtcccagcaaccgaacaagtccccatcccctctcagggcgaccctgggcctcggggtgagaggtttcctacactaaaagggctgcggcccctcagtgctagaccccgagattc

SEQ ID NO: 350 - DNA, 1244 bp, Homo sapiens
cattatctgaagaagggtgcaaaagcttcctgttggccgccagaagggttctctgcaggacacagatcaagtaccacagtcttagggggagaccagacgcggggtctctgcgcacctccccaaaggacaatggcaggaggaaaaggagaaagagacagacgtcacttccttcgccagctccggcagcgggttgatcggctgagtcggcggagggtggggcggaagagcagacggggactgggaaaggcgctgttagtgacatcacggatagggcgatttctatgtagatgaggcagcgcaggggctgctgcttcgccactaaggagttcccgtgccgtgggagtgggttcaggaccgctggtcggacctgagagtcccagctgtgtgtcagggctaggagggctggggggggcggggaggtgcgcggggcaagtgaccgtgcgtgtaaagggtgaagcgtgtgaggctgtggcggggcggaggtgcaaaagctcatacttacctggcaggggagatactattatctaaacgaaggtggtttttctcagggcgagggttatccattgtgttccggatgtgctgacctctgcgatttccccaaacgtgggaaactcgattgcataatttgtggtagtgggggactgcgttcgcgctttcctctggtgcttttgtggtgcgaatagtaggtgagccgtaagtgtttttgtaattcagggtgcgggctcgtgttttgtggctgtgttctgtccggtcagttgtttccgttcgcaacggttagttttcgtttgtgaggccatgtttggggacagcttagaactatccacttactctcttgggaggcgaatttcagtctctgttggttggggtgttctcccaggttagctgccgctgtacttgctaggtggagctcagggatcaagggtcgggagctttctggtttgttcagtgctcccagggcttctaacatctcttaaaaactctggtgttttctgtcatcctcggagttacctcttagcctctgttttttttgttgtttttttccccccctccctaagacaagtctcgctgtaccgtccagtctggagaagtggcgcgatcttcccatctcaggctcccgagtaggacaaccacacgccaccacacctggctagttttttctctttttttttcttttcttttctttctctttcctttctttttcttttttcgtagcggtttcaccattctgctcaggctgggctcca

SEQ ID NO: 351 - DNA, 1248 bp, Homo sapiens
cgcattaaaagacattatctgaagaagggtgcacaagcttcctgttggccgccagaagggttctctgcaggacacagatcaagtaccacagtcttagggggagaccagacgcgggatctctgcacacctccccaaaggacaatggcaggaggaaaaggagaaagagacagacgtcacttcctccgccagctccggcagcgggttgatcggctgagtcggcggagggtggggcggaagagcagacggggactgggaaaggcgctgtcggtgacatcacggatagggcgatttctatgtagatgaggcagcgcaggggctgctgcttcgccactaaggagttcccgtgccgtgggagcgggttcaggaccgctggtcggacctgagagtcccagctgtgtgtcagggctaggagggctgtgggcggtgggggggtggggtggggggggggggcgttcgcggggcaagtgaccgtgcgtgtaaagggtgaagcgtgtgaggctgtggcggggcggaggtgcaaaagctcatacttacctggaaggggagataccatgatcacgaaggtggtttttctcagggcgaagcttatccattgcgttccggatgtgctgacccctgcgatttccccaagtgtgggaaactcgagtgcataatttgtgatagtagggaactacgttcgcgctttctcttggtgtttctgtggtgcgaatagtaggtgagccgtaagtgtttttgtaattcagggtgcgggctcgtgttttgtggctgtgttctgtccggtcagttgtttccgttcgcaacggttagttttcctttgtgaggccatgtttggggacagcttagaactatccacttgctctcttgggaggcgaatttcagtctctgttggttgggttgttctcccaggttagctgccgcggtacttgctaggtggagctcagggatcaagggtcgggagctttctggtttgttcagtgctcccagggcttctaacatctcttaaaaactctggtgttttctgtcatcctcggagttacctcttagcctctgtttttttgttgttgttttttccccccctccctaagacaagtctcgctgtaccgtccaggctggagaagtggcgcgatcttcccatctcaggctcccgagtaggacaaccgcacgccaccacacccggctagttttttctctttttttttttttcttttcttttctttctctttctttttcttttttcgtagcggtttc

SEQ ID NO: 352 - DNA, 1267 bp, Homo sapiens
tctcatgatttccattctcaaggctcttcaaaggactaaaagctaaaaggatggattcattcgacaagtcctagtcctgcgccctggtgagtgccagaccctgctccccgtgagggggacccacgagccaccctcaccacgatccctgccctggtggagcccccgtgcggaacacaggatccgaagatggcagcggaagctccgcagcggccccaaaagcgactgggcagggagggcacaggctccctcactgggtgaaggcggcgcaaagaatgggaagagccatcccgggagccaccgggcgttcagcctccctagggcccccaggcggctcgggccggggtctcaaccggggcgtttccgggggtttctgaagcaggcgaggggcagggcgggcgaaggccattcggctatccttctggctccagaatctcccaacgcgcaggtgtccaacgtgaccagcgcgacttaccgctccaatctctccagttttccaaggccttgctcagtcctcctgccgggcgggccctgaggatgcaagggacggaggaagtttcgtgcgtgcgcccttcctatagcgcccagtagaactaacagtacctgtctctgtggcgcaatcggttagcgcgttcggctgttaaccgaaaggttggtggttcgagcccacccagggacgcctctttgagcttttaaagtattcatgcattgtcaatcactagataaatggggaagattttatcttcctggagtcctaagccactaatttgtgacttatccatgtcaagggccagcccacctccccaaccggattcttaaccgggtatctcctgaaatcctgggtttatacgtgtgtaactcaggaatcctgaaacagagacctaggaacccacttctggtgtgataaaattctaattcagtccgttatacgcttaaatgagtaatttacatgcctccattttttcatatgttaataataggaggtcagtaatatcccgaggatgtgcctggatttactgattgctctatcaataatgtgaccagtggaatcattcatcatcatagtgatcctctccatcatttttgaagagtatttttcctcagtttgtgcatgatttatttaacccttttcaaaatgtttttgttagccaggcatggtggcatgtgcctgtaatcccaggtacttgggattctgaggcaggagaatcatttgaacctgggaggtggaggctgcagtggaggctgcaccaatggaggctgcactgctaca

SEQ ID NO: 353 - DNA, 1417 bp, Homo sapiens
cctcagcctgtctcctgggctccatccatgttgcttgtcttgtctgtccctcagtttcctcatctgttcagagggtactacaataatacctacctctgtaaattgctgcaatgaattacatgaggcatttcctgtcaatctccttgaacattaattggcacagtgtaaacactatctattagttcttcattctgatgtttctaaattaacacaaactaatcttatgctgtttctaaattaacacaactaatctaaatcttaatgctgcctctcatactaataaagtatttgggcatatttccttcatggccttattgtcttatgtctcacactttatgcttcagatatgattcttaaaaccatatctgaatattgatttaaaaatgaaatatttttaaagtccttgacatatttgtccttgaaatacccagtaaaagggaaaccatcagtcccatagtcctaggggccttcccgactgtacaagaaatcactacttcatgccccagtgcagtgttttagaggagaggctgcaaggcttgggaaagtggccccgcattcagagtcagacctcaggggctgtgagttctgactccgcttcgttgtggttgaatcatcttgtcaacttccttgacgcgcccttgagtttctctttcttcatctttaaattttggaggatcagatgccagaaagtcaggagactgaagagtaaagatgtggaaatccctgtctagaccctggtactggggagagttttgtccttgggatggacctggctcctgccctgtaggcagtgaccacagcagcatgtccagccttccactgaggcaggcgtgtctgtcttttctcagactatgaagagtgtaaagacctcataaaatttatgctgaggaatgagcgacagttcaaggaggagaagcttgcagagcagctcaagcaagctgaggagctcaggtgaggggaccccgtagggggaggcaggcgggtaggtgtgtagatctctgaagtacagcagctcggcggggagaaataagaacgaagctgggccaggggaagggcagaaattgccatggcaggctcatgacacacaaatatttatcagagaacaaggataataataagttctgtgttgcagttgtttcttagagccttgttttctctttttcaaacaagtaattgttgatgtgaaatttacataacacaaaattcaccaaaggagtgggaaccacccagcagcattcagtataatcaaaatggtgtgctatcgccaccccacttacccttagtgagaatcaccttctgactgactgcgtcttctcattctttcactcaatcaatgttgccttctcgaccctgtcattcttttcttctttcatcttttcatttcgccccatctgcacctggcctcatttctgtacat

SEQ ID NO: 354 - DNA, 1417 bp, Homo sapiens; identical to SEQ ID NO: 353

SEQ ID NO: 355 - DNA, 1254 bp, Homo sapiens
taatcctaaactttctagtttgcgcattaaaagccattactcaaagaagagcgcccaggctccagctggccgccaaaggggtccttggcatcacaggctaagaacctacttctttgggagagaccaggggtggggaagggagggaaaggagatagaggtagacttcacttcctccgccggctcccgcagcgggttggtcggctgagtggcggagggtcgggcggaagagcagatggggaccgggaaaggcgctgtcggtgacatcacggatagggcgattcctacgtagatgaggcagcttaggggctgctgcttcccacgaaggatttctcctgctttgggagcaagtccaggaccgctggttggacgtgagagtcccagctgtgtgtcagggctaggagggctccgggtggcatggggcggggtgggggtgggggtgcgggtgcgcggggcaagtgaccgtgtctgtaaaggttgaggcgtatggagctgtcgcagggcggagatgtgtgaactcacacttacctggcaggggagatagtatgatcatgaaagtggtttttccagagcgaggcttatccattgcactccggatgtgttgacctctgcgatttccccaactgtgggaaactcgactgcgtaatttgtggtagtgggggactgcgttcgcgctttcccctgaattttccagtgcaaaaagcagttggtatgcaaaggtctacttctcgcttttttttgctgtataatcttggtggtggtgtgttattcttatagccggatggcagggaaacaggaagtaacatgtcgccgtcgttcctgccggagaaataagcgtcaggcgttgtgttcctgtttaacacaagctaagtagcgcgaaggccgcacagctccttcctttcaacatgaggctgctttttgcagagattggtccatagtctccattctcttggggtctcacgctctgtaaaaatcttcttgtttttccctagcccccaatcaccttttacacagcctctgcttctaagcgcagccccctcaggagtttgtaggatttctgtgctagcggggaatgtgttctcacttggtagagccaggtacaaactacgcagacgggcgctgttctttgggaagaaatcagggcctttggggctcttagtgttcccgttgggttgtagacataacacgcttactttgcggaggggaaggggtctaccggcgcccaggtgccctaacgcaattcatcccgagacacgc

SEQ ID NO: 356 - DNA, 1272 bp, Homo sapiens
caaggataaggatgtgaagagaaccggtttcttttgtaatcctaaacgttctcgtctgagaattaaaagccattatttgaagaacggtgcccaggctccaggtggccactgaaaggttgctccgcagcgcaggctaaggaccagcttcttcgggcgagaacagatgccggggcgggagggaaaaaagggagagacagacatcacttccccctgccggctccggcagcgggttggtaggctgagcggcagaaaggcagacggggactgggaaaggcactgtcggtgacatcacggatagggcgacttctatgtagatgaggcagcgcaggggctgctgcttccccacctgctgctgcgccacgaaggatttcccgtgccgtgggagcgggttcaggaccgctggtcggacctgagagtcccagctgtgtgtcagggctaggagggctggggggggggggggggggggggctgcgcggggcaagtgaccgtgtgtgtaaagggtgaagcgtgtgaggctgtggcggggcggaggtgcaagagctcatacttacctggcaggggagataccatgatcacgaaggtggttttcccagggcgaggcttatccattgcactccggatgtgctgacccctgcgatttccccaaatgtgggaaactcgactgcataatttgtggtagtgggggactgcgttcgcgctttcccctgattttttgtagtttaaagaatagtctacacagcaagggttacttgttttttttactggcttgtgttttagtcttaatcgttactctcacagtcgaaggctgagaaatagtagtaatatgtcgctttctccccgccccgggagaaataagaatcgtcgacctttacacaagctagctagcgcgaaggccgcacagctcttcctttatctaggcggggctgctttttgcagagatttgtctgcccatggtctgcagtctcttgggttctcagggtctgtgaaaatctacgtgtttttccctagcccccagtcacatttcacacagcctctgcttctagctgcagccccctcaggagtctgtaggatttctgtgctagcggggaatgtgttctcacctcatagagccggctacaaactacgcaggcgggggctgttctttgggatgaaagcagggcctttagggctcttagcgcgtccccgttgggttgtagacataacacgcttactttgcggagtggaacggctctcccggagcccaggtgtcctaacgcaattcatcgaggcccg

SEQ ID NO: 357 - DNA, 1198 bp, Homo sapiens
attcattcgacaagtcctagtcgtgcgccttagtgagtgccagaccctgctccccgcgaggggacccaggagcgaccctcaccaccatccctgccctggtggagccccggtggggaacacaggatccgaagatggcagcggaagctccgcagcagcccaaaagcgactgagcagggtggatacaggctccttcactgggtgaaggcggcacaaagaacgggaagaaccatcccgggagcccaccaggcgttcagcttccccttgggacctcaggcggctcgggctgggtcgccgaccgcggagtttctgggggcttctgaagcaagagaggggcagggcgggcgaaggccattcggctctccgtctggctccagaatctcctaacgcgcaggtatccaatgtgaccagcgcaactcaccgctctaatctctctggttttccaaagccttgctcagtcgtcctgccaggcgggcgctgagaatagaagggacggaggaagtttagtgagtgtgcccttcctatattgcctattagaactggtagtgcttgtctctgtggcgcaatgggttagcgcgttcggctgttaaccgaaaggttggtggttcgagcccatccagggacgctgattgcaacttttaaagcattcacgcattgtcaatcactagacaaatggggaagattttatcttcccggagtaccaagccactaatttatgactgatccatgttaagggccagccccaaacccctaatttatgactgatccatgtcaagggccagcccccctcccccatccgattcttaaccgggtatctcctgaaatggcgggtttacacctgtgtaactcaggatcctgaaacagatacctaggaacccacttttggtgtgataaattctaattcagtcccttatgcgcttaaacgagtaatgtacgtgcctccattttttcatattttagtaataggagttcagtactatctccaggatgtgcctggatttactgattgttctattaataatgtgaccagtggaatcattcatcatcatagtgatcctctccaccatttttgaaaacagtatttttcctcagtttgtgcatgatttatttaacccttttcaaaatgttttagccaggcgtggtggcatgcacctgtaatcccagctacttgggaggctgaggcaggagaatcatttgaact

SEQ ID NO: 358 - DNA, 1187 bp, Homo sapiens
tttatacatcttcaagcagacaaataacagtattatggttacaagaccgatcattactcttttgccaaaaaaaccagcgacaaaagactaactcagtggaccaacctttgtttcttcattatctctaccttgattctgtccttttatttcctctttcctctaattctaattctgcttctgcttcttatttcctccctggattagaactttacttacctaagctaccagttaggttaccttctcagaaccactaaggcagcagtttgacgttgacaattgaagatttaggattagaaaaaagaaacatgaatgaatttgtgacgttttattataggggtatgtaatgcaggtagaaagacctttttcagagttaagagtttgatccgacaaatgagctattttgatatttataactttgtttagtaaaagtttcctataaaaacatttggtttggatgtctttgttagctttgagtcgacacttgaaaaggccgcttggaagtttctaagtctttctggatactctttccgataattctccaagggttgctggggagaggcactggtggttcagtggtagaattctcgcctcacacgcgggacacccgggttcaattcccggtcaaggcaagaggttcttttgctcttcactatggctctttacccttctgccctgcagaattacactgcataacctaatagtgcatttaagggcttggccaccacaaggtaaactgacaacaacgctgaccaaagtagcagcaaaagacattcaggagactaacccgggacccacgcagttgttggactcaacaaaccgctaagcaaagtggcaagcacgtagtgtttctggtgagtcactgcagttttgatattggtacctgttactttcatctgttctctgggcggattcctgcaaacccaagaaccatcagtttcctgattcgtgtgctggaccttgggcttaccgctgagccactacggagaggaacaagaaatgaagctcccggaaggagagaagctgcgggcggggcaatcacctcggaggtccaagaggcctcagcggcccaaagaaaggggaggtgtgtgcgggagaatctcaatggagatgaggagagcagcggtgactggtccttgcgcagagtggtccttgcacagaggtagccaatggaccctcgaggctgtacc

SEQ ID NO: 359 - DNA, 1185 bp, Homo sapiens
gacggctcttcccgctcctgtaggaaaaggcaatgccccttttgtcttgtctatgtgggactccaaagggtccagacgagacagaaagggggcgaatcctctcagagtgggcaggggaggagatacaatatgggaatggggcggtagaggggtgggatttcatgaaatttcctgatttaaggcgatcatgaagtaggcctctttgggaggttggccctccagtcgctggtaagggtaacagcccaccagtctctggtgagatccagtcgcgtcccccgactgcatttagagccaaaagcagaacgaggccggcgctgcggcctggcgtccagtgacccagctgtctgcatattccccagggtgcaaacacttggacttcaggtgtgaaggcaatgcggtcaccaccgcagtaagaaaagcaactagggaaaatggcaccttcttctcctaacttttttttgagactctcgctctgttgtctaggctggagtgcagtggtgcgatcttagatttggaaactataatagaaacggctgatctaagattttcatggttatgttttgccgcgcaggttccgcgtgtggtttccgtagtgtagtggttatcacgttcgcctcacacgcgaaaggtccccggttcgaaactgggcggaaacagaggttttttttgttttgttttgtttttttttttttgttagcccttaaatttagtgagtttactcgaggttggaaaacagaaaagtagttgaacctgtgactacattttagacctcatcaatctatacagattgtcgaccaggctacaatttccactggtctgccaggaagaggacgtcacagcaggcctgcttaatattaactttggttccagcaattccttaaggttctcttcattctctttatcgcctgaattttcacaggcagacaccgaaagtggatgacatgttagcgcatttcctaagggtccagcttggcttcgctttactctgatacagttgcagatctggctgatttgcgagacaacaaaaacaaaatgttttttaaaaacgttccaaatctgcatctggaactcatggagtcaatattccgaaatcacacgaattatgtacatacatttgcatgcataccccttccccaaataatcctcagaaaaccggtaagcgtccaaactactctccggaggctt

SEQ ID NO: 360 - DNA, 1226 bp, Homo sapiens
ttatctgaagaagggtgcaaaagcttcctgttggccaccagaagggttctctgcaggacacagatcaagtaccacagtcttagggggagaccagacgcggggtctctgcgcacctccccaaaggacaatggcaggaggaaaaggagaaagagacagacgtcacttccttcgccagctccggcagcgggttgatcggctgagtcggcggagggtggggcggaagagcagacggggactgggaaaggcgctgtcggtgacatcacggatagggcgatttctatgtagatgaggcagcgcaggggctgctgcttcgccactaaggagttcccgtgcagtgggagtgggttcaggaccgctggtcggacctgagagtcccagctgtgtgtcagggctaggagggctgggggggggggggggggtgcgcggggcaagtgaccgtgcgtgtaaagggtgaagcgtgtgaggctgtggcggggcggaggtgcaaaagctcatacttacctggcaggggagatactattatcaaacgaaggtggtttttctcagggcgaggcttatccattgtgttccggatgtgctgacctctgcgatttccccaaacgtgggaaactcgactgcataatttgtggtagtgggggactgcgttcgcgctttcctctggtgcttttgtggtgcgaatagtaggtgagccgtaagtgtttttgtaattcagtgtgcgggctcgtgttttgtggctgtgttctgtccggtcagttgtttccgttcgcaacggttagttttcgtttgtgaggccatgtttggggacagcttagaactatccacttactctcttgggaggcgaatttcagtctctgttggttggggtgttctcccaggttagctgccgcggtacttgctaggtggagctcagggatcaagggtcgggagctttctggtttgttcagtgctcccagggcttctaacatctcttaaaaactctggtgttttctgtcatcctcggagttacctcttagcctctggtttttttgttgtttttttccccccctccctaagacaagtctcgctgtaccgtccaggctggagaagtggcgcgatcttcccatctcaggctcccgagtaggacaaccacacgccaccacacccggctagttttttctctttttttttcttttcttttctttctctttcctttctttttcttttttcgtagcggtttcaccattctg

SEQ ID NO: 361 - DNA, 1332 bp, Homo sapiens
aaaatacagtggctcggtccaacaaaacagagcctggagccaggaattatggcgaacctgctccctcccgtcctcccttggcgcacagatccctggcgccgccgctcttgaggtcgcctctcgcgtgtcgacctcatcgtcggaacggcgcttcctgaagctttatataagcacggctctgaatccgctcgtcgggattaaatcctgcgctggcgcgctcctgccagtctctggcctccatttgctcttcctgaggctccctccagagacctttcccttagcctcagtgcaatgccttccgggcgtcctcagaccagacacaggccaaagccactacagaatccggaagccccggttgggatctgaattctcccggggactgtggcgtagcggttaaaaaaaaaaaagagtgagagggacctgagcagagtggaggaggagggagaggaaaacagaaaagaaatgacgaaatgtcgagagggcggggacaattgagaacgcttcccgccggcgcgctttcggttttcaatctggtccgatactcttgtatatcaggggaagacggtgctcgccttgacagaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgaccacttgctcatctgaggagttggacacttgactgcgtaaagtgcaacagtaacgatgttggaaggtaactttggcagtggggcgacaatcggatctgaagttaacggaaagctaccgcggcccatagcgctcacagccgtaaagacttaagtcgttgaccgaaagcggctttttcacttacctgggctttttttttttttttttttttttttttaaagcctttatcggtatgaaaggttgaatgctctaggtttgagcactgctttctcggcttgctcttctggtgcagtataggcacacctagagggccacgtcagtctttgcgatcaccaaatctggttctgagaaataggcactggc

SEQ ID NO: 362 - DNA, 1332 bp, Homo sapiens; identical to SEQ ID NO: 361

SEQ ID NO: 363 - DNA, 2154 bp, Homo sapiens
ttgcttgagccaatcaaagtgctccgtggacaatcgccgttctgtctataaaaaggtgaagcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcagtagtgaatagcgaacctggagctgacgggacgggacgggacgggacgggacggggcggggcggggcggggtgtgtgtgtgtgcgcgccgtcttccatctggagcacgtaactgccttggctcttcgatgagtgggtccccagtcctaggacttcccagggcaggtgcaggcaccaaacgtcctgggcgccgccacggtccgctccacacagtcacaaacaccagcgccgcgggcagtacccaacgcgctgaagtgttgcgcgcggagcgcgcgcttccctagtggtttccgcaggctatggccggacacttagacctagtctggcaccagcgggacgtgctcctcgtccccacccccgatggggagggccctgagcgggtagtgctcgctagtgtggcggagctgggtcttggcttcactgagctgacttaagtcttagtttctgttttgttttccaaagcgccctggcggcggagagtaagggcctcggaggcggaatcttgcgtcctgggggcgggcacctctcccacccaaaaggcacccgacaggcgaaaaacgatccgccaagtagcaactgggggcggggggcaaatggaagaatgaggttccacgcgggagctgtagggcgcagcaagaaagggggggtattgcgggcagtgtgttctaaggaagcgaagggcggaaagggaacaatctgacaaagctgcaatggaaaatgactttcaccctgaaggaaaggggaaaaacaagcttgcgaaacttcgccaactggtaagtagaaagtgaggcggggtgggcgggattagggaggaatctgcccaagccaaccggtgactttaggacgggtgacgtcacagccaatggacagccagcgcgggattttcaattattgttccgcccaatcgggaaaagactgtgcttataaagacggctgcggcggggctaggagctcgtttttctccccgccgctgcgctggtaagcctgtgttttggttcgctatggcccgtactaagcagactgctcgcaagtcgaccggcggcaaggccccgaggaagcagctggccaccaaggcggcccgcaagagcgcgccggccacgggcggggtgaagaagccgcaccgctaccggcccggcaccgtagccctgcgggagatccggcgctaccagaagtccacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccacgccaagcgcgtgaccattatgcccaaggacatccagctggcccgccgcatccgtggagagcgggcttaagaagtggcggttcggccggaggttccatcgtatccaaaaggctcttttcagagccacccacatcagcacttggaagaa

SEQ ID NO: 364 - DNA, 2154 bp, Homo sapiens; identical to SEQ ID NO: 363

SEQ ID NO: 365 - DNA, 2154 bp, Homo sapiens; identical to SEQ ID NO: 363

SEQ ID NO: 366 - DNA, 2154 bp, Homo sapiens; identical to SEQ ID NO: 363

SEQ ID NO: 367 - DNA, 1220 bp, Homo sapiens
gttgcggatggccagctggaggtgacgagggatgatgcgcgtcttcttgttgtcccgagccgcgttgcccgccagctccaggatctcggcggtcaggtactcgaggaccgccgccatgtagacgggcgcgccggcccccacccgctccgcgtagttgcctttgcgcagcaagcggtgcactcgccctaccgggaactggaggccagcgcgggacgagcgcgacttggccttggcgcgggccttgcctccttgtttgccacgaccagacatgactgaaatcaaggttaaacacagacaacgctcagaacctcgcaacaaaataagattgaaagagaaccaagaggaaagcctttataagctttcctaggggtggggtcaagaacgagtttttcattggtcctaatatggcttcagaaccggccaatcaagtcaagagtcggtgttgttacgtacgcattgctgaaaacgcaaggtccgcacacggaccaatggaaatgaacgactttcggagccctaatttgcataaggtggttataaaagaatcaggcccgcccattctcttacttcttttcttggctaagccgcgtttgtactgtgtcttaccatgcctgaaccggcaaaatccgctccggcccctaaaaagggctccaagaaagccgtcaccaaagcccagaagaaagacggcaagaagcgcaagcgcagccgcaaagagagctactccatctacgtgtacaaggtgctgaagcaggtccaccccgacaccggcatctcgtccaaggccatgggcatcatgaactccttcgtcaacgacatcttcgagcgcatcgcgggagaggcttcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctccaagtgagtccctgccgggacctggcgctcgctcgctcgagtcgccggctgcttgactccaaaggctcttttcagagccacccacctaatcactagaaaagagcttgttcacttattcccttagtttcttttcataaagtaagttattttagtgtgaaggtcatgggaaatggcatacgtagctttttaactatttggaactcgaggtccccagtgcgtcattggatttgcttttgaatcta

SEQ ID NO: 368 - DNA, 1444 bp, Homo sapiens
tgcccatggccttggacgagatgccggtgtcggggtggacctgcttcagcaccttgtacacgtagatggagtagctctctttgcggctgcgcttgcgcttcttgccgtctttcttctgggctttggtgacggctttcttggagccctttttaggggccggagcggattttgccggttcaggcatggtaagacacagtacaaacgcggcttagccaagaaaagaagtaagagaatgggcgggcctgattcttttataaccaccttatgcaaattagggctccgaaagtcgttcatttccattggtccgtgtgcggaccttgcgttttcagcaatgcgtacgtaacaacaccgactcttgacttgattggccggttctgaagccatattaggaccaatgaaaaactcgttcttgaccccacccctaggaaagcttataaaggctttcctcttggttctctttcaatcttattttgttgcgaggttctgagcgttgtctgtgtttaaccttgatttcagtcatgtctggtcgtggcaaacaaggaggcaaggcccgcgccaaggccaagtcgcgctcgtcccgcgctggcctccagttcccggtagggcgagtgcaccgcttgctgcgcaaaggcaactacgcggagcgggtgggggccggcgcgcccgtctacatggcggcggtcctcgagtacctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgttttgcctaacatccaggccgttctgttaccaaagaaaaccgaaagccacaaagccaaaagcaaataaatgcagacaaacaaaccaagaccaaaggctctttttagagccacccaagttttcaaaaaaagagctaatgcgctatttcgtgatcagcccttcatttgacactttggtggctcttaaaagagcctttggggtgaatgagtatggtgtcaagcctcttaattacttgttcttgccaggcttgtgactctccgttttcttgggcaacaggacagcctggatattgggcaagacgccgccctgggcaatggtgacacccccgagtaacttgttgagctcttcgtcattcctcacggctagttgcagatggcgagggatgatgcgcgtcttcttgttgtcccgagccgcgttgcccgccagctccagaatttccgcggtcaggtactcgaggaccgccgccaggtacaccggggcgcctgccccgacccgctccgcgtagttgcctttgcgcagcaagcggtgcactcgccccaccgggaactggagaccagcgcgggacgagcgcgacttggccttagcgcgggccttgcctccctgct

SEQ ID NO: 369 - DNA, 1292 bp, Homo sapiens
cctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgattagtttcagtgtatagcattcactttttcaacaataccattagcggctttgaaggtctttttaaaaactaacagcttgaaagttaactgatttaaatacttggatgtgatataaggcattacaatttatttatttattttttgagatggaatcttgctctatcgccatgctggagtgcaatggcgccatctcgactcactgcaacctctgcctcccgggttcaagcgattcccctgtcttagcctcctgagtagctgggactacaggcatgcaccaccatgcctggctaattttttgtattttagtagagacagggtttcaccatgttggccaggatggtctcgatctcctgacctcatgatctgcctgcctcagcctcccaaagtactgggattacaggcatgagccactgctccc

SEQ ID NO: 370 - DNA, 1306 bp, Homo sapiens
gacagtttcgttgtctgttggatttggtttttagtttttggttttttattctgttgttagtgttaaagagggagaaagcatccttccgtgcccaacttgcgatactgagaattcaccacacggcacgcactggctcttggccgttttaaaagcatagcctctgctttgcaaccaaggtgtacagcaacgtgcgcatcacattaaaaagatgccttcgtggcattgtcctgctggggtcaggctcttcacagagactgaccttccgtgatgcagagctagagccgagattttaaagatggtaggttaacaccataaaagacaacaattttgaaagcagttgggtgaaagcagtatgtaagttagtaatatttaaataaaactatcctggaggaattgttactgagttaattgttgctgtaataaacactaagaccttggaggaaaaacgacgctgtcctaatgaaaatcagacattaattagcatagaaatggcaccgcgatgccgctctaatttccctttggttggtttccatggaaatctgtaggtaaagtgtgcttttaaaagtgtttatcgcttctctgccttttggctaagatcaagtgtaggatctgttcttaacagtttaatatctgatatattttctatccgagtccaatatattaaatggatttggggagcaggaagacggaataggagcttgcttgttcacttcacgcatcgatctggtattgcagtacctccaggaacagtgcaccccctcaggggattaaaatttaatgttcaaaacagaagaaggaaaaaaaaacagtctgtctatgtgggatgggatacaaaagagtgggataagaattatcttttggccgggcgtggtggctcccacctgtaatcccagcactttggaaggccaaggcggttggatcacctgaggtcaggagttggagaccagcctgactaacatggtgaaacctcgtctctacaaaaaatacaaaatattagccgggtgtggtggcgtgcgcctgtaatcccagctactccagaggctgaaacaggagaattgcttgaacccgggaggcggaggttgcggtgaaccgaaatcgtgctattgcactccagcctagacagcaaaagcgaaaccctgtctcaaaaataaaaagaattatcttttaaaattttgtctcgacggtctaacttttttcttagctcttgcttaaattatatcattcttattcccttacaccattctcaggataaataaccaaataaattccaaatgatttggggaaggaagtggaaagtgggggaatt

SEQ ID NO: 371 - DNA, 1167 bp, Homo sapiens
gtcaggagatcgagaccatcctggctaacacggtgaaaccccgtctctactagaaatacaaaaaatcagctgggcgtggtagcgggcgcctgtagtcccagctactccagaggctgaggcaggagaatggtgtgaacccgggaggcggagcttgcagtgagccgagatcgtgccactgcactccagcctgggcgacagagcgagactctgtctcagaaaaacacaaatatccaaggaaatggaggtcacaatttttttttaaccataaaatcacgttcagctgggcacatgtctcacaaatgttactaggtcttcttataaaagaatattatctgatttaaataagaaattgaagtgtttttattatatatctcttttctagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaacttggtgtgatatttttcacacattcgtaagtattagagtttgggtctacaggtgatcttttttccggacttttagcaattgctgtggaaaaaaacattttttgtcattgacatttatttatatatataaatggatgaatggatggatggatagatggatgtgtatttttgaagtctagtggaaatgtttgatctcatcctggagctagaatgataaatactgttttcctggagcagaatgaagcagggagatgtgtaaagtggtaagggaggaaggagggacaaatgagtatccatcccttaaccaagagaatcaccaggttagacagattacctcaggacttggctaagtagtctttccaggaaatcagttcctctaagggatgcatatgtgggaatgtgtgttgtgggtgaaatggaca

SEQ ID NO: 372 - DNA, 1214 bp, Homo sapiens
tttgtgatttggagaaacttgtttaagataaaattgtgaggccgggcacggtggctcacaactgtaatcccagcactttgggaggcccaggcaggcggatcacgaggtcaggagctcgagaccatcctggctaacacagtgaaaccccatctccgctaaaaatacaaaaaattagctgggcgtggtggcaggcgcctgtagtcccagccactcgggaggctgaggcaggagagtggcgtgaacccgggaagcggagcttgcagtcagctgagatcgcgccactgcactctagcctgggcgacagagtgagactccgtctcaaaaaaaaaaaaaaagaaagaaactaagagtattagagtactgcacagtaaggcagcaagagtatgttcacaaagagaggttttcttcaaaagtcaaaagactaaatttttttattttttattttatcctgaaatgaatatttcccatgtcattttagataaaacaggtgggaagaagttctccaaagaatttgaagaggcaagctccaagctggaagaatttgtgaatggattagataagcaggtgaaaaacggaccctcattaacagaagcactggaaaatgctggaattttctatgaagcacaatacaaagaagtaaaagtggtggctaatgtaagtaataattaaagctgtcttatactgaatgcttgttactatatttcagagattgttaacatgcattatctaactctgttaggatatgcatttttatctccttatcgcagatgaaattacttttgggataggtgctgtggtacacacctgtaatcccagcactttgggaggctgaggcaggaggattgcttgagcccaggactttgagaccagcctgggcaccatggtgaaaccatgtgtctagcaaaaaagtacagaaattatctgagtgtgatctcaggcttcaatgagctgtgatcacgccactgcaccccagcctggccaacaagagtgagacccgtctcaaaaaaaatagaagaagaaattatgaggattagtaaacttgtacaaggtaatacagctagtaagtggtagaataagacctgggtctttttttttttttttttggaacggagtttgtcgctcttgttgcccaggctagagtgcagtggtgcaatctcagcacacagcaacctccgcctcccgggttcaagcgattctcctgccttagccccgct

SEQ ID NO: 373 - DNA, 1191 bp, Homo sapiens
ttaaagagacccaggccaccttttgctaggggccctccgttctttgcaccaaaacgcccattcttccctcccaggtactgatggaaaccaagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtattaaaaaaaaaaaaaaaaaaaaaaagtaaagaaacacaaccaaagccatttcatttggctggggggttggggagtggggaggaaaacaatctttattttaccccatctattgaagagtattattacatttgaaataaaacttccatcagtacagataaccacatgtgcaatgttgggatgttattttgggcttggcttatcgagtagtcaatggaaggattcccgtcccctctctcggcagcttagtaactgctgtagccagctcggctcccttccctgtgtatctgtgtcctgctaacagccaagagatgttgcaagggaggaaatgtgagagaccttgaacctgtcaggtttatttgttttgtttttaaaggcatgttgaagtttagttctttacccttctcctaaaatctttttttaatcagcctcaaggttaaaataaggagtgactacagtatgtaaaataaggaaaggaagcattaatggtgtgatgtgacctgcctgtttttttgtaaacaagagaataggaaatgttttcaaggtagtttcacatgtcttgcaccaagctcatgcctcttgcttttcctttttgactttatctccctcagtttttcttctgctgtggccagaaagacagtcactacagttgactattgatacaaaggtgcaacagaaatattatccctgcatttttaaatataagaagtagacattaattttaccatggtgcctccctaatgtaagtgatatttattggtggttttcaacaaaggttaactattaaagaaagaaatatttgtctttatcttccttttccccttgcctcagtcgtgttattcacccctattcttgatattttaaaggaggagattcagtagcattttccttta

SEQ ID NO: 374 - DNA, 1169 bp, Homo sapiens
tccgcctcctgggttcaagtgattctcctgccttagcctccagagtggctgggattacaggcatgtgccaccatgcctggctagtttttttttttttttttttttttgagatgaagtcttgttctgtcacccaggctggaatgcagtggcgcgatctcggctcactgcatctctgcctcccgggttcaaacaattcttctgcctcagcctcccgagtagctggaactacaggcatgcaccaccatgcctagctaatttttatatttttagtagagacggggtttcaccatattgtccaggctggtctcgaactcctgaccacgtgatccacccaccttggcctcccaaagttctgggattatagacatgagccaccgcgccctgccagggaattgatttttatctgccattgccctctctcagtaggacagttcctttctcttcacctcttctgtcagctaaagaccatgagagggagaaagctagaagctgaagattctgaaaatcactaactggcctcttctttctcctaggtgtggcacattggttgacctttgccagggcccccaccttcggcatactggacagattggaggactgaagctgctatcggtcagttgtgggacagagttaggttaagattcctattttgagccgggcatggtggctcacgcttgtaatcccagcactttgggaggctgaggcagatggatcataaagtcaggagtttgagaccagcctggccaatatggtgaaaccccgtctctactaaaaatacaaaaattagctgggtgtggtggcacacacctgtagtcctagctgctcgggaggctgagacaggagagttgcctgaacctgggaggcggaggttgtagtgagccgagactgcactactgcactccagcctgggcaacagagcgagagtccatctcaaaaaaaaaaaaaaaaaaattcctggtttcactgggatgagcaggagaatcggaaggtgatactttctgtcggcaccccccttttttttttttgagaccaagtctctcggtcgcccaggctggagtgcagtggcgcgatcttggctcactgcaagcttcgcctcctggattcaagcaattctcctgcttcagcctcccgagtagctgggataataggtgtgcaccaccatgcccagc

SEQ ID NO: 375 - DNA, 1218 bp, Homo sapiens
acccaggaggtggagcttgcagtgagccgagatcgcgccactgcactccagcctgggtgacacagcgagactccatctcaaaaaaaaaaaaaaaaagaaagcaccttggaaagagtattgggacaccgatttgagcctacagtcttccccctagctaaccatgtaaatttgggaaactcattttacctctttaggtctcagtctccttaaagttgctatctaaggctcctccttcagctcagtgaccatcacagaacagggaaatggtaaacgatgtctgttattgtgttactgagaaatccacttttgaacctcagggctcagactgtgatgagtgggattgacaggactcagtgggaggatgtgctgaggctggagagggttatagcagatggtgcagagaaagtaggcaagcagattgggtggaggagcagtcttcgggggctagtcctccctatggccctgacccctctgcaccccaacctcagcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcaggtggcctttccctggctccaccaaagcttttctaaaccacctttctttctccctatgaacctgcaaacccctgatctttatttgccccctgtatgtactataattcagctacattctacccccagcttgcttccgcttcctctctgtttttgccctttgttttcctcaaactgccagcatccctgatctctagcgggctcacagctcactgacccttatttcctgcccctagctggaagcagagatccaaagctgtcttgatttcctccgttccgtctatgccgttcttggcttctccttccgcctggcactgtccacccggccatctggcttcctgggggacccttgcctttgggaccaggccgaacaggtgagtaggaggtagagaaatagaggcagataaaccactctctggtgggaaggagtggagaatacagtaatcaaggttctcagaggcatctggtgagtgggtcatttgttggggactgaccggatgtgttgcttttgaagtctaagatgatgtattccactcttgtctcattccttcaaaggtccttaaacaggccc

SEQ ID NO: 376 - DNA, 1174 bp, Homo sapiens
ttttttgttttctaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataat

SEQ ID NO: 377 - DNA, 1168 bp, Homo sapiens
gattgtgccattgcactccagcctgggcgacagagcgagactccatctaaaaaaaataaatgaataaaataaaacaagtacaaatttaaactagagacacaagttaatggtgtttattgtggtggggttagtgagccatcccatgatttcctcctgagtatgttatccctggtttgtgtttgccagctggggaatgaggtgaggtctatgaggctgaatgtgggatcattcaatttctttctttctttctttttttttttttttttagaggcaggatcttgctcagtcacccagaatggagtgcagggtgcaaacactcactgtagcctcaacctcctgggctcaagtaatcttcccatctcagcctcccaagtagctgggactacaagcacacaccaccacacctggctaattattttttgtagagatgaggattcaccatgttgtccaggtgagtctcagaacacaggcttaagcactcttcccatctcagcctcccaaagtgctgggattacaggcataagccactgcgcctggctgagaatatattttcatcctttcttttgtagagaggatctcgttttgttgtgtaggctgctcctgaactcctggcctcaagcagtctttccacctcagcctcccaaagtgcagggattacaggtgtgaaccactacacccagcagttagtgcaatttcattttaatacaagtgaggaaattaaggtatagagataagttacttgtaaagtagaaaagctagttagctgaagagcttgagttagtatcttaggcttttatattatttcttcccactattcctggcttccctggtcctcaattttaatttgtggccttaagaagcctggggtgccaaaaatgtttggggctatctgtatttcatgttactccttagccttttttttttccttttagttcttcaccactgcacacttggcaggatgtatcccattttaaaacttgacagtccatctccttcactcccatactgtagggctaggcaagcaaagcaaactgattctgcaatgcttctaatagttattcctgctcattattttagctagatgtattctaaagtctttatcccaaagagttgaatcaaaggttcttccactcctccaacctgattgtgctgacaagccactaagctg

SEQ ID NO: 378 - DNA, 1100 bp, Homo sapiens
ccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgtccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatg

SEQ ID NO: 379 - DNA, 1220 bp, Homo sapiens
gtttttcaagcttcattgaaaagtcaggccatcagttattattggcagtatcttgatgaaatttcaaaaagccatgaaaacatcgcatgaatgattttggttttcatttgtcctgcttaatgtgcatatatttcattcagaaatactgaggtggattagggattgtggatctgtagtagtagtagtagtagaaataggaattttagatgcttaacttttttttaaataacagaattcattcatatgatgtgttaaggtagtgcccctcacatatcctccttgggatatagagggtcttaaaagctgaaaacttcttgaaaaacttttgggattatatgcatagccaccatgcctggttagtcctgttcttttaaaaatgacagtaagaggccgggagtggtggcttatgcctgtaattccagcactttgggaggcagaggcaaaagttgctcaactttttgaaaaaaaagaagtttgtagtttgttaaggaactatctagaagaaataacccaaggaatgtaaaactctaaactgctgaatatcactcagttctccttctcttgtcatcagaatatatgcgtaaatttttacattcttcttcattgttactgtgttattttctgcctattgaccattttataaaaacattcccatatattgataaggttattgtatttgtcatttttaatagctaaataatcttttagcttgttaacctgtcatacttagacattttattcagggcctctttatctatataaatatatttaaaatggaattgacacattcctgacacaatggcctgccaacaccttgctatttcctcagttgccacccatcattacagtatctcagttttctagaaaaatttagtgatggttctttgtatccttctccagtggagagggaattgttacttttgatccattcctgtgtggctatactgcagagaaatggcaaaaggaccgaatcaaagttaataattattttaggaacaaatcaataatagaagatatgccagaaacctacctcttagagttatttatataatttctccagtgaaatctggttggttattttgtcattgtgtggcacgtgcatgtgttgtttgtgtgagagggagagagattatatttgtcatcacttgtttgatagtatcatctttaatgtactctgtctttaatttcttcattatagaatagcacatgtggatatcatt

SEQ ID NO: 380 - DNA, 1199 bp, Homo sapiens
gtgtgccaccacacccggctaatttttgtatttttagtagagatggagttttaccatgtcggccaggctggggaggtcaaattcctgacctcaagtgatctacctgcctcagcctcccaaattgctgggattgcaggtgtgagccaccactgccagccaggatacattttcagataacagcaaggtaaataatgaggtaagggtgaaagtactgtactttgggcttactttggatttttgaggaactagtctggaaactaaaccactatttaaaacatttttctatagaaaaagcattctaaattctaaacagagacactttggaatgtggcccatttaaattgaggactgtctatacttaaatatatatacatcgtaatggattctatatctcttaattcctctactggctttgaccttttctgcatgtgttccaatattagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtaagggatgagctttggataggagagtctcaggactgaagttgaaacactggaagatgagcaaatagaagataatagaagagaggagaaaccattgtcactaactccatatttctaactgcctgagttggctattaaagaaaaaaatgcaacattgttagtatcatagatgttccctatgtgctacaccctgattgtattactttgctttcctcattctgtgtaacccctattttggggtattccatcaaagagtggaattgccaggacttatagtgagtgtatgttctgttattagaatataaaaaatacagttggtttttgtgtattgatcttgtagcccgcaaccgcattaaactcacatagttctagaagctttttgttgattccttaggattttctttttttttttttttttttttttttttgagatggagtctcgctctgttgcccaggctggagtgcagtggcgcaatctcagctcactgcaacctctgcctcctgggttcaagcaattctctgcttcgacctcccaactagctgggattacaggcaaaccccctgccccaccaccacacccagctaatttttgtatttttagtag

SEQ ID NO: 381 - DNA, 1347 bp, Homo sapiens
acaagttcataactggaaaggtgaagccctgttcccattgtgtaggccttactactctctacaacttcctgaactcccatcttgccagtaactctctaaaaaactagtgtggagccctgggtataacaggaacaagccctcagagagaagcagtacttaggggtttgaggatctcatgtaataacccttcttgtcccttttccacagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgcagttatgtaatattttcttttttaa

SEQ ID NO: 382 - DNA, 1205 bp, Homo sapiens
tcttctttaagaaaaactttttttttatttcaggttctgccatcttgaaacccccattctgtttccagcccagaagaaatgctgcccctaccagatccctccttgaaccagtgatctaaggacccctcttttccctatctgcctaacagtgcctcacaaggcttgggggctggactccctctactccctctggccatagcccctcctggagatggggtcaaggcagcaggactgatcaagtgactactggttagccagaggagctcagctgaagccctggaaaccctcaggtctgagataggagttctctaggaacctggaatgagttcctgtctcctgaatgatggtctgggtgccacctgtttttaaactcttaaacctggaactccttaaatggggtaggtgggtgagattatcaaagctgaagctggctttgctgagaagctccctacctccctgcccttctcctccttcctgctggaatgaactaaagcagatgtcaagcaggggctggtgggggtgcctactcccttttccactctatctttagatttcaaaccttaggcttacagcccctcaatatctctctgctaacaccagtgtctctttctagttaggcctctaatcttctgtttctgtttaccagcttcccagcaactttccttttttaaaatattaaaaatttaattcaggttctcttaattatcctcatcctgctgttgcctccgcccttaactctatccctattaggaaccttgtttcccaccgaataagagttaaggtaagaggtagctcttcacctgatgacattccatttaagttttggggcatctttcctgccctctgccaacctccctgctggcccaggtgagaggaggaagaggggtctggaaagaaacccagaatgcggcagaactaggagtaagtccatctcaaggtggacttctgatcattgaggatggtgagataaataggttgaaaacaatcatctgtgagtttaggagtcttaagatcctcacagcacgggagcagggagaggctctagaacaaggtttcacaaccgagatgcctttgacattttgggctgaagtgttctttgtaaggaaaacctgtttcctattttgtgcattacaggatatttagcagcaaccctggcccactctagttatgacaaccaaaaatgtctctatacattgccagatttc

SEQ ID NO: 383 - DNA, 1357 bp, Homo sapiens
cgatcttggttccatgcaacctccgcctcctggcttcaagtgattctcctgcctcaacctcctgagtagctgtgattacaggcatccgccaccacgcccggctaatttttgtatttttagtagagacagggtttcaccttgttagtcaggctggtctcgaactcctgacctcgtcatctgcctgcctcagcctcccaaagtgctggaattacaggtgtgagccactgcacccagcctgatttccttctttctgtatctgttgtcttctctcctcagctctttgtgtttttccttgtcttttgtcctcagacttgatcctgctccctcggtgtctgcattgactcctcatgctgggactggacccgtcaacccccctgctcgctgctcacgtaccttcatcacttttagtgatgatgcaactttcgaggaatggttcccccaagggcggcccccaaaagtccctgttcgtgaggtctgtccagtgacccatcgtccagccctataccgggaccctgttacagacataccctatgccactgctcgagccttcaagatcattcgtgaggcttacaagaagtacattactgcccatggactgccgcccactgcctcagccctgggccccggcccgccacctcctgagcccctccctggctctgggccccgagccttgcgccagaaaattgtcattaaatgaagagatgtctagtcctcagaaacttctttcctgccctgattggggctcttgctgttccgtttcttctccctgcttctcccctttgtcatctctgatctttgcctaatctgtttctttttccttttcccctagttcttacaggtttcgttgtgttttttaatctaataaaatagaaagatcccttttgtctggtgtccagtctagggttgggagcaagaagtatttgaatacctgcatatatttgggtctttattcgatagcatttattatgagctgtcctttctaaattgtattcattcctccaactaaattataaacatctgaaaattgcacaccaaaacacatccttgtattgaccttcctatcactttacactcactgttttgaatacagcaggcaccaaataaggaggaactggctgattctagtcgaactcatatgtctcagactggggcttgtatgaagggaagtggaagagatgccatggctgttaatgaccactagaggctctcagggctgggcagggtatgggggctgtgtatatgtgatctcccactaccccccacctggccagagctaaaataataaaatgctgagctcactgttcccccaccctctcccccggcaccgggctcctcctgctgctgggacagtgctcta

SEQ ID NO: 384 - DNA, 1357 bp, Homo sapiens; identical to SEQ ID NO: 383

SEQ ID NO: 385 - DNA, 1183 bp, Homo sapiens
ctttgggaggcctaggtgggcggaccacctgaggtcaagagttcgagaccagcctgaccaacatggtgaaaccccgtctctactaaaaatataaaattagctgggtgtagtggcgcatgcctgtaatcctagctacccaggaggctgaggcatgggaatcacttgaactctggaggtggaggttgcagtgagccaagatcgcgccattgcacttcagcctgggcaacaagagcgaaactccatctcaaaaaaaaaaaaaaaaaggaattatgcaatagggtacatttcatctgatggaagtaaagcagtcatcaaggctccatgttggggggttaggtgtggatatgtttcctttcttctaggttttcatgcctcttggaaagtgaagtgagctaacaccttgttctctgaatagtaattcataggcctgtctttgttgacattagccttttcacttttcagaccaactttgggtgtgtgttggggatactagcaattatttgtatctatgtcttggtaatagttgctaaggtagttgctaagtaggctctctctttcccttttgaagtgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggtcagcgctagggctggggtccccatgtgattgggtactccctcccttccttctgagcctttatcttgtctggccaggacctctgctcccatttctatccaggaagcctagctgctacatatttttccttgtatttactgtaccccatcttctctatcttttttccaggcgttcaccttggtcgtcctgatgttttacctcagactccacctttggaggaaatcagtgagggctcgcctattcctgaccccagtttctcacctctagttggagagactttgcaaatgctaactacaaggttggtttattggcccctttctccatataatcttatctctcttttcaagtccttggaaacctctataatttgattgcatcataataaattaccccaaagattagtggcttaaaataacaaacatatatcatactttctgtgggtcaggaatccaggcccagcttagctgg

SEQ ID NO: 386 - DNA, 1223 bp, Homo sapiens
tgtctttggagggcttattttttcactgagctaactatttttgttgtttcattttccataggactcacttggatagctcactcaaggtaacaaaaactcacctcacaatttaatttctggtttgcagtgtgtttactctgttattattattattattatcatattattgtttcaatttcctagttgaactgagatttctcctcttctctttgctcctcacccctttaggcatggccagactcgtgaccgagtgcatgaccggaacgtgaagaatatgtaccctcctccttccttccccactaacaaagctgccactgtgaaatctgcgggggccaccccagctgagcctgaagagctactaactcccttagccccagcactcccatcaccagcctcaactgcaaccccaccaccaacccccactcacccgcaggctttagcccttccaccgctggctacagagggagccgaatgtctgaatgttgatgatcaggatgaagggagcccagtcacccaagaacctgagctagcatcaggtggtggtggtagtggtggagttggcaaaaaggagcagctgtctgtgaagaagcttcgagtagtactgtttgctctatgctgcaatacagaacaggcagctgaacacttccgaaatccccagcgacgtattcgccgttggcttcgacgtttccaggcctcccagggggagaatctagagggcaaatatctgagctttgaggcagaagagaaactggctgagtgggtgctaacccagcgcgaacaacagctacctgtaaatgaggagaccttgttccagaaggccaccaaaataggacgttctttggaaggggggtttaagatctcctatgagtgggctgtgcgtttcatgctgcggcaccacctgactccccatgcccggcgagctgtggcccacaccctacctaaggatgtagcagagaatgcaggactcttcattgattttgtacaacggcagattcacaaccaggacttacccttgtctatgattgtggctattgatgagatctctttgttcctggatacagaggtgctgagcagtgatgatcgaaaggagaatgccctgcagacagtgggcacaggggaaccttggtgtgatgtagtcctagccattctggcagatggcactgtccttcccaccctggttttctacagagggcagatggatcagcctgctaacatgccagact

SEQ ID NO: 387 - DNA, 1137 bp, Homo sapiens
ctgaaaataagagaatttaagtaagttgatcccttagatctttttctttcctcaccccctttgtggctttggtttagaaagacagaaataattaaaatagaagattaaagaccagttagaatccagttaagcactttacccattaaaacccagagtgcccctggctatagctgactcactggggcactgcaagattgttttcaattttcaagcgaaacaatgccatctgttgggcttcttgcaaactgctactgtcaggatgtatagccctaactaaatactcaataaacagaatggttaggttggttgtttggttttggttttcgcttatggatgtagcagcagaattactaagacactaaggacacttagagccttacagtaaaggctttgtttgaacattgagcagtaatagtactcccgttccaacacagagaaactgacccttagtaaactgttattggagggcagaatagcattaactctttgtttgcaatgcagagatacagactttatttatttgtttttatttatttttattttttttgagatggactttcgctgttgttgcccaggctggagtgcagtggcgtgaattgtggctcattgcaacctccactcccatgttcaagcgattctccagcctcagcctcccgagtagccgggattacaggcatgcaccaccacgcccggctaattttatgtttttagtagagatgggttttctccatgttggtcaggctgatctcaaactcccgatctcaggtgatccgacctcaggtgatccgcccacctcggcctcccaaagtgctgggattacaggcgtgagccactgcacccggctcagactttaattttttaaagggacatgtaatttaggcagtgttttcaaattaagggttgactccgaaatcacagtggaatggcctccaggatttcctagactagacgtacaaggtagtagtaggactgggactagagtatgacaagtaaggttctcatcttagatgcaaaatttaaaggagtacagagaggttcagtaatcataataaatgcattttaatgcatcattttaaaagatcaatattaatgcagaacaatccataatgaacagaatatctattttaaataaagact

SEQ ID NO: 388 - DNA, 1208 bp, Homo sapiens
tggtcctgggaataaatcaagaaattcaaccaacaaggctaccagttatttagtaaataccaaagagataggtggaatgtagcagtacagaatatcacagctaagatatgagtaggtagttccactccctcctaccccacctcagtttttattaagaaaatttcacgcatgcgaaaagggagaaagaggctgggcgcagtggctcacacctgtaaccgaagcactttgggaggccaagatgggcggatcacaaggtcaggagttcaagaccagcctgaccaacatggtgaaacctgtctctactaaaaatacaaaaattagctgggcgttgtggcgcatgcatgtaatcccagctactcaggaggctgaggcaggaaaatcacttgaacctgggaggtggaggttgcagtgagccaagatcactccagcctgggcaactgagcgagactccatcacaaaaagaagaaaaaagaaaagggtgaaagaattctacaaggaacacttaaactatccaccacctagacagagtgactttttttttttaagacagagtctcgctctgttgcctagactagagtgcagtggcacaatcttggctcactgcaacctctgcctcccgaattcaagcgattatcctgcctcagccttccgagtagctgggactgcaggcaccagccaccacgcatggctaatttttgtatttttagtagagacggggtttcactgtgttggccaggctggtctcgaactcctgtccttgtgatccgcctgcattggcctcccaaagtgctgggattacaggcgtgagccactgcgcctggtgacaggatgatttttaatgttttggcccatgccaaatattttttgaaagttggcatactagtatctataagaaaatatcaaaatagcccacctgtagtgacaactacttgggaggctgaggcaggaggatcacctgagcccaggaggttgaggctgcaataagccgtgattgtgccactgcactccagcctgggggatagaatgacaccctgtctcaaaaaaaaaagccaaatatctatgtatttgcttaaccccttgaaagtcactttcaagatatttctattaaatattttgtgcatttcctaggaataaatacattctcctacatgaatataatatgattatcctttctgtttaaaaattttttagagggatcggttctgttt

SEQ ID NO: 389 - DNA, 2230 bp, Homo sapiens
cgtgagaatgctgaatgtgtaaagttgcagagggatccctaatttgaagactttgacacagaactaacttcttttgacttaaatgaatttaaaatgagccaaaggaccctgaaaagaagacatgttgatttcccactcctagatgctaaagagacttggcaccagctttgttcaaactgtaaaaatagcaatttgcccctactcgctcagagtgggacagtagtgaacagagctgggattccatgcgacagcttgaatgctgaccttcagacatgagacatagggatttggaggccccttagaatgggtagatggtgttatgttccctttctggcatagcattcacttggtgctttggagattaggtgagggccctataggtagttggcctgttggcagaatttatttaggaacagcccttttgaaagtgtcccagtaacaacgcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaacacttctttggtttcctagactacaaatcctttgggttgtgtgggaagaagtgaactgggacctttgagatttgagtcagagtggtcagtctgaaaagaagaaacatctaaccagttttcccaggtaactagtgtggcagttttttgagtgcagggaatggagaagggtgaggaaagaagccacaggaggcccttggtttgcagttctcttcccagtggctcctttgaaa

SEQ ID NO: 390 - DNA, 1400 bp, Homo sapiens
tcgtgtgctctttagtcatcagtgataaggcctttttatttatttttggcttgggccttgccacttatagaaatgatgtcactattgtgatttgctcattttacgtattgttctttgtagattctcgggattcgaagatggctgcacagtcagcgccgaaagttgtgctaaaaagcaccaccaagatgtctctaaatgagcggtgaggcagccaacagcaacttcaactccttcctaagaaaacattacttaacttggccctggggtccaatgcacaaagccaattttaagctaaataccaacagaaggctacagacctctgttcttagttgcatctcatgtggtacacaaaacaaattgggcggttgtttcaaaaccccttatcagtagacttttatgttaagctgtctgaagtatttatttggtgggatgtattttaaaagactcctaacactcttccttttcacatttttttacgttgatactggggtcgtgcagcacggtagcatggtaccctggctacagtaggcttgctgcccagtccaaggccagcagtgttgtgtctggcctgtaagaggcaggtagcaagccatgaatatgtccaaaggcccttgaatgtcattcttgggccttgtaagaggcactcgctttgctccatttcactttctttccattctgcttttagtttggttttgttttggattcttctacagttaagtgttcttctcttccattccattatacttccttgacagaaataatgagtctcttcacaggctcataaatgatcaaactgatgtaactttgaaaagtaactacttggagtcagaaaaagtgatgattggagactaagaaaagtaaagatattcaaaggcagtttctatctctgacaactttgttcattaagagtgcctttgtttaggcgcggtggctcatgcctgtaatcccagcactttggcaggctgaggcgggcggatcacgaggtcaggagtttgagatcagcctgcccaacatggtgaaaccctgtctctactaaaaatagaaaaattagctgggcgtggtggcgtgtgcctataatcccagctactcaggaggctgaggtaggagaatcacttgaacccgtgaggcgaaggttgcagtgagccaagatcctgccactgcactccagccagggcaacagaggacagagtgaggctccgtttcaaaaaaaagaatgcctttgatcagtgatttcattaagttgactttcgaccactgaaatttacttaatgtctatttttgcctcttctgaggcatatgtgcttctctccttatctctttggctatgataagctaattatttatgtttgcataatatttatgtttgcatgttagtgacatatattttaaaatgtgataca

SEQ ID NO: 391 - DNA, 1236 bp, Homo sapiens
cgtggatgctgttaaacatcctacatccccatcaccccaaagatttgtctagcccaaaatgttattaactgccactgacctgaaaaaccctgctgtagaaagaggatatgagtacaggaggggtcctgttccctgagtcttccaatttttctgcccaggccttggctttctcttataaaagtatatattctattacttacccttgcttcagccttggatatgggacagaaatgagagtgcaaagtagcttagagatacatagaaagtctaggcaaataaattattataacattatgtcattttctgtcaattagtggaagctgttgctgccctggggaacaaagtcgtggaaagcctaagagcacaggatccttctgaaggtttgcatttgttgctgattctgtatttagtagccataggaaccaggtcttgtaattgtaagtacactttcaacaaaatcagatcagaccagatggaagagtaaatgcagagttttatgttgtgggagtttttggcaggggcttcaggtgttcaaggtgttcaagggagatctgtttgatctcccttctaaagctctgtattctaaattctcattctggactttgtgctgttttaaaaaatccacctgttcccccccaccctggatttaactttgatcatctaatggaaatgtgagttatagtttttgtttattctgttttttcagttttaaccatgctgaccaacgaaactggctttgaaatcagttcttctgatgctacagtgaagattctcattacaacagtgccacccaatcttcgaaaactggatccagaactccattgttagttcttttttttccattgctggaaaatttaggggatattcaaaacatggtattgttgctgtttagtttacttagcttgttgctattccacatgcagcttcctgggaattgaagaacttaggtttattctgaactttgctctctccctctgtaatttggaaatagtttatcagcttgctagtggaattttcagatggggtgaccaagaaagcatttggaggacttaaaaaggactgagaaaatatttatggagggggataggcttttgaagaaaacagatcttgcatgtttctagtgatttttagacaagtgatttgctgatatgagaaacacagggtggcttaaagaattgcagagttggtcgggtgcggtggctcacgcctgtaatcccagcactttgggaggctgag

SEQ ID NO: 392 - DNA, 1181 bp, Homo sapiens
tgtcagagaaaccagaagcttgacggtgaatcctcgggttttaaggagagagcaaagtcctgagagggcgacgtattgtccctgctcacctagcccagaatgaacaaacacgcgccagccagggagcagcgagccgagaattcggacgagcctctgcaaccgccatttgccgttctcgcaaagactaccaagaccacaatgcaacggggcgccgagctaattcccagtgagcagcaggcgaggcgccaccgacgcggaagactataagccccagcgggcgacgaccgaacgcccccgggaacaccgggccccgagctcggtcccgcgcccgaggatcctccacggggctagatggctgcgtcgggggcgggagcggaggtgagcgggcgctagggccgcgagcccccgccggcccttcctccagcgccctgcggaccccgcagaaggcgctcgcctccctagcccgcaaaaacatatcgatttttctcgctgtggcaacggggacgtcctgatagatcctctgctccaataggcaactccggccttccctgccctgacctggaacctctgggagggctgcagagtaagtgccgcctctgcgctccgacggaggcacgaggcctgtggagtaggtccctctgttccgacaggtgcgacacttggcgctccatgcttgcgggtgccgggaggcctggcctcccccagggccgccacctctgctggttgctctgtgctttcaccttaaagctctggtaaggaggaggtaaggggagggaaaaggaggtcactggaggacaggatcgttcccggcctcggggctgggggagatcttatccatggacagcgcaggagggggtgccctattttctgggttttgacttttgtcccttcccccaactccgctacagccaagcagaggctcccgtgcaggaagagaagctgtcaggtgggtgattgtctgggaacccgacacgtcccgtcgtttgtttttggttttagtatcttccccatataccaagagcacaggtggaaaaggccggcaccacatggaatgagggcaagcgctgtgccgggaagttggatgggcagagcctgggagaaatgttttctgaatggcctggggctggcatttatctttcctttcagcaagcacctcaaatttgccatgctggctggtggaa

SEQ ID NO: 393 - DNA, 1316 bp, Homo sapiens
cttgcaacctctgcctcctgggttcaagtgattctcttgcctcagcctcccgagtagctgggattacaggcacccgccaccactcccagctaatttttgtatttttagtagagacagggtttcaccatgttggccaggctggtctcgaactcctgacctcaaacaatccacctgcctgggcctcccaaagtgctgggattacaggcgtgagccaccgcgctcagcctcttgtatttctaagctactagatggggttttagtaactagtttacaaaataggacagataggacacaaataactatttgtgactattgctgcatttatggcctgggataagccctgatttctttgattagtcctcattctgtcaatgacctcccctctctgttcttcagggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattat

SEQ ID NO: 394 - DNA, 1477 bp, Homo sapiens
tagcacttcgagaagccgaggcggacggatcacttgaggtcaggagttcgagaccagcctggccaacatgacaaaaccccgtgtctactaaaaacacaaaaattagccaggcatggtggcgcgcgcctgtagtcccagctactctgaggcaagagaattgctttaacccaggagtcggatgttgaagtgggctgagattgcaccattgcattccagcctgggtgacagagcaagactcccatctcaaaaaaaaaaaaaaaaaaaagatgtaatccagtgattgtcacctatagaaatgagattaagccccaaaagagggcctgcttatatgagtttctgatttttacagtcctcattcatggtgctagtgcaggacaatagcatttccttgagattcattagcatctctggcttcatatactgggtttcctcttgcagatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcagcagaaactgaaacagcagaagaaaaaagcctccttgacttctaaggtacttaaacttttaggtagataccattttatggcaaggggtgtggggcttgagaattgagattaaaagggtaagtttggaaatttaaagggaagggttttttttagtctttagtaaggttgtattaaagccattactttctcttctccttcaactttatagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccaggtagaggaaacattaaccataagacctctcttattaacctttactacttttttaatctgtgggagatttctagaactctggagaggccaagcccctctgcatggctgagggggaaagtagtcagtcatagcatttttagtgctttaaaatattgttattagggttatctgtaactaaacaggtagaaatatgccccttaggggctgggtgtgatggctgacacttataatcccagcactttgggtggccaaggcaggaggattgcttgaggccaggagttcaagaccagcctgggcaacataatgagtccctgtctctacaaaaaaaatttttttttaaacacagagtttcactctgttgcttaggctggaatgcagtggtgcgatctcggcttactgcaacctctgccacccgggttcaagcgat

SEQ ID NO: 395 - DNA, 1206 bp, Homo sapiens
ttgtcttatttttcctgacctatgatgctgatctcttttcttcttctctcttccactgctcccccttttgaagcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggtagccttgcataagcagatggcattcctctgggatggaggaggtaagtaattgtgtgatgggataaaaatgtaatttctcttttaggaaaagctcctcccaacctccctcctggggtcccgccgttgttgcctaatccgtatattatggctccagggctgttacatgcctacccggtaagtgggactaaaggatcttcttcaaaaggtgaggatgttgtggctactctttttatagctctggcttcagatggacccctgtgaataccaaaacttgcacatactcaagccctgcagttggctctgtggaatccatgtatatgagttttgcattctgtaaatgtggccgtatttttgatctgtgtgtctggttggaaaaaattcatatataaacagcgtgcagttcaaacctgtgttaagggtcaactgtaattaaaatataaaataaatgagggattgccacatgtaatcaaactggtttttaatctttgcagttttggaaaaaatactaaactgaggccaacccatctattgtgtatctgctttggtttatggtgcacacatgtatgcatgtgtgtgtgtgcgtacaatgtgtatgtatatgtgtgatgagaatatctgccctgtttgaaacacagcttctgggcctcagaagccaaaggccagaatgttcatctggaatcctttttggtttcttagataattatgactattattttattttttgaggcagatcttgctcttttacccaggttggagtacagtggaacgatcatagctagctcactgcagccttgaactcctgggctcaagcaatcctctcacctcagactccccaagtagctaggactacaggtgtgcatccccatgcctggctaagttttaaaaatttttttagagacagggtcttcctatgttgcctaggctggtctcaaaat

SEQ ID NO: 396 - DNA, 1269 bp, Homo sapiens
tattagaatatagggatttgggggagggtttccaacagaagataacttttttttttgagacagagtctttctctgtcgctcaagctggagtgcagtggtgtgatcttggctcattgcaacctccgccgcctgggttaaagcaattgtctgcctcagccttccgagtagctgggattaaaggtgcccaccaccacccccagctaattttttttgtatttttagtagaggcggggtttcaccatcttggccaagctggtcttgaactcctgaccttatgatccacccgcctctgcctccctaagtgctgagcttataggcatgagccgccgcacccagccttttttttttctttttttaaatcagagttgtggcatcttagtaaatacattttaacctattctatagcccagtaaagtactctggagcactcagggtgctttctgtttgtcccagacactttaaattatcgaatgatctgttttctcagtagaataagcttggtataaactgatagggatgacacctagagggttgaaaatattggtcctcgtggactttgatgtattctcaagtgggcatacccgtagaccttgtctgactgtgctcatggccaggcaggggggacagtgtatgcaagagtaatgtggagtttgtgctaactctagccagcttaattagtgactggataaattgcacaactctcacattcttctgttttttcctccgtggaaatagtactcatgctggggaatgagtgacattgaatctctgctcttttttcccctcttttctaggattactacagcatcccatttcccacacccactactccgctgactgggagggatggtagcctggccagcaacccttattctggtaggattgggatgggactaaataaataaaaagggagatagtgttgggattgatggcagacacctgattggtagcaagaagggatgtgataaatcaggattggtagattcaaaatcctgctaaagttgggcatgtcatggcttttcctattcatcccactttgtgttgtctccctgtgatttctagatgatatcttagccaggcatggtagcacacacttgtagtctcagctacttgggaggccaaggtgggagaattgcttgagcccaggagttcaagaccagcctgggcaacatagcaagaccccatctccaaaaaaagtgatatcttgacttagtttcaagccatttgctagctttttccaggaaatacagtggttgaggtggtcttctc

SEQ ID NO: 397 - DNA, 2437 bp, Homo sapiens
agtgtatcactttctccggcagctgggaagtctagaaccagccagactgggttaagggagctgctcaagcaatagcagaggtttcacccggcaggatgacacagaccacttcccagggagcacgggcatgccttggaatattgccaagcttccagctgcctcttctcctaaagcattcctaggaatattttccccgccaatgctgggcgtacaccctagccaacgggacaaatcctagagggtataaaatcatctctgctcagataatcatgacttagcaagaataagggcaaaaaatcctgttggcttaacgtcactgttccacccggtgtaatatctctcatgacagtgacaccaagggaagttgactaagtcacatgtaaattaggagtgttttaaagaatgccatagatgttgattcttaactgctacagataacctgtaattgagcagatttaaaattcaggcatacttttccatttatccaagtgctttcatttttccagatggcttcagaagtaggctcgtgggcagggcgcagacctgatctttatagggttgacatagaaagcagtagttgtgggtgaaagggcaggttgtcttcaaactctgtgaggtagaatcctttgtctatacctccatgaacattgactcgtgtgttcagagcctttggcctctctgtggagtctggctctctggctcctgtgcattctttgaatagtcactcgtaaaaactgtcagtgcttgaaactgtttcctttactcatgttgaagggactttgttggcttttagagtgttggtcatgactccaagagcagagcagggaagagcccaagcatagacttggtgccgtggtgatggctgcagtccagttttgtgatgctgcttttacgtgtccctcgataacagtcagctagacacactcaggaggactactgaggctctgcgaccttcaggagctgagcctgcctctctcctttagatgacagaccttcatctgggaacgtgctgagccagcaccctcagatgatttccctccaaactgctgactaggtcatcctctgtctggtagagacattcacatctttgcttttattctatgctctctgtacttttgaccaaaaattgaccaaagtaagaaaatgcaagttctaaaaatagactaaggatgcctttgcagaacaccaaagcatcccaaggaactggtagggaagtggcgcctgtctcctggagtggaagaggcctgctccctggctctgggtctgctgggggcacagtaaatcagtcttggcacccacatccagggcagagaggtctgtggttctcagcatcagaaggcagcgcagcccctctcctcttcaggctacagggttgtcacctgctgagtcctcaggttgtttggcctctctggtccatcttgggcattaggttctccagcagagctctggccagctgcctcttctttaactgggaacacaggctctcacaagatcagaacccccactcacccccaagatcttatctagcaagcctgtagtattcagtttctgttgtaggaagagagcgaggcatccctgaattccacgcatctgctggaaacgagccgtgtcagatcgcacatccctgcgcccccatgcccctctgagtcacacaggacagaggaggcagagcttctgcccactgttatcttcactttctttgtccagtcttttgtttttaataagcagtgaccctccctactcttctttttaatgatttttgtagttgatttgtctgaactgtggctactgtgcattccttgaataatcacttgtaaaaattgtcagtgcttgaagctgtttcctttactcacattgaagggacttcgttggttttttggagtcttggttgtgactccaagagcagagtgaggaagacccccaagcatagactcgggtactgtgatgatggctgcagtccagttttatgattctgcttttatgtgtcccttgataacagtgacttaacaatatacattcctcataaataaaaaaaaaacaagaatctgaattcttagaaagttttaagtcctggtttcttgggggaggtgaaaatgggaacaaagggacctgtggccctggggtttctgataacagcaccagtggcatctgacatgaacctgtgggggacagggctgtccctcagcctttggaaaggagccatttcaaagaacctccctttgtgggtaaatttgcgtctgggtggggtggggttcatcaggcaccttttgattacgtacccagcagggcccttccccagcagagcccacgattgattgattgattgattgattgattgattgatttagagatggagtatcactctgtctctcaagctggagtgcagtggcgcgatctcggctcactgcaagctccgcctcccgggttcacgccattc

SEQ ID NO: 398 - DNA, 1199 bp, Homo sapiens
gcaagtggacatcaggggtgtccccaggggcgtgcatctcagaagtcaggggctccagagagggttccagcatccttcaccacgtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatg

SEQ ID NO: 399 - DNA, 1178 bp, Homo sapiens
tttggaaattccgagcgttttgggaactgtgcctaaaccaggataaagaccaagtacattatttcttattataaatcactatatctcaggcagcgatttgcagaggaggaaagtgaggccaagagagtcaaagtgtcttagccagggcttcccaggtagactgaatccagctctccctactccacatacagggctcttgccacatagcaaggcccctaaagagcatgctgaggtggtcaggctgacctgagcccagcagcctgccccagcctgccccacctgtcctgcctggaccctgctgtgggcttcctggtcctggccacactaatggactttctgctcccaccagctcttcgtgatcgacaatggcgcggatgactggcggatagccatgacctacgagcgcatcctgtacatcagcctggagatgctggtgtgcgccatccaccccattcctggcgagtacaagttcttctggacggcacgcctggccttctcctacacaccctcccgggcggaggccgatgtggacatcatcctgtctatccccatgttcctgcgcctgtacctgatcgcccgagtcatgctgctgcacagcaagctcttcaccgatgcctcgtcccgcagcatcggggccctcaacaagatcaacttcaacacccgctttgtcatgaagacgctcatgaccatctgccctggcactgtgctgctcgtgttcagcatctctctgtggatcattgctgcctggaccgtccgtgtctgtgaaaggtattccacatggggctttctgagtacagagcctgtgctgggacagggaagggaggaggagtaggggtgccaggaagtatgtggtctgatggaggagacaggcatgtacccagacacctgaaaggagacaatgggaaagaggggagtgctgagttggggttcagtatgagctagaattgcagcattggaaccaaagtaaggtgggaaaaaggcacagaattttcctgattttctgttccttctttgcaaaccaatatatcaaagcattctggttacatcagtaactcacatataacacattgcaacttactcctcttgggtattaataatgcttattagcattttaaaggctctgagaagtcctgaagtaatgaaaccatttatttttgtttggttcagcctttcttaat

SEQ ID NO: 400 - DNA, 1199 bp, Homo sapiens
gccagtccctcacccagctttcccaccctggatgccaaagttgaggagctggaaaggacagatttctccccagccaaaatcacaaggaagggattcctggccctatgtctctttgctcttctcccctgcctgaagcattgcagtctaggagaaacccttcccatgagcctcagagttcacaagcaacaattgttctgagcttctcaccttcctgagctccagaccctcacctccaaccgcccctgggactcctcattctagaagttccactggtttctcaaatgcaacatgtctgcagcagatactattcactgcttacccaaaagccatgtaatccctgcttctaggctgatagaactccagtgtctttgggaagcagaacagattcaggggtggataggtccctgccccagccccagtcagagcactcccttctcctttgtagatatgggtgtagcaacggacatgtggacacacgaactggttctgttccttgtctgggaagttgctagaaaagattttcttcccagataaaaagagagccttgggctggtcccagataaaaagagagccttgggctggtcagaaggtagtgagttatctcaattgttcacagtcagttacagattgaactccctgctctactcttttctcccttctcacagctgcatttgactaggctttaaaaagggagaggggttccgggcgccgtggctcacgcctgtaatcccagtactttgggaggccaaggtgggcggatcacgagatcaggagttcgagaccagcctgaccaacacagtgaaacccagtctctattaaaaacacaaaaaaattacctgggcttggtagcgtgcgcctgtaatcccagctactcaggaggctgaggcgggagaattgcttgaacccaggagttggaggttgcagtgagccgagatcacgccactgcactccagcctcggcaacagggcaagactccgactcaaaaaaaaaaaagagagagggagagcaccatgggaggataggaccgctttgctcccactccttcttcttggggctcctgtagcttgaatggagctctctggctgaagcagccatcttgtgaccatggtcctgaggacagcagggcgtggggaagcactggaacttcggtgacactgttgagttcctgtctcacttccagactgcttgttatgggggga

SEQ ID NO: 401 - DNA, 1244 bp, Homo sapiens
ctgcacctgcccactccctgggggacctaaagggcagctggccaggtcggggcctggtcactcgtttcctccagatatccaggaaagccccagaccccagtgggactggagctcatggacataagcaggtaggaattcggggagccaggaaagatgtttgggaaagcgtggagcttcagattgagccttattgatgatgccctttcttgtgtccctgtccaggtgccccggagcctgtggggccggcctggccgagagagcctccaccttcgcagctgcggagatctgagctctagctcttccctgcggcgtctcctgtctggccgcaggctggagcgtggtacccgcccccacagcctcagcctcaacgggggcagccgggagactgggctctgacctaggcttcttgtcacactgaacacatccagccacaggcaccagctggttgggaccagcagcccccagcatcctcttgcactggctggcacaaaaagaaacctgctgtataccccccaaagtgtccctttccctcctacctctggggtctcttgctgcttgcctctgctgctctggactgggagagcttctgtcctgtgctgcatgggtatttagactgtgggggagatgccccttcttatagcactggaggaggaaaacaaattcttgtccccctcagaatgagagtggctctttctgatttgcaagggcactatggtcagggcaaaggcatggcccaggtgtttaagtacagggtgacgtgtgcctatgcaatggggtggtaaggcaggcacgaagagtccaaaaaatctaggtggcctctcagctctgccacctctagctgcatgaccttgggcaagctatgtaaccccaattgcctgctccattaaagactgtgaaggtagaatgtttgtaaagctcttaacagtatgtaagccttcaataaatttcagttttccccttgttttcttgatcattctctgtcaccagtgaaatttgttctagtgtctctcatatttaagaaaactctttcaggactgggtatggtggctcacacctataatcctagcactttgggaggccgaagcaagaggatcgcctgagcctaggaattcaagaccagcctgggcaacatagtgagaccctgtctctacaaaaaacaaaaaattagccaggcatggtgggacacgcctgtagtcccaactactcaggtggctaaggtgagaggatcacttgagcttgggaag

SEQ ID NO: 402 - DNA, 1189 bp, Homo sapiens
gggactctgtccgtggcagaggagtactcatgagggtcccagccctgagtctgcaccctgttttccccagatctccttcttctccttgctttcggtgctctgtgtcatgcttagcatggctggctctgttctctcctgtaagaatgctcaactggcccgagacttccaacagtgctctctggtgagatttgaggagggagagctggaaagaactggctgggggaggtgtgcaggacacctcagtttgtcctgactcaggctgcctcaccctccctgctccactcaggaaggaaaggtctgtgtgtgctgtccctctgttcccctcctccggccctgtccagagtcggggcaggaactgaaagttgcccctaactccacctgtgatgaagcccgaggggccctcaaggtgagcttgcaccctgcaaacatcctcctggttctcactcttgcctcccctgctggggtactcacaggcccataatgtgtggaacttagccgtctcctgactcctctcctcctttcccttccccagaacctgctcttcagcgtctgtgggctcaccatttgtgccgctataatctgtacactctctgctattgtctgctgcatccaaatcttctccctggacctcgtgcatacggtgagaagggagcaggggccagggcacgcaggtatggtgggggcaggggtgtgtgtgctgagacttgcctgagggaacaatggctacagatctggcttttgagcaccaggggctatgggttatctattatcctcatctattggaggaatggatgtttagtggggaggatgagaaggggagatggcagggagtgagttaagtatgtgatgctggtctgggaccaggagagggtgctttagagaatgggactggatggtggggtagagtcaagaaggtcctatgctgggcacggtggctcattcctgtaatcccagcactttgagaggcccaggcaggcggatcacctgaggccaggagttcaagacccacctggccaacatggcgaaaccctgtctctattaaaaatacaaaaatcgggccgggcgcagtggctcgtgcctataatcccagcactttgggaggctgaggagggcagatcacctgagatcaggagatcgagactatcctggctaacatggtgaaaccccatctctactaaacatacaaaaa

SEQ ID NO: 403 - DNA, 1181 bp, Homo sapiens
cttctctggtcccttggtcctctcagtgactcaacaagtgtctgagaacagttttctagcattactctttgtcctcactaaggcaggaccttgtcacagggtatggtagggaatgtgatctgaacagatacacctcattggtatttgttatccaacagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcggtgagtgccagcccaggcccttcctctccccactcttctgcaggccctctaggactctggtaagtgagcagtatccttgttctcagctgaacattggggcatgaacactgaggtgggcactgagtttgcctactttcttggaagctctccgactcttgaagggccctggatctgctttggagatggatgggcacggagcatttgtgacccccagtgctctccctggcatgttgggcttattgtgttgggagcagcttctccgccccagcggcctccactctttaatggggaccttgcttgtgaactgcctttttcccccaagccctgggctctgtagcccccttggcaggcgggcttgggtgggggcaaggggagatctgtgtctgcccggaagggcattgtgtagagcatggggttgtgggtgacattggcaacaacaccacttctctgctctgcccatgcctctccctgttcctgttttgggtttggggacttgggattatgcgccgctctctcttctcacaccgatccaccttactgcatctgacgtgttcccttccactgtcccccatcatcgtctgtcccccctggctgggcgcctgtgaccggtgacccctctaccacccaccccgcctccctccggcccccgctccgacacctggcttgctccgaccccccctgccccccgacagcagcacagcagccggagagccaagagtgtagaggacgacgctgagggccacctcatctaccacgtcggggactggctacaagagcgatgtacaagccaaatc

SEQ ID NO: 404 - DNA, 2148 bp, Homo sapiens
tactagggtagaccatgcagaaagaatgtgcctgggtactgggacctcttctagctttgctccagaaatttggggaaggagtaaagacagtagcaattccagaggctccttgaagaggagttggggttggggaggataaagttaggtggtggttggaaatgggagagagcaaggagaaaactcacagtagctgctgtatggaccctgataccctgtacctctttccttgccctccaggtcctggagtacaatgccattggaggcaagtataaccggggtttgacggtggtagtagcattccgggagctggtggagccaaggaaacaggatgctgatagtctccagcgggcctggactgtgggctggtgtgtggaactggtgagaggggtagggcaagggagaagaagtttcctgcaatggtggtgacttgggtgggaaggggagggatgggcctgaaacttatttctgggttgtgtttgtgtttctttgtctctagtgtgctacggccaaatttagagtgaatcactccaagggttaactaatgtggggagcctcttttggcattaggtatgaagatggctgtagatagttgtagacagtgtggactggggcctcgagactgggcagagaggtgtcagctctttcctctgagcagaggatggctataaaagtgacagaggaggccgggcatggtggctgacacctgcaatcccagcactttgggaggccaagggggaggatcatctgagttctggagttcgagaccagcctgaccaacatggagaaaccccatctctactcaaaatacaaagttagctggatgtggtggcacatgcctgtaatcccagctactcgggaggctgaggcaggagaatcgcttgaacctgggaggcagaggttgcgatgagctgagattgcaccattgcactccagcctgggcaacaacagcgaaactccatctcaaaaaaaaaaaaaaaaaaaaaggtgacagaggtcttccaaaggctattcagaagcagaaattgaaaactggcagctcactgacagtattttgaaaatgttttacaattaagtctcctaaatttaacaaagagatttcacactaaaacctagatttctagcatggcttgggaaattgtaagatttgggtccatgttcccgcatagcaacaattggctgaagctgagtggatgcaacttctgcaagacggcatgtgttctcctgtgtgctttctctagtttgctccaatccccacatccccttgtcttctataccagttcgtcttggtcttgaaggtgtctagtttgctggcatggcctaaagctttcattagtggcagggggactgggttctgggaggggtgccatgcccgaggagggtggcagtgagcccaaaagggaagagcattcagaacttggtgagtgacgatgatgctgagtgcctggcctgagaggagcagctggctcaagggaagacgtgctgagcacagtcagcccgggtacgttcttggtatgggtggagcaggtggatctgcctgtcctgtgggcggtggaaattccagtctggaacttgtcggggagatgggtctggagaatagagatttgcttccaaggaggtaataggcccatggcatccagggagagggccctggatgacagggatgctgaggggctgaggggttcaaaatatggagatgacaggcaaggaaggaagggaaggaggatgagggcagagcagaggagtaaagctatgggggccaagggaagcaagaccttgaggggccagtggttaactggtagaatcagttcattttttttttgagatggagtctctctctgttgcccaggctggagtgcagtggcaccatcttggctcactgcaacctctgcctcccaggttcaagcaattctcctgcctcagtctcctaagtagctgggattataggcacatgccaccatccctggctaatttttgtatttttagtagagacggggtttcaccatattggtcaggctggtctggaactcctgaccttgtgatccatctgcctcgccctcctaaagcgctgggattacaggcgttacaggtgtgagccactgcacctggcctagaatcagttcttaaccctagcagcaccctagtttcacc

SEQ ID NO: 405 - DNA, 1198 bp, Homo sapiens
tttataacgtgtgttttctctttagctgctgcttttttgtttaattaattaatttatttatttatttgccctcccaggctggagtgcagtggtgcgatctcagctcactgcaagctctcgggttcacaccattctcctgcctcagcctcccgagtagctgggactacaggcacccaccaccacgcctggctaatttcttttttatttttagtagagtcggggtttcgccgtgttagccaggatggtcacaatctcctgacctcgtgatccacccacctcggcctcccaaagtgctgggattacaggcgtgagccactgcgcccagcctctttagcttcttttgttttcttcatcagtagtttttaacaagtttattacgatatactggaccttgttttatttatcctgcctatggtttgcttactttcttctaactctgaggttatgctttttatcattttgggaaactttttagccataattctcaatttttttcattgtgaattttttattttgtgaatgttacatcattgtatatctggtttttgttgttttcctttacaagtgtccaattgttttagtagtaagttttctcctttcccgggattctaagattctgttagtattatattctttacataatttattcttttctttaatctctatcagtttgtgttgtttctattgctgtcttcaagttcactgatctccagtgccttatttgctgttaagtactctccagtttttcatttcagatttcgtatttatcaattctcaatattccttttgttgttgttgttaagtcttctcttcctctcctcattatctttgtattttcttctaaattcctgatttatgcttgtagagtagtattttaaagttattttcttttctatctttgtgatttctatttctgttgctgtttctactgaatgattttttcccctgggtcacattttcctgcattttggcatatgtaggaatttattattggatgcaagacattgtgatgtcgcattattgtatgtctggtttttgttggtttcctttacaaatattcaattttattttggtaggcagttaagttacttatggatcagtttggattctcatattgtttttaaacttagctaaggctagtcttttttttttttttgagacggagttttgctcttgtcacccaggctggagtgcaatg

SEQ ID NO: 406 - DNA, 1203 bp, Homo sapiens
gttttgtttttgagacagagtcttgctctgtcgccaggctggagtgcggtggcacgatcttggctcactgcaacctctgcctcccgggttccagcaattccccgacgtcagcctcccgagtagctgggactaccaccgcacccggctaattttttgcattttagtagagacggggtttcaccatgttggccaggatggtcacaatctcctgaactcgtgatctgcctgcctcggcctcccaacgtgctgggattacaggtgtgagccaccatgcctggccgaaaatgcagtttttatgtggatgcaggattgccttaaaaaagcatacatgtccaggcgtggtggctcacgcctgtaatcccaacactttgggaggccgaggtgggtagatcacctgaggtcaggagattgtgatcagcctggccagcatgacgaaacactgtctctactaaaaatgcaaaaattagctgggcatggtggtaggtacctgtaatcccagctactcggaaggctaaggcagggagagttgcttgagcctgggaggcagagcttacagagagccgagatcgcaccactgcactccagcctgggcaacaaagcgagactccgtctgaaaaaaaaaaaaaagaaaggccagctcaatggctcacgcctgtaatcccagcactttgggaggccgaggcaggcgatcatttgaagtcagtagttcaagaccagcctggtcaacatggtgaaacctgtctctattaaaaacacaaaaaaatagccaggcgtggtagcgggtgcctgtagtctcagctcttcaggaagctgaggcaggagaaatcgcttgaacccaggaggtggaggctgcagtgagccgagatcacgccactgcactccagcctcagcggcagagtaaaactcagtctcaaaaaaaaaaaaacagaaagaaaaagaaaaaatcaaggtaaaaggagaagcttctgccaaccaagaggcagtagacaagttcccagatgctattaagaaaatcattagcagccggacgcagtggctcatgcctgtaatcccaggcatgcctcccactttgggaggcagaggcatgtaaatcatctgaggtcaggagttcaagagcagcctggcaaacatggtgaaaccccgcttctactaaaaatacaaaaattagcagaccctggtggcccggaggttgcagtgaggcga

SEQ ID NO: 407 - DNA, 1177 bp, Homo sapiens
gtgagccttggcggtggctgtaacatgatccagcctgtcaatgcggctgtggcccagagtccccagactattcccatcgccaccctcttggttaaccctacttccttcccctgtccattgaaccagccccttgtggcctcctctgtctcacccttaattgtttctggcaattctgtgaatcttcctataccatccacccctgaagataaggcccacatgaatgtggacattgcttgtgctgtggctgatggggaaaatgcctttcagggcctagaacccaaattagagccccaggaactatctcctctctctgctactgttttccccaaagtggaacatagcccagggcctccaccagtcgataaacagtgccaagaaggattgtcagagaacagtgcctatcgctggaccgttgtgaaaacagaggagggaaggcaagctctggagccgctccctcagggcatccaggagtctctaaacaactcttcccctggggatttagaggaagttgtcaagatggaacctgaagatgctacagaggaaatcagtggatttctttgagctaggagaataagagtctggagactgggagccttcacttcggcctccgattggtggcgcatagggtgtaaccaataggaaacccctaaagggtacttaaaccccagattttgcaactggggctcttgagcagcttgctttagcctgctcccactctgtggaatatacttttgcttcaataaatctgtgcttttattgcttcattgtttcattgatttgtgcaatttgttcagttcttcattcaacattccaagaacctggacaaattgtagtcaagaccctccgacagtaacatattttggcaagccagcctggaggtaagtccaaattgcggtgcaggggaagggggcggttatttttcttttcttctttcctttttctttccctgtcaagccttcatttttcggcatgggctggagctatatctctgtgcagggctccactccatacaggggaaccttttcctctctctctttcccttttccaacttgagactcagcagatagcatgtgaacatggaggcaactgcaggtctctggccagggccactctccagtgagactgaagggtatccacgtggaagcacctgatcaccatcacccagtttgggtgacag

SEQ ID NO: 408 - DNA, 1120 bp, Homo sapiens
gagccaaggggaaagggatgattgctcctgctgtcaccacttaaagagaaggaagagaacacgttataggacattttctcagcactgacccaacccctcacaaagcttcatacctttttcccacagaagctcagcatgtcagccagatgaaccatggaaactggagaggaacacaggcgataaggaacagtgactgtgtccagggctgtagccaggatggcactgcagtggaagggcagaatggcctgtaagaagacaccaagaggggcacttggcctcgggcctggaaaagaatgtgtggaggcagaatgttaacaccagagagacccaggggatgaatcaggggtatgtttgaccccaggctggacaagcataggacagtgtgatctgagaggccacatcacagctgagttcaagctcgggcctcaggaacagagccagtacagacagcgactgactgggagcatgaggaggccctgtagcctgccgcagtcagaacaagagcaccgagacttacatcataatgcaggtaagggaagttgacaggtggctcaggtcgcaggcccaggctcccacccaaggacaaggggcagacgagagctgtgagcagtcaggtgcacgagaccaaaagctgtgtttaatagacgatagatgtttctctgggcctcctcgtaaagaaaaaaaccagtttgcattaagccactctcccaatgggattcgaatgtttactcctccaagttccactcaccccacgatggtagggaccaggtagcaggccccaagttattattccccgccctgaatattcatcttgtagcagctctgccgccttcgcgcctaccccagagaagccatcgtgcaggtcacacaggatctggaagccctgggcgggggtgagtgacgaaagatagttagcaggatgagaagagcttccaccctggagtgcacattgccacgccactacctgcaagtagtcacattcctccacgtagaaatgcagcctgtcctccagctcttcctggtacttgggttcctttaggacactttccccttggccaaaagcctccagccgacctgcttccctgccacaagtaaacacgatccaagacttacatctctt

SEQ ID NO: 409 - DNA, 1341 bp, Homo sapiens
gactttgctctcttctgcccctgtgcccaaggtaatgctgccctcccttgccccttctaagtttcgaaagccatatgtgagacggagaccctcaaagagaagaggagtcaaggcctctccctgtatgaaacctgcccctgttatccaccaccctgcatctgttatcttcactgttcctgctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatg

SEQ ID NO: 410 - DNA, 1266 bp, Homo sapiens
tgcactccagcctcagtgacagagtgagactgtctcaaaaaaaattttaaaaagcaacattatgtaagagatatataaacttttcaaatgtaaggattataaatgctggtatgtttcttttataacttaagaaatgtatacttaaaaaaattttttttttgagacagagtctcgctctgttgcccaggctggagtgcagtggcgcatctcagctcactgcaagctccgcctcccaggttcacgccattctcctgcctcagcctcccaagtagctgggactacaggcacccaccaccacgcctggctaatttttttgtatttttagtagagacggggtttcactgttagccaggatgatctcgatctcctgacctcatgatccaactgcctctgcctccccaagtcctgggattacaggtgtgagccaccgcacctggccacaatttcttaaatcatgaaagtagaattttaggaaaagagtagatgtctggataataatctggatggattatatatactggtcttggaggcaggggagagacttaatgagagcatggtaatggatttatggtgggtccttctctgtgggcctctcatagtgtacccatgccatagcaaatggcagcctcgaaccattgcccagtccccttacctgtgggctgtgagcactgaagggggttgcacagtgtgtaacaaaaaagctatgaactaaattttatttgtggtctctagtcaaatttattttattttatttatttattttatttttgtttattattattttttgagacagaatctcattctgtcacccaggctagagtgcagtggcaccatcttggctcactgcaagctccgcctcccaggttcacgcgattctcctgcctcagcctcccgagtagctgggactacaagcgcctgccaccatgcctggctaattgttttgtatttttagtggagatggggtttcaccttgttagccaggatggtcttgatctcctaacctcgtgatccgcccacctcagactcccaaagtactgggattacaggcgtgagccaccgcgcccggcctaatgtttgtatttttaatagagatggggtttcaccattttggccaggctggtcacaaactcctgacctcaggtgatccgcagcctcggacttccaaaatgctaggattatggtgcaaggattacaggcataagccaccgtgcccagccaaaattattttaatttttatatttagacagctctgtaggtctctacttt

SEQ ID NO: 411 - DNA, 1232 bp, Homo sapiens
tataaaaatgatatgtgctggccaggcacagtggctcattcctgtaatcccagcactttgggaggccaaggtgggtggatcatttgaggtcaggaatttggaccagcctgaccaacgtggtgaaaccccgtcacgaacattacccgggcatggtggcaggcacctgtaaccccagctacttgggaggctgaggcaggagaattgcttgaagccgggaggtggaggttgcagggagctgagaccatgccactgcactccagcctgggccacagagcaagactccatctcaaaaaaaaaaaaaaaaaaaaaagtgccaagtaatacatacaaagaaaaaaaaatcgtgaaattccaaattccaatcccgaaagttacctgccataggtattctgtttgtgtgttatccagctctccacggtataatgaacacctgatcacacatttcttcatattgatatattctagaaaggagattgatagagcagaaggtatacatgttgtacattttgaagttagtggttttaatttgtatttgtaaacttgatgacaactggaggactaagaaggctgagtctgatgaagtaagactttgctgatacattcctcctagaaaaaagggttggagagagcagccttcactgaagagtatcacagggctgactgtactacccaacactctaccccagttttacaggagactgtctttgctataatttcttattgacttatttcaaagattgaggatttaattatatattctgtttaatctgaagtattctgttcttcctacagatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcaggtatggatggatagggcaggggacatgtgaattcttgtcaacttgttggtacagtcaggagtgattcagaaggagcaagagaaaactgggtgtaattaatagtaatgagggatttagataaatgctaggagtaattactttataattagttaaagaaattgtagaattggggcacggtggctcatgcctgtaatcccaacacttctggaggccaaggcgtaggaccac

SEQ ID NO: 412 - DNA, 1232 bp, Homo sapiens; identical to SEQ ID NO: 411

SEQ ID NO: 413 - DNA, 1358 bp, Homo sapiens
ctctactaaagatacaaaaattagccaggtgtggtggcatgcgcctgtaatcccagctactggggaggctgaggcaggaaaatcatttgaaccctggaggcggaggttgcagtgagctgagaatgtgccactgcataccagcctaggtgacagggcgagactccgtctcaaaaaaaaaaactaagactttgtatcaaaaataaataaatttgggctagactgctccctttctcattggactcatattttccctggcttctcctgtgccctaatccagacttctaagcaaggtctttgttttcctttacagctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattgacttgtctgttttcttagcccccgggtgaacacaggtgattattggaactcagtctttgcccagacccctgggcaagcgagctgggttctggccttgctgcaggggttgtgggcgggtcctgttcccatggagatatctgcccttttgaatcttttgcttccatcccttattttcctctgattgttgttctcatcagtcaccacctattgccgtacaccttccttgccaggcagctcctcttcacagctggagaatgtaggatggggaaagatggtctgcagaggaacagctattgtcatccccttagatctcatctgatttattgactcagtatttgttttttttgtgggttttttttttttttttgagatggaatctcgctctgtcacctagtggtgaacaccggtgcctggcacctgagtgttcttgaaaagctatctctcat

SEQ ID NO: 414 - DNA, 1317 bp, Homo sapiens
tacctccttgccccacaccacttttgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagagcccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagc

SEQ ID NO: 415 - DNA, 1241 bp, Homo sapiens
gcgacgggaggacgtggccacagcccggcgggaaatcatctcagcagcggagcacttctccatgatccgtgcctcccgcaacaagtcaggcgccgcctttggtgtggctcctgctctgcccggccaggtgaccatccgtgtgcgggtgccctaccgcgtggtggggctggtggtgggccccaaaggggcaaccatcaagcgcatccagcagcaaaccaacacatacattatcacaccaagccgtgaccgcgaccccgtgttcgagatcacgggtgccccaggcaacgtggagcgtgcgcgcgaggagatcgagacgcacatcgcggtgcgcactggcaagatcctcgagtacaacaatgaaaacgacttcctggcggggagccccgacgcagcaatcgatagccgctactccgacgcctggcgggtgcaccagcccggctgcaagcccctctccaccttccggcagaacagcctgggctgcatcggcgagtgcggagtggactctggctttgaggccccacgcctgggtgagcagggcggggactttggctacggcgggtacctctttccgggctatggcgtgggcaagcaggatgtgtactacggcgtggccgagactagccccccgctgtgggcgggccaggagaacgccacgcccacctccgtgctcttctcctctgcctcctcctcctcctcctcttccgccaaggcccgcgctgggcccccgggcgcacaccgctcccctgccacttccgcgggacccgagctggccggactcccgaggcgccccccgggagagccgctccagggcttctctaaacttggtgggggcggcctgcggagccccggcggcgggcgggattgcatggtctgctttgagagcgaagtgactgccgcccttgtgccctgcggacacaacctgttctgcatggagtgtgcagtacgcatctgcgagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgatttgaggggcaaggtgcttagagatactcgctcgctggggaaggggggagggaggcagtggtggctggagggtgcgccactttcagagcctctggtcaccctgtcctggaaagattgggagggggccagactgaaa

SEQ ID NO: 416 - DNA, 1186 bp, Homo sapiens
ggacggttctccagatccttcctcccccaggactctgcctttagacaaagaaatatcctcgcactggaagagggaaaggggaggggatcggtctcccaatccagggaggctgtcctgagggggtgtccactcctaaccagaaaaactgacggaatgtgcaaagagttactcagaagcctgtactctggtatctgctcctaggctggggagggggcatccctggggcccccagccgcctggagttacagactttgggggagacctggccctcgaagccagactgagtatctgtctctttgttgggctgagtgtaggaatggaagggggtgtggcccaggggagggtcccagcctggggaagaggcggtgaggggggctgctgagaggagggggtcctgtggtcacccacaccccaaagttggattgtctctggggttttggaaggggtgtctccaaggaagtgctacgtcctggcttggacctctcctcttccctctctggcttttgttctgggctggccacggccttgggccagaggcctagagaggggtctctggtagtgaaagagtaggacagggtaggagggggaatgctggggggtaagaaaccttcacctggaaatttggtggagggcgtgtgtctgggtgtgttgggagggggtgcagaattaatccagcgtagtatgtctggtaccacaccctctgctgctccagcatccctgggtgggtgagtgggggtgttggtgaaggtccaaattgagcagacgggatcttggggacccttccctctcctggcttctcaaaggagagtgtggggggcaggatttggaaattgcaaagaggctgggctggggaggtgtggggtgggggaggagctgtcccacagtggggaacaatagaggagctgcattccggctgggagtgcgggaggaggccagcttctggcagaggaaaaggggaggcgggccaggggggcccctactccacatcccaccttatccactgggagtgctgggggttagggggatttcacggagagatccagaatggaggaggggaagatgccactcccctgcacagccctcatccccctggggcactccatctcttgagatttctgatttagaaagttggatttcctcttgtcagaaactggggatccaaagccctggaattgggtggggacgg

SEQ ID NO: 417 - DNA, 1231 bp, Homo sapiens
cagctctgaatgggctgcccacgtgtggaggggggttggggtgactcactattactactgggaggacagggggagccagtggtggaagaagggtgagtcacactgatgggcaccagcctcagccctccccccactttcctggctcccagccctgcctacctgaccctctcccttgctttgcgcccacttccctctctttctccccgacccttttgcccacccactctccctccttggctctgccctctagcccagaaggtctgaggcaatgggggcaagcttggagccgacagtgctgagcaggcaggagccaagagaggggaagcttgagcctcacgcagttaggggtgcgctggagagggtggggcccgactccgccacaccccaacggtccttccccctcctcaccactcccgcccccacccccaatggatctgggactgcccctttaagagtagtggcccctcctcccttcagaggaggacctattagagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcggtgagttcgcccaggtggctgcgtgcctggcggggagtggagagggcggcgggccggcgcccctggccggccgcaggaagggagtgagagggcctggaggccgataactttgccatagtctcctccctccccggaactgcccccagcgg

SEQ ID NO: 418 - DNA, 1819 bp, Homo sapiens
aaccctccctcacagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactatattggattctgactgattctttgggggtgtattggttaactgaagacagaaagtggggtaatggaatgcaaatgatttccaggtcatctcagatttaggtagagggtgtcaacctcctccatttttaggcatttggaaatccaaacttcttgtgggcagagtcgtagaataaaccacaccattcattctactcctgcccagccactgtttaacgcacctgggaaagttttttttaaaaaagggtttgcacaagaagtggggtgtgggaggatgcgagtatcggccacagcccaagatggccatgaagtgggagtttggaggctggttgtataaacaatttgaccccaaagtgcaagtcaaataataggataaccctttctccttgctaatgctaggggtacctgccacccttagctggtgatggggtggtagggggagggggttggtagggtgaaa

SEQ ID NO: 419 - DNA, 1199 bp, Homo sapiens
atccatgaaggattggttccaggacctcccacagatactaaaatctgcagatgcacaagtccttgatatcaaatggagtggcatttgcatataacctatgcacattctcctgtatacttcgttatctctagattacttataataccatatacaatctaaatgctatgtaaatagttgttttactgtattgtttaggcaataacgacaggggaaaatgtctatacaagtttagtactggcacagcttttaaaaatattttcaatctgcaattgattgaatctatggaggtggaacccatgtatatgcaggattgactgtatacactataagtgtggaatgtaaaatgaatcctacccagtttataaacatgtacctcttaatagcactctgagcatgacaaccaactctaactttcctgtcatggtgcttttttacccttttccctcaaccttagcaaagacaatacataacaatgggttatcagaatagataatggaggaatccagtaaatgagaggcatagaaagcaagtatcaagtgtacatccataccgtcctgaacgcaccggctcttgtctgatctcggaagctaagcagggttaggcctggttagtacatgtataggagaaaacaaatatcaaaatcttgacttaacttccccacctttataaccaccttgtacaaaactaaatggctttaaatataaccatcttctcccagagcacaggtccttggccatatctcagtagatgcatctttaaactctactctgctatgctttaagggtaccttccaataagctgatgatatcaaacggcgtagggagctgagagtgctcagcccgtcagtcttagattagccagcctgttcttcacatcgcatcagaactacacaagcttctcatcccctaaatgctgattttcccatgtcaatttatggataagagttaatataatagttaatacttatgagtgacctacagcagagtctagttggagaggcaggcttccaggatgaatttccaggactcctctttcatttcttcatttgaaacaaggagaaacttcattcctcaaggacaggtaatgagagtgatttatctctatgagcgaggcttcagcaagacagaattagggttatagtaacagctggagtgtctcccatctactcatcttcctaagccccctgttctcatgaagag

SEQ ID NO: 420 - DNA, 1263 bp, Homo sapiens
aaatgactgtccctttggacagatgaggaggtggcttcagagagcttatggctctcgagggcagagctggcaccagcccttgagccaacagcaaagcctgtgctctgtccaaggaagggatttactagggcagcctgtgatctcctctaaccaccactcccttgtcacccaggaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaatggactctggctgtgtctggggccactgtgccactgtggggaagggaggaatactgggcaaagtgcagtgagtgatacaggaaggagggcagagatgagaggttgcagtgctaacccctgtcttgagtttcctccccatcctcattctcacttgctttggggggtggtgtaggttggaattgagaggggacaggacctcacagctgaatgcagactatgtaggcagtgtccacagggaagtaaggccctttctagtcaat

SEQ ID NO: 421 - DNA, 1385 bp, Homo sapiens
gtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatattaggagactagttctacacaatattgtaatgctgggttccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctt

SEQ ID NO: 422 - DNA, 1200 bp, Homo sapiens
cctgcttttttccaggtggtcctctttctgcaattccagccttcagcatcatccctgctctggactcctgtagcatttaaagaattggttatctgtttggcattcagcacgcagttttctattattatttgctcccttcaattctgcacaataaataataagtgaagcatccactgaggataaagcagagtcttgaagacagtagaatttacttataaatatgaaaaaaaaggtctcttctttatgccccaattttctaactctaaaaagaatggtggaagctacaggaaattcagagagccttggtcccaaaaggcttgagggataaaggtctactagagatagggtagctccccaagcagggaacttgaagtatagagcatttcaggcctaaaagagacctcctgcttcccatcccccagcctcccatcagttaatctccctcgtaccccccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaagtaagaatcacttggccctgcaccctcttcattcttgaagagagtctattctgcagtctgggaggaaggtcactgccctccgctttcccacactaccccctccagaacttcaggtccatctgtattctttgctcagtggcgttttcacatctgaactgaaacccttatttgtttgactggatattcatcttagaaactcatcctcacccttagccctttactgtcaacaatccttggttatggttccactgctccctagctctccagggtcctgagttcctcagggttgccagcagagggcatcatctcaaacacaagcatgggaaggatggtgggggccctttggctagaagacagaaagcagtccttctctggaactcacccagaggtgccagaaacagtattcatactctgtgaaatgtaccatgttcttgccatgtggtagatggccatggttcagtgcgagggtaaaagtgcctcctatagctgatggggctccagagatacaaagggtaactctgggttaccctttaactgctcctaacttgaggccttggataacaggggactt

SEQ ID NO: 423 - DNA, 1195 bp, Homo sapiens
aggtgaatggttccttattgtctaggccacttgtgaagaatatgagtcagttattgccagccttggaatttacttctctagcttacaatggaccttttgaactggaaaacaccttgtctgcattcactttaaaatgtcaaaactaatttttataataaatgtttattttcacattgagtttgtttaaatcctgaagttcttaccttaagagaattgggactcctagagtgattggacattcaaaatattcctgatagtcttgttaattaagagattaggatatctttccattaccttgataattacgttttaatttagcttttttcattggcctgtgtttaaatgcaaataaccccacaatggacatttcctatgttaaagtgacatttaggggataaaaaatgagagcagttccatggattttggtgtttcccctgagacatgaactcagcataatctgggataaaatgattgagtgttaaggatgtgtttgttgttcctgtcgtttttttattttcttcaaagtatacaacatggtttgatatgcacatacatttgtgtaatgattgccatggtcaattaacacatcaccatttttgtgtgtgtgtgtgtgtgtgtgtgtgagggagtcttgctccgttgccaggctggagtgcaatggtacaaccttggctcactgcaacctccacctcctgggttcaagcaattctcttgcctcagcctcctaagtagctgggactataggcgtgtgccaccatgcccagctaatttttgtatttttagtagagacggggtttcaccatgttggccaggatgatctcgatcccttgacctcatgatccgcccacctcggcctcccaaagtgctgggattacaggcgtgagtcactgcacccggccacatcacctcccatgttctatcttacgtattcagaacttgttcatcttgtaactgaaagcgtgtaccctttgaccaacactgtttttcctgtcttaacaggatctacagatcaaggacaggggaggggatagtggaggaaaacggagttagtctgtttctaaatgaggggacagtatgtttcttggggcctgaggacagcttaataaagtagacaaatgaagaaaaacaacaatttgcattaaaaaatatccaattctttagcttttccagcttattaccccttctctggtactag

SEQ ID NO: 424 - DNA, 1206 bp, Homo sapiens
tagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactgtcccagagctgaggcaaggggatttctcaggtcatttggagaacaagtgctttagtagtagtttaaagtagtaactgctactgtatttagtggggtggaattcagaagaaattt

SEQ ID NO: 425 - DNA, 1177 bp, Homo sapiens
gcaatgaggaaaatccccacaggtaggaagaaggaaggactgcctgggaattgttactggatcctcagggttctgtacccctagccaggaaaatcctaaaggtccctagatttctggctgttcctttctgggtcttagtctccaacctctaaccctcagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgcatctgctcctgctttctgcatcccaggcacactttgcctctttgctgccccgcattcttatgcctataggtgatagaacagccagaccaagccaagctccagcaatttttattttcatgaatgagagttggggatcagctgttaggttctgtgcccaggacactgactgctgcctggcgcccactctctatacagtcattaacagcaactccctcataggaggctccagccagagtcag

SEQ ID NO: 426 - DNA, 1316 bp, Homo sapiens
tagtgatctaaagccttccacttaagtctaaggggccaccaatcaagtcctgcccgcctctgcagctccagggttgaagctcttgggccgtcagacctgccactcattttcttcctcccttcccattggcccatggtaaatagcgaggcttttttttttttttttttttttcattgattgggcggggcccaatcagggttgggttgggtctttgacagctttctttgccagattcaaagatggcgcttacggccacgctaagaatgcagcgtgaagctgcagttctgccatcactcaagatggctgcccccatcaagatgaccggggtgtgccggggggaaaggggcagcatgatggtctgagatggtaagggatactgcaccattgcgggcctggtcttggggcctgggaatgaagaatagagaggctagggagctaggtgaagtctgtggtgggggctaggatcagagaaagggagagaggacaagggtgacaagtgggggtgagagatcaaagatggggcgggagtgtgcctagggttgtctctccatgagtgctctccttccctactcttcctgttccaggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaaggtgagaacttggcacttgggtgtctcaggatgaaggggcagaggagtggagggtcttgaatgccggatgtccggcgatgggagcaggaaaggggagatcatagctgggtcatgcagcctcagggaggatcaggtgcccaaatgaagtggagcatttcattgcaggacttgaaaggaggttaattcctccaaagtgttccctatgggattgaaaggggagactatcttttggggtaggggttctttgtctgtgcttattccttcccttcccctacccccttcagatgtattcccagcacagatggagggagtgaagctcgttgtcaacaaggttctgagcagccatttccaggtgctcccacttctctggcccctccttactattccccctttcctgtccctggatcatcttctcctttcctttgtactccagccctagccagtctatgtgggacaaatgagggaggatgtggggttctcttt

SEQ ID NO: 427 - DNA, 1237 bp, Homo sapiens
ttttttttttgagacagagtctcaccctgtcgcccaggctggagtgcagtggcgcaatctcagctcactgtaacctctgcctcctgggttcaagcgattctcctggctcagcctcccaagcagctaggactacaggcgtgtgccaccatgccaggctaattttgtatttttagtagagacggggtttcaccatgttgatcaggctggtcttgaactcctgacctcaggtgatccacctgagccaggcatcagccaccgagccaggcataagccaccacgccgggccaatgtaacaacataataacataataataacaattgtggctgggcatggtggctcatgcctgtaatcccagcactttgggaggctgaggctgtcagatcacaaggtcaggagatcaagaccatcctggccaacatgatgaaaccccatctctactaaaaatacaaaaattagccgggtgtgatggtgcgcgcctgtcgtcccagctactcgggaggctaaggcaggagaatcgtttgaacctgggaggcggaggttgcagtgagctgagatcatgccactgcactgcagcctgggcaacagagcaagactccatctcaaaaaaaaaaaaattgtactgtgttatacaatagatctcttgaacttattcctcccttctaactgacattttgtatcctttgaccaacttcttccccttccccctcccccgcatataaacatgtttatgcttggctaattaagaattattagttatcagagtattgtattgtcatggcttttgaatatatgctctctattttgtatgttctctaaacagttcagggaccagctagagatgaacaaccagctaagtaacacaaaccattggcactcagtcaaggaatgacttgccaaggccaaggagttagagaactaagctaaggacagctaggcttctatgtaataatgttcatgctccttaaacacaaagtcaccaagagtcattaactatctggccagtactcattgtattaaatgccgtatgtgaaatgcccctaaatattaaggtttaactctcaatttatgaaactgctttttaaaataagcatattcattcacaaacctttttattttgttatttttattttttttaacctttttctttgtgtcagacattattataggtactgtggatccaaggccaggtgcagtggctcatgcctgtaatgccagcactttgggaggccgaggcgg

SEQ ID NO: 428 - DNA, 2153 bp, Homo sapiens
tgctgggattacacgcatgagccaccgcacctggccaattgttaaaaatattttgatgtagagtgttgctctgttgcccagggtggagtgccatgatgcaatcacagctcactgcagcttctacctccctgggctcagaagatcctcccacctcagcctcccgagtaactgggactgcaagctcggaccatcatgcttggctaaattttctttgcattttttgtggaaacagggttttgccatgttgcccaggctggtctcaaacttctgggctcaagccgtctgcccaccttagcctcccaaagtgccgggattataggcgtgagccaccatgtctggcctaagttttccttatatagggatcttgtctatgtaaggactaaactaagctgtgcctacatgcgggggaccagacagcatgacagaatttattattctattgatttaaagaaaactgtccttgacattttagtgtgtaagtacatcaaagcataactataattattttgaaagcatatgttgttatgggtattgggacatctggactttctgttgttggagtttgtccttgcaggtattaccaagctgcttccttagctgtaaacatgttagaaccgtgggttgtcactggcaaggaatgtgccttgctagttttaagatggagtttatttatttattttatttatttttttgagacggagtcttgctctgtctcccaagctggagtgcaatggtgtgatcttggctcactgtaacctctgcctcccgggttcaagtgattctcctgcctcaccctcctaggtaggtgggattacagtcgtgcgccaacacacccggctaatttttttctatttttagtagagatggggtttcaccgtgttggccaggctggtcttgaactcctgacttcatgatccacccacctcgatctcccaaagtgctgggattacaggcttgagccactgtgcgtggcctattattttattttatttttatttttatttttattttctgttttctgttgctataacaagatggagtcgattttaaaatagtgtcactctggctctcctaggctcctgcttccctaacaaaaccttttctaaaaagatactgcaaatttttttttttttttttgagagagaatttcttgttgcccaggcttgagtgcgatggcgcaatcttggctcaccgcaacctctgcctcctgggttcaagtgattctactgcctcagtctcccgagtagctgggattacaggcgcccgccaccacatctggctaatttgtatttttagtagagacgaggtttctccatgttggtcaggctggtctcgaacttgtgacctcaggtgatccgcccgcctcggcctcccaaagagctgagattacaggcctgagcaaccatgcctggcttggtattgcaaaatattgacttaataaaacgttatgcaaaatattaaaccaagtttacttttagttattttcaaacggtctggttttattttagtgctgttcctttgggaaccacggccaaagaagagatggagcggttctggaataagaatataggttcaaaccgtcctctgtctccccacattactatctacaggtaaggaaggattctggagccagagaatctagaggtagtgggtgaaagttctgaaggttgatctttagcctacttgatacttccctcacttttactcaaccaaaatactgctatgtagatgaggtgaacccttcagggtagagggagatgacataaggattatcttacaccttttttatgtggagatgactaaattctatcttgtcattacaagggtaatctattttgcaaaactaccatttagaaaattctggtaagtcaaaatataattcccattaattaaaacatttttgaaacaatttcaaatttacataaacgttgcagaaataacatacagagttcccatatacctttatatggaaggtatatagtatatatgctaagttatatagaagttgcaactttgcaaattcttcttcttttttttctgagacagagtcttgctctgttgccaggctggagtgtagtggcgcgatctcagctcactgcatcctctgcctcccgggttcaagcgattctcctgcctcagcctcccgagtagct

SEQ ID NO: 429 - DNA, 1223 bp, Homo sapiens
gcctcggacccagcctgtgggccctccttctccttcctccgccctccagctagtcgcagggtgccatctcgggcctggcctgcctggccctttggccttctgggcctccttggcctcctgtcttttcttctcgtccgcggcttggtagcggcagccgggaggcctcctctggccctgcacggcgcccaacgagctgccggctcaaagtggttgtcggaagaggctttctgcgacacacggggccctgcgcccggtgggaagcgtaggagtggggaccctgccggcgccggccgtttcccccccgggcacctgttggggaagggctctgggggcccgaggcggcgagtgagcgagagcgcccccagaggcaggcgggcgtaacgggtcagccgcgctggccttgcaccggtggggcgcggggcggcctttggagaggccgcggcagcgcggagctgcgggcgggcggacggaccgggcgtcggggccggcctgccccgggcgtcggcggcgcgctggtgggagccccgggccggcgcggcggggctgcccgcgccgtgcggcgttggtggtatagtggtgagcatagttgccttccaagcagttgacccgggctcgattcccgcccaacgcatcgggcggaccttttgcggagatcccgcgcgcggagctcgcgtcgcagcttggcctgtggctgcgtgcctgtgcgccggggaaggaggcttgcggtgtttggagggtgtgctacctacctccacccatctgtccttttggcctggctgacgccaccttcgcaacatcggctttgcagctcttccttgtcatgtgctcacctcgctgccactgtttctcagcggccaagcccactggccaggtcaggctttctcctcggattgtcgccaggtgacccaccaccaccaccagcagcaccctcgcactctcttctggccacggaatgctccagtagtgtggagcagagcggcttccgccagtccaagccgggtggctgaggggccacttctctctcggctgagggggatctacgcctaatgattgggccacccgccagagccactcatgccagcaagctcactggcttttccaaggcatgccagaccctgagcgcgggatccctgattgggctccacgggtgtcagcggctttggtagaaatggcagcagaacttgaggagccgagaccacgggctatggcgctggggagggaga

SEQ ID NO: 430 - DNA, 1303 bp, Homo sapiens
actctctctagaccttgtcgcaaagcgggaaaaatgaaacaggctccgacagctctttcctctttcctcactacccaaactaatccttaaggctccattttccctggcgactcttcgagcgcccctctgcttctgtagaggggtcgagccatgtcaaggtagaccctgtgtcggcccgtctccctcggatcctccgcaccaatcactgttgctgaatccgacacccggcggatccagtgcggagtctcgaacagctgcggagctgggagctacgggacatgaagagagcggggtggaagagaagacggcggaggaaaatcccccggcgatgctcaactgcggctttctctctcggctgtgagccggctccgccctccagcttccagagccggtggcttctgcgttcaccgccccgcgccgtttgcggggcggggctgattcataagaatcggttctcaccaatggagggcttagcttgtttaacctcaggatcataaacaaaagacactgctagaacggtcgggaaagtcatacgctttgcttatcttatatatagatatctaaaactccaaaccgggtacgcgttggtggtatagtggtgagcatagctgccttccaagcagttgacccgggttcgattcccggccaacgcaagggtttttgtctttccttctacgaaaaacctttctcagtcagaacctataacgcgctgtgtatccgttttacgcctcaacgaagtatccgttttacgcttcaacgaaactgcagcaatacctcactttccgtactcgcttcctgtctttcccctggcctctttctaaacccaggcgttttttgaagggattaaattctgatggttctttcctcccttccttcctttgtaaacttccaactcttgaggaatctttgggatcatttcaatcctgggatgagtcttagcttcagaaaggggctcttgtgtcttcacttgcgaggttcattcgctagccacgcactattgagcacgtgaacttggctagtttctctaagaaactgcattttcaaatttagtcttagtaaataaatcaattgaaataaaattaataagtgaaaattttaaaatggatacttaataactcaaccattggagaaggtttcagtgcatttgaaacaacgtggctattgaatctactttttcaattgtaaattttatgaaatctaaatacggatttttttccgaagaaaatttcctttccgagttgaaatgtgccgtctttaagtgtaaaatacatagcgatttttgaagactagctaagaaaaaaaa

SEQ ID NO: 431 - DNA, 1214 bp, Homo sapiens
gtaactctctctagaccttgtcgcaaagcgggaaaaatgaaacagcctccgacagctctttcctctttcctcactacccaaactaaaccttaaggctccattttccctggcgactcttcgagcgcccctctgcttctgtagaggggtcgagccatgtcaaggtagaccctgtgtcggcccgtctccctcggatcctccgcaccaatcactgttgctgaatccgacacccggcggatccagtgcggagtctcgaacagctgcggagctgggagctacgggacatgaggagtgcgggggggaagagaagacggcggaggaaaatcccccggcggtgctcaactgcggctttctctctcggctgtgagccggctccgccctccggcttccagagcaagtggcttctgcgttcaccgccccccgccgtttgtggggcggggccgattcataagaatcggttctcaccaatggagggcttagcatgtttaacctcaggatcataaacaaaagacactgctagaacggtcgggaaagtcatacgctttgcttatcttatatatagatttctaaaattccaaaccggggacgcgttggtggtgtagtggtgagcacagctgcctttcaagcagttaacgcgggttcgattcccgggtaacgaaacgtttttgtctttccttctacgaaaaacttttctgagccggagcctccagcgcgctgtgtattcgttttacgcctcaacgaaactgcagcaatacctcactttccgtactcgcttcctgtctttcccctggcctctttctaaacccaggctttttttgaagggattaaattctgatggttctttcctcccttccttcctttgtaaacttccaactcttgaggaatctttgggatcatttcaatcctgggatgagtcttagcttcagaaaggggctcttgtgtcttcacttgcgaggttcattcgctagcctctacaaatcatcacttaagcccctaattattcccggccgaggtcctaggctaaggtcccgggccaagctttctaattagtcccaggccaaggtcccaggccaacctaaatcacgcattctccaaaacagccggcaaactaagcacattccttcccgtttccagtccataaacccccccccccaagtggcctcatagtaagcaactcattcgggccccctctctgctggcaaaaagctcagatgtac

SEQ ID NO: 432 - DNA, 1271 bp, Homo sapiens
ataccattaattggaatgttacaggctttttaagctccgtgttctgtctgcatggctaatatgcccgtagaaacctttcaaaacagcgtgggttgaagactaattttgtaacacaaaactcacttacttagatatcacattttgctggacgtgattggacctgaaagaaaatatttttaatgctcacgacaataacctttttatgagtcagcactaaacgtgtgcacatgcatacataagttgtctacatcagcaaaaaaagcttatcgtcgtatttctctgaccaaaatcaacggaacccccgaaatcacagagagcatccattttggattccccgaagacccttcgttcctgcatcctcttctgctctccctttctcagcctcttctgctggaagctgagtcctgctccagatctaggcaagtgctagcgcggaaaaaagacctgcctcgctcagggctgtgagccgcgccctgaagcacggaaagctaattgtgtcactggtttcaaatcaacttcaaattttttggagacgtaagagtgctgagcattttttcttcagtgaagtgacttggcagcccaggtcgccaacgcccgtttctgtagcgcgatcggttagcgccttcggctgttaaacgaaaggttggtggttcgttcccaccccgggacagaagtcccacttttgtgaaccttgagtttttgaaactttcactgaaaaaaaccgcgtgcgatgctatccgccgggagcgctggagccttggctctcaaaaccagccgcggtgctaaccgccgggatccctggcagctgacctccgcgttgtgtggttcccaatgtcctcttctgccttagtgctgtacgggtaattttgaggtatttggtttttccgactagggttgtagtgataactcttagctgcttaaccactgcaattacgttatggaaactgacactttaagaaaatttactgaccaaaggaagtaagtactaataataccaaaacaaattgtttgtctttccaccaaacctgtacctgccttgcctttctatttcctaactcagaaaacgggcactatgtgtggaacctggtccttagtcatgccatgtactgccggctgccaattcttggagagtcggcctcctaaataccttgttgattaagcaccttcctctccagcctcaccgccagttacttcctcattgctccctttgggttattgcatcctgccttgcatgccctatctggtttccggtcttcagctctcctgtcccg

SEQ ID NO: 433 - DNA, 1221 bp, Homo sapiens
tattaaaagtacttaacctacatagaatggttttttaaattttatgcgtgtttggctaattgctgagttactattcctggtctcttcagtgttggggctgtatctcgtggcagaatgcatatgatagttctgccaaatcctcttttctccatggtttatcatttctttgcagtgtccttattatcagcagtgcctaataggtaagagacaatccaaagaagacttctttatgagcgctatatggaaatgtacagcttgcctctgagaactgcccagttaatgaaccaaagaattatggtaatcaaggactaaaaatttttagcatttagcttggcagtgggtttactgcactcttagggaagtaaattcactgtagagatggatagaaagggagcagcttttttattggttgtaatatttactcatcttttttaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggtaaacttcaccagtgctttgctttggggtccttactttcaacttaagagtattcaatttatgatgatttttttttttcttttgagatggagtttcactctttcacccaggctggagtgcagtggcgcaatctcagctcactgcaacctccaccttccggtttcaaccaattctcctgcctcagcctcctgagtagctgggattacaggcgccagccaccgtacccggctaatttttgtatttttagtagacacggagtttcaccatgttggccaggctggtctcaaactcctgacctcatgatgcacccgcctgggcctccccaagtgctgggattacaggcatgagccaccgcacctggccaatttatgatgattcttttagagaactcttgattgctgtctgttgtccatactcctctttttctattgatgatacttgaatgccactaccaactcctatggctatcaatctgctagtgagtattgcattcttattgttcctagcctgtggcttggcatatagtaagtgcttgataaaatgtttgaatgaatgcattttcctgaagaaacaaaagtggtttcttttgtttac

SEQ ID NO: 434 - DNA, 1230 bp, Homo sapiens
agagctggctttgtacaaaccccctctccccgctttttttttcttcttttcttaaaaagcttctgtgctcttttgaaacaagccaacaaaagttgaagccagtgtgtgtgcaactcagacctcatgagcaattcttttccaaaccaaattttaattcacagctgccagtttaggggcaatgctaagacccaaatcgtcctggcatctgaagcacctgtcctaatgttgagtactttaaatatggtgttcccatttcctaaatctcaatttagtctgtttggtcttacaattgtgagtataattatgggaaaatttaaatgggatacttgagtcaggactgtgttaaaaaatccaagatgtattgcttctgtaaggctagactaaaataatgaaaatattaagagcctaaagtatgctgctgctttttttttttttttttttttttgatacagagtcttactctgtcgcccaggctggagtgcagtggcgtgatctcggctcaccgcaacctccacctcctgggttcaagtgattttcctgcctcagcctcccgagtagctgggattacaggtgcccgccaccatcggctgatttttgtatttttagtagatatggggtttcacaatgttagtcaggctggtctcgaactcctgacctcaggtgatctacccgcctcagcctcccaaagttttgggattacaggcgtgagccactgcgcctagcctactactgctttttaactaaagtctgcctgcattccctctcttgccacaaaaggcaaacagagcttttggcacatttgattcctgaggcagccccatgcctgtttaacacagtgtagcttaactggttaaagcaccgggctagtaaacacatgactaggggctcaatcccttgtgggcctgttagtttatttactgcattcattggccacagacttcatccctaaagtggtcaagccatctcagacacgtttgcttctggtcacaccgatcaagattgatccagccactgaagtaatccaaacaactcacttctaatgggccagaggttgtcatcttcatacctgaggaatggcttgcattttataaaaattggagattcttctgctctcagaatagcagacacagggctgggcgcagtggctcatgcctgtaatcccagcactttgggaggccgaggcgggcagatcacctgaggtgtcaggagtttgagaccagcctaaccagt

SEQ ID NO: 435 - DNA, 1149 bp, Homo sapiens
ggagttgtgatacacgattatattaaattgcttatggttagttttccaggaggtgatttaattgttcaccttcctaagtcttcagtcttaggcttatccagtgggagctggaaagctttaataggcaagtttattggaacacacttccagagtcaaatgtcactcttggcagctgcagatgtcaactgggacaagtattcagagcctgagaattaaggatatgtgttaaatatggccctcataggcggccccagggtttttttttttttttttttacttttgcgaacatgttgacagagatgaggctcagaaggcaggtatacatgtgccttgtcttcattctctgcagagagaatgtttttaggggcttgggaaagtatttcaactcgaagaaaggacttatagttactagaatcttcacatctgctttctcgagtgaccttgagtcaaccacagtcttgtggggtagatggtattattcacccctcttttgttacatattaacatgacaaaactaagactcagagaggaagtgccttccccaagcacatgcagctagccagtggcacatccagtacttgaacccttttctctttgaatcatgctttgtactaagctgatcacggtccactgtagcagtaggtgacttatggtactaagtaccatctgatacattaatttattcagcaaacattgagtgtctgttgtatctctagtacctggcattgcaaagatgagtaaggcagtagacagataactgacataacccatgacagtgcagttgcgtaagtggcatgatctggagtgcagagtactgtggggacacccatgagggagccacaattgcctggggtagggagttggaggaggcagatgacaggaggtaatgactgagctggagctggagggatgagcaggagttaggcagattgcaaagggggtgcgggcatgtgctgggtggcatttccagacaaaatcggagggcttggaacagcagtgtgtgctcacacctggtacgtagcaggagtgagaggcaggaacagcagtttgaggcttgacagccctgtgtgcgaagcgaagcatttgaatgatgtctcattaccactgtataccacatgtccttcccctgcagctttggctgacatctgt

SEQ ID NO: 436 - DNA, 1494 bp, Homo sapiens
attattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagtatcctgaggacacagggcccctggccttgatggcactgggctgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgcaaaggcagtgggttaaacaacgggatgtctgtgggacaggccagggaaggagggcagagacagggtctccagttcaccttgccgcagaactagcctaatcatccctgcttctggtcttggccacttggcaatcatggggaagttgactccccgcctcacttgggcttggagctggatacttgtggccacgcccaggataggttgccagagtttcattaggccgctgggtcgggctggaggcttgt

SEQ ID NO: 437 - DNA, 1315 bp, Homo sapiens
ctagcacagggggttacaaccagcccagcctaggatatggacagagtaactgcagttatccccaggtacctgggagctactccatgcagccagtcaccgcacctccatcctaccctcctaccagctattcctctacacagccaactagttatgatcagagcagttactctcagcagaacacctatgggaaaccgagcagctatggacagcagagtagctatggtcaacaaagcagctatgggcagctgcctcccactagttacccaccccaaacttgatcctacagccaagctccaagtcagtatagctaacagagcagcagctacgggcagcagagttcattctgacaggaccaccccagtagcatgggtgtttatgggcaggagtctggaggattttccggactaggagagaaccggagcatgagtggccctgataactggggcaggggaagagggggatttgatcgtggaggcatgagcagaggtgggcggggaggaggatgcggtggaatgggcagcgctggagagcaagttggcttcaataagcctggtggacccatggatgaaggaccagatcttgatctaggcccacctgtagatccagatgaagactctgacaacagtgcaatttatgtacaaggattaaatgacaatgtgactctagatgatctggtagacttctttaagcagtgtggggttgttaagatgaacaagagaactgagcaacccatgatccacacctacctggacaaggaaacaagaaagcccaaaggtgatgccacagtgtcctgtgaagactcacctactgccaaagctgccgtggaatggtttgatgggaaagattttcaagggagcaaacttaaagtctctcttgctcggaagaggcctccagtgaacagtatgcagggtggtatgccaccccatgagggcagagggatgccaccaccactctgcggaggtccaggaggcccaggaagtcctgggggacccatgggtcacatgggaggccgtggaggagatagaggaggcctccctccaagaggaccccagggttcccgagggaacacctctggaggaggaaacgtccagcaccaagctggagacaggcagtgtcccaatccgggttgtggaaaccagaacttcgcctggagaacagagagcaacaagtgtaaggctccaaagcctgaaggcttcctcccgccacccttcccacccccgggtggtgatcatggcagaggtggccctggtggcatgtggggaggaagaggtggcctcatggatcatggtggtcccggtggaatgttcagaggtgg

SEQ ID NO: 438 - DNA, 1717 bp, Homo sapiens
aacttgcacaaaaacaacagacagccctacgttgtcagtgaattagcaggtcgtcagaccagtgctgagtcttggggtactggcagagctgtggctcacattcccagagttcgaggtggtgggactcaccgttctggccagggtgcttttggaaacatgtgtcatggaggctaaatgtttgcaccaaccaaaacctggtgccattggcatcacagagtgaacacaacccaaaaacgatatgccatctgttctgccctggctgcctcagccttaccagcgctggtcatgtctaaagatcatcatattgaggaagttcctgaactttctttggtagttgaagataaagttgaaggctacaagatcaaggaggctgtttcgcttcttaagaaacttaaaggctggaatgatatcaaaaaggtctatgcctctcagcaaatgagagctggcaacagcaaaatgagaaatcgtcactgtatccagtgcaggggcccctgcatcatctataatgaggataacggtatcatcaaggccttcagaaacatccctggaattactctgcttaatgtaagcaaactgaacattttgaagcttgctcctggtgggcatgtgggacatttctgcatttggaccaaaagtgctttccagaagttagatgaattgtatagcacttggcataaagctgcttccctcaagagtaactacaatcttcccatgcacaagatgttcaatacagatctttagcagaatcttgaaaagcccagagatccaaagagccctttgagcaccatgcaaaaagattcattgcagagtcctaaagaagaacccactgaaaaacctgagaatcatgttgaagctaaacccatatgcaaagaccatgcacgcgtcagaacaccattcttcaccaggccaggaatcacaagctctgagtggataaggcagcagcaacagctgcagcactagaagccaaatcggatgagaagggggttgcaggcaagaagcctgtggtaggtaagaaaggaaagaaggctgctgttggtgttaagaagcagaagaagcttctggtagaaaaaaggggcagcagctaccaagaaaccagcccctggaaagaagccagcagaaaagaaacctactacagaggaaaagaagcctgctgcataaactcttaaatttgattattccataaaggtcaaatcattttggacagcttcttttgaataaagacctgatcaaagaggcagtgagaaaaaaaaaggtaggtaaataaattaaaaagaaaatccaaaaatgtattgaaacaagtgaaaatagaaacacaatatactaaaacatatgggatacagcaaaagcagttattctaagagggaagtttatagcagtaaacacctacatgaaaaatatatatttcaaataaacaatctaactatgtatctcaaggatccagaaatgcaaaaacagacagaatcaaaaattagcagaaggaaataaagtataaatatcaagccagaaataaacaatatagagactaaaaatatgcaatcaacaaaatgaagggtttttttcaaagataaacgaaattgacaaaccattaactacattgatgaagaaaaaagatacaagaccaaaataaataaaatcaaaagtgaaaaaggatacattacagctgataccacagaaatataaagaattattagagattattacaaataactatatgcca

SEQ ID NO: 439 - DNA, 1167 bp, Homo sapiens
aaaattaagacatactggcctggtgccagcagatggcttttctatagacaaactaggttagtgtggaagatataggttaaaataaactatgctgttttatttatcttcccaacctgattggcagctagacttttttagggtctcatttaatggccctgtttttttcattattatatttaatgatagggcaggatttcgtatgcaagctcttgtttctcaggctgcctgcagaagaagtcgctataaattatctgttgtctacatggtacaaggcccattgactcatctgatgcttgttttgttaatttctttaatatttttatcacggggcagtgggagggcttgggcttttagccacagctgttttaagacttctgatctcctgccctgcaggaataggtgggaagtcattgaatttttacactatagtaatttgcattcccacataagtttgagtgttacgaaaacattcctttaaagggatctgtgctacacaaaatatgccaggacctcacagacaaagccattgctagaaatgtcattccaatgatcagatctggaaacaggctgccataaccacttttccttcttgtagactcagctcacctgtatatttaaactgttcttggcatcttgaaacacctatttctactcaggtactcattgtcctgttactgattcacctttctgatccttttcaaccagttttcccccaaggggggaaattttacttaacctctagtatttgaacaactcaatatttgaattgttgccccatttgcttttacctgtactgtattcttggtcatctcaaatggcgtctaaacccagctactttgcattccagaagtttccattccctccaattccacctaatttttcatctgtcctagttactggctctttcttcatgtcttatttctcttgctttgggagcttaaaagattttacaagacctaattttgggttccttccttggagccatagttaccctgccaagaagagtagaaaatgggttcaactcctgtttcgctccaccaacacctctgtgagtctcatcatcagctgagcgatgatgccttacaggttgcatagcactggaactttcctagagtaacggctctgctgccagggtttctctgggctcattcttccactgacttaatt

SEQ ID NO: 440 - DNA, 1210 bp, Homo sapiens
ataagtgagatcgttcaatatttttgtctttctgtggccggcttatttcacttaacataaggccctccaggttcatccacactatcatacaagaaagaatttccttctgttttacggctgaatagtactccattgtatacattatccaatgttttctttatccattcatatgttgatgaacaattaggttggttccatatcttggctattgtgaatagtgctgaaataaacatgggagtgcagggatactgatttcaattcctttgggtatatacccagatgtgggattgttagatcatatggtagttctatttttaattttttaggaacctgcatattattttccataatggccgtactttcaattatatctttatcaaagtcttctatcgtgcccatggaggcttacctctgagttgacaccagaatactaatcaatttccattaggtgtgattgctaaccagccaattatattttctttattcctataattttgtatattttactcacaaggatatgagaaatttggccaaatgccttaaagtcaatatatacattgtctatagcagtctcttgatttaaaagtttaataactcttccaaaataggaaataatgttggcttgctcttggctctgaatccatttgactccttttaatcacctcttgctaatctaaataaccattgaggctgctcccaaatattccaactctctttcctattgtgcacatggtaggagtgcacttccctgtctacttgaaactaggcatggtcatgtaatttgctttggtcaatgccatgagtaaaagtgaaatacgtcacttctgggagtagaatgagtatactccactacatcctctttcccactaccttgacaaccagaatattccagtttgggtcccaaagtgaaggcaaaaacagaggagaaccccatacaacccacaagggacatgtagtgtgagcaagaaatgaacaagaaataagcctttgttatttcaagccattgagatttcaaagttatttgataatgaaacataacctgtattatctcaacaaatacattatgtttactggtctgtgttttctgggatccatgagtagcctcatcttttgaaattcaaaagagaatgtgcccatctatggtattccagcccatctcttgttctccatggttttttgagattactgacattacacctgtcagttcttt

SEQ ID NO: 441 - DNA, 1181 bp, Homo sapiens
taaagaggtttcttgctgcaagtcttctcagaggctttattacgctacaggttcttgtgaatctcacaaagaggtatacacaatgtagtatttcccaaattttgtgaccacattgtagagtatcagaacactttggacaacagtgaccttcatcttcttattctgtaattaaattattccattcaaaaataaattgagtgtgaatttattattaaaaacttaagcctgggcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctacgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcatgaaattatccatggtaaaaactagttataaaaattacataattcaaagataacattgttattcttaagccttatataatattgtaacttgcatgtatccatacctggatttg

SEQ ID NO: 442 - DNA, 1160 bp, Homo sapiens
atctcagctcactgcaacctctgccttctgggttcaagtgattcttgtgcctcagcctcccaagaaactgggactacaggcatgtgccaccacacccggctaatttttgtatttttagtagaaacagggtttcaccatgttggccaggctggtctcgaactcctgacctcaagtgatcctcctgcctcggcctcccaaagtgctgggattacaggcgtgagccaccatgcccagccccatgtcctttttaatgcctggattgactttgtgggacatgaggccaaggtaccttttaagatgtcacctgtatagcatactagtagtgaatgtaggctttgaagtcagatgcatctggctgtgagctgtgactagtcatatactagttgtgtcattttgaacaggttacctaacctctggctcctcagtttgttcatctgtttaaaaattgtgggaataacagttcctgctgggtcattgcaagatgtcagtgagacgtgtcaagtgcttagaatagggcttggcataagtagagtctcagtagggtaggtgttatttaatcccagaaataactgacaactttggaagatgagagtgaatgtctccgatcattaatttatttaacaaatacttatctagtactatgtgcccggcgctgtagacactgccatgttttatctcattcaatattcacagtgactgcccagtgaatggtattgcctccatcctctgagaaggtaaagagcctatcccagaccccacgagtggaggcgtcagggaggggttcttggcaggagatgggtcttgtagaaaggcttctgctttgctttcactcacggcctgtggccagtttgctcagacagctcccatcaggacaccattggcagcttttgcatgaccctgcctcccagggtcttcctgcgtttttccttaagttgccttattctttggttgtttccctacttgtttttgttagactgtgggaggaagaaatccatttcaaatctgctgaaacctgttaccaagcaacagcagtgattaaaagcaacctgatgagtgagtaaagaattagggtttcagacctgtagttaatgatggtctctgtctccctgctgccctgcattcccttcccttccgttcactgctgggtgaaggagggcttg

SEQ ID NO: 443 - DNA, 1222 bp, Homo sapiens
gggtaattctaagactagttgaactggattttagagctgtgtaataaagaactttccaacagttttacatatccataaatggaatgaactgccttgacaaagtagtgagcacttccttctggaggtgttcagaagagagctggatagaccctgtcaaggatgttgtgaataaaagtgtagccaatattatttcttaaaatgttcccaagtcaaagacttccatgagcctttgaaaaaataatttggcctgcatttattctttttgtagccatttattaataaattcattacttgctctacattgatattgctgacctaggaatttaaaagaagaaaaaggcttgtgttgcttttatctcgttttaataaaataatgatacttttcacttatgcagcacttttcatccaaggatttcaaagtgctttacaaatacgcactaattaagcctcacaaacagccagaggtaggtggttttcttctctttctacaggaatgtcaactctggcccagaaatttaataagagcctgtgagtgcctgagattctttactggctgccattcccttgtaatgtgctgcatgtgaagcatcacttgtcatttccagatttctttgttcctgctctgaatcatatcaagtttagaattctaatgattgctattacaaatgtgtttgaagtcttgcaaatattagcaaaaattcagtcttctgcttgctgaatgctaattagatttctaaatttgtttatttaaaaaaacacactctagatatggttttctatttgttgttgggttttaaatataatttttctcttttaaagaatttgtcatttttctttctaggtacccagaaataattgttcttgggagataaaacttaatggcagattgactttttggccttatcattcctagttatcttttcacaataaacaataaccattttctttggaccagaattatgtattttcaggaagagacactattttggtgattcaaaggtccaaaatatgttatctgaatacgaaggaaaaaggtgaaatggcactaaataagtaatcctataaagaaaaagtactataatagttgcatatactagtctagagggatacaccacattttatgtgggttaggagtagcaagaagaaactatgtacatacagagacatgcaccctacaagattggattgaattccagtatacttataaatagccacatattca

SEQ ID NO: 444 - DNA, 1189 bp, Homo sapiens
aggctgatcctctgcccttaatgattgagatttttagatacatggctagtaggacagtaatataaaaagtactaacattgtaaaagtaataaaaaagcttttcaaaattaaaattgatataggtagagggtatacttattttgatatcctctataactgtgtggatgggttttgaaatcagagctggcaagctgaaggcaaatgctactgagcatgctgtttcaagggttttgggattactaattatgtaaattgtaccattttgttacttaaatgtggttatgctgagtgcatctgtgcctactcagcaattgagatttttttactagctttttcctccagtggcttttcttgccattaaaaccttttttgtttttttattgcaaatgagagatgggggtcttgctggtattgcccaggctgggcttggactcaaataatcatcccacccctgccttctcagtagctgggactccaggtatacaccaccacacccagctttttttgtggcatttagaataaactcaaggataacacttctaatccaaggctctgcaaaatgtgacttttgcctactctgatttcatctcctgcctgtctccctgagacatgacttttacacttgaacgttcttagattgaaattggtttgcttttcagtggttctcaactgtgggtacagtttagagacacttggggaacttttcaaaaaatactattgccaggcctggcccaagaaattctgatttaattgcctggcatggggccttgacatacaatttttttttaaaactttggataactgtgcagcctaagttgaaaaccactgattggttttccttaactcctgtccccttttcagagaggtcttctggacctttgctatcctatccaaagtcccctttacctctttgctgcccctttttacccagttgagtttttcatttctacatttttatttacttgtttattgttttgttaaaagttccatgaaggcaggggcatcatctgtattttcataacatatcctaatatctgaaacaccaaaaaaggcttgtttctgtgtaacctgtagagaattgttttgctaaattatattttagagaacataccaactactctagtaggccttaaaaggacgttgattgttgttattgagatggagttttgctccgtacacaggctggagt

SEQ ID NO: 445 - DNA, 1195 bp, Homo sapiens
cctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaa

SEQ ID NO: 446 - DNA, 1220 bp, Homo sapiens
acttcatagcaattcaatgagcagagttcaaaagtgcgaaactttacaagacaaataactttgcttctccaaaaattgaattgcaaggaaagaaagtggagagggagaaactgacagagtaaaaggaatttaagactcatatcatcagcctagagcggtggctcatacctattaataaaatcccccagcactttgagagggcaaggcgggagaatcgctttaacccaggaattcaagaccaatttaggcaaataagagagaccgtctttacaaaaaactacatatatatataaaatttatatatataaaatataaaatgtatatactatataattatatattaaaattatatattatatataaattatgttatatataaattttaattatatatatatatatataaaagctgggtgtgttggcacatgcctctggtcccagatacttgggagattgaggtgggaggattacttgggccagtgcatgatcacaccactgcactacagcctcattgacagagcaagaccctgtctcgaaaaaagccagccagatatgagggcgatctgactgtgacatctgtcactctattgatcgccagggttgattcggctgatctggctagctaggcaggagtccccttcctccctcaccactccatgtgcttccctcttgaagctgtgcacactcagtggaagaggacagccatccccaatagaggaaggccagtctgcagtcaagggtatacaagtagctgcattcccctactagaacctccaaacaagctctcaaggttcatttgtaagagaacgtagggttctttgaagtcaagcttccaagactccagacacatccaagtgagttgctgcatgtggcagtctgcctttctttaaaacaaacaaacaaaaccaccaaacttcaggtaataaggcaggtaatgttttacataatgcatctcagtataaaacatgcaacaattgaattatttacatagcccagcagaagcgattcaatagtctgccctgatgtggactgtaagaatgattagaaaagaagttaagcctgagaaaggtttgaaagagagtaatagttttgctaagtggacaagagtggaaaggacattccaggcagagcagcatgtgtaagatatacagaaggaaggcagtgagacagcatgggctgttcagggaaatcaaagcagtctgctttcaggagaataaagt

SEQ ID NO: 447 - DNA, 4721 bp, Homo sapiens
cttacaccgcccccccttcccccatccccagagctttccttgcctcgcgccccctcccctctctgctcttcctcctcagtcgggaggagggcgggagcacggcatcacgtggacggtcatgtctctgcccacaatggcgaggaagggcggggaaaaggggcggacttaaggggtgggaagaaggtgatactggatgagaggaagattgagggaggttagggggaggagccgaagcggacgctgccgggagcgtgcgtcgtgacgtcatcaaaagaactcttatatacaggagcccaggcaccatactgtcttttcgaggtaggagtcgactcctgtgaggtatgttttatctttgcgaatgttgcgggttttggggcgctccagcctttgtctgctaaggtcaccctgaattgactgggacttctaagccagtcgcgcgcctttgcagggcctacaagttgaggatggtgggggattgcacatatggtgcatgcgtgacctaagctgcgactatgttagagtagaactgcggagaagcctcggctctcgtgccctgcctctgatgaagcctgtgttggtagggacatctgagagtaatgatgaatgccaaccgctctgatggtggcacatgccgagtcacccgagtaagctattgttaagggccgtgacccgagcctccatcagccgtccgctctcatgaaaggctgtcggtggtagtccacgtgcttaagtgcctgcattccgcagtgtcaccaatatttccattagtgtttcttttttcttttttgagaccgagcctcgttctgtcacccaggctggaatgcagtggctcgacatcggttaatggcaacctccgcgtcccgagttaagcagttctgcctcagcctcccaagtaactgggactacaggcgcgcgccaccatgctaggcttttatatttttagtagagacggggtttcaccatgttggcgagactggtcttgaactcctgacctcaggtgatccaccagccgtggtcccccaacatactgggattacaagccgtgagccaccgcgcccggccgccatcggtggttcttaactgcgggtgcagtgcttctttgtaacattaagtgtatcctttacctgtcgctagataatgaatggtatgttacctgcatcattggtttaaaaagacgaaccgtttttttaaagaacactctttaaaaaaaagaaccgtggaacaatgaattaaaatctgtacctgatctctttaggtatggtgctgggtgcagatgcagtgtggctctggatagcaccttatggacaggtaagaattggggaaagtatggtgggaagaatgaaatctaagaggtggtctcagcctgtgatgctttaagagtagtggacagaagggatttctgaaattctattctgaggctttaatgttaacagcatttatatttaacgtgactgctgtgaggttcattctcactgttttgcttgcatctttttgttttctagttgtgtccccaaggaaggatgagaatagctactgaagtaagttgaaaattccctctcaaaaaggtttaaagccattggatgtgccacaatgatgacagtttatttgctactcttgagtgctagaatgatgaggatcttaaccaccattatcttaactgaggcacccaaaatggtgagttggggaacatagagagtacacctaagttcacatgaagttgtttcttcccaggtcctaaagagcaagcctaactcaagccattggcacacaggtgagacacctctattttgtacttctcacttttaagggattagaaaatagccaaagcaatgatgattatctatgttagtgcttctctcccctcttttcaaatgagaattttgctctcatattgatactaagtttaatactgaagaaaatgtgaaaacagatactatgatggttgcatagttcagcagatttaatcatgaagagatgtactatctgtctgatgtatctggggtagttgtggtttgctgttaatggttaagcagtgtaccaccaatctaccattaaaatattttttgctgacaattttgtattaaaattacaggcattagacagaaagctggaagttgaaatggtaagtgaaactgtatccaagtaagcaggtaactgggcaaacttcctacggcacaaatggctttttagttacctcctagtgctgaatgcattaaataaatggcggattcttgtcttgttatgattaataagaaagtttgtaaatgcagcctggatgatgataagcaaatgctgactgaacatgaaggtcttaattagctctaactgactaaaggcatttgttagttttggcagggggtgaacactcatctgtggctattctaagaccactcttatttcttaggtggagtccaacttgcctggaccagcttaatggttctggtaagtattaatgaaaacagtagatagacttaatgaaaatgctgatggtgatatgcttactgctgagctaatggcttaaggcttggctgatgaatactgactgtattttccttgagcatgtctggaacagtgtttatgtgttttccttgagcatgtttggaacggggtttgtgtaatgatgttgatcaaatgtctgacctgaaatgagcatgtagacaaaggtaacactgaagaaccctgtgacagacaactttgaaaagagtttaatgatgtttagcattttaatggaagtcctcatttgtattccagctcctggtaacgtttttatccatggatgacttgcttgggtaaggacatgaagacagttcctgtcataccttttaaaggtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgggattacaggcatgtgacaccatgcctggctaattttgtacagctatgttgtccaggctggtctcgaactcttgacctcaagtgatactgcccgcactgacctcccaaagtgctgggattacaggcgtgagccaccatgccccgcctcaagtctggtttttaagtgttgtaaagccgatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttcctaattctccatatgagcaaattgtcaggtttcataggcccctgtgctaattggttttgagcttaaagtattgatggagctacttggagaaagtcatgttgagtctgaggctgggaaaataagttatagaaaatactataga

SEQ ID NO: 448 - DNA, 4721 bp, Homo sapiens; identical to SEQ ID NO: 447

SEQ ID NO: 449 - DNA, 4721 bp, Homo sapiens; identical to SEQ ID NO: 447

SEQ ID NO: 450 - DNA, 4721 bp, Homo sapiens; identical to SEQ ID NO: 447

SEQ ID NO: 451 - DNA, 4721 bp, Homo sapiens; identical to SEQ ID NO: 447

SEQ ID NO: 452 - DNA, 4721 bp, Homo sapiens; identical to SEQ ID NO: 447

SEQ ID NO: 453 - DNA, 4721 bp, Homo sapiens; identical to SEQ ID NO: 447

SEQ ID NO: 454 - DNA, 4721 bp, Homo sapiens; identical to SEQ ID NO: 447

SEQ ID NO: 455 - DNA, 4721 bp, Homo sapiens; identical to SEQ ID NO: 447

SEQ ID NO: 456 - DNA, 4721 bp, Homo sapiens; identical to SEQ ID NO: 447

SEQ ID NO: 457 - DNA, 4721 bp, Homo sapiens; identical to SEQ ID NO: 447

SEQ ID NO: 458 - DNA, 1178 bp, Homo sapiens
aattcaagctgtacccctccatggtcctacactctagagctaatctggttgggcagaaaggcagaaggatggtatattgtcccattgtgcctataatgtattttaaattggtcattccaccttacctaatggaaattcttgcagctttcctagtgctcatcagcggttttaggaattcactaacacccccaaaatttgttttttgttttttgctttttttccttttccttttctctgtgatatcatgagcctgtaaggacaaatggcatatttgggcataactgcttgactctgtaactacttttttaaaatcaaaattgaaaaggtattaattgcttctggctttttaatttttttttttagagacaaagatgaaaccagataggaaatacagtttttatgttttctacttactaaaatattagtttcttctaaatattactttatttgtatttcactaaattccaaagcaaaaatcagatatctgagatgaacaattttgaatgggttaaggtaggagtaataagcattgtgttcactcatacataggtgagggaattttatttatagcgagaaatataaaagtattttgacttactcttttttcaaggagtcgctaggaaagggtagaagaactgagaataagacatctagattccatttctggtttatatgtagctcttttgcctaatttatatataattttgtcataagataagtccagtaactgtcctgtcttagataacgtacagaggctgaagtgaccaaagatccattccttattacttttctaattaaaagaagagttagctagatttctagtagtagtattctagatattgataagacattattcctaatgccaactacaaatattcaactactcagaatgtatttaaaaaattgtttggtacagcattaatgttggtgattcctttctcccatcttatttcccttcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtga

SEQ ID NO: 459 - DNA, 1299 bp, Homo sapiens
tgctctgtggtttgaaagcagtggataatacgttaaacaaatgaccaggctatattccaataaaactttagttacaaaaatatgcacctgaaaaaaaaaatacgcacctggctagctttagtttgccaactgtgtgctaaaacatggataaggggctgtagattaaaatgtggaagccatttatatattttcaatcatgctaaattatatcccctgttgattttattgtagtaatcatttttctctctctcctttttcaaaattttaaaatgtcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctc

SEQ ID NO: 460 - DNA, 1239 bp, Homo sapiens
taattttttgtgtttttggtagagacggggtttcactgtgttagccaggatggtctcaacctcctgactttgtgatccacccacctctgcctcccaaagcactaggattacaggcgtgagccacgacgcccggcagatagcatttctttcagtagaagattgtttgtttacattgaaaatctgtggtttaatgaagccacatttatcaattatcttagccagatcttctggataacttactgcagcttctgttactgtattagtacttactgcttcactttatacttacatgtcatggagatggcttttctttaaacctcgcttatcgtttgaatatttctcccctccaaaacttctgttgatacttaatttccattgtggcaatattgagaagtgtggtttttcagaggtgattgggtcatgagggctctgccctcatgaattcattcatggattaatgtgttagtggattatcatgggagtgagactgactcattgctttttaagaagagaaaggggctggatgcagtagctcatgcctgtaatccttgtactttgggaggccaaggcaggaggattgcttgatcccaggagtttgagaccagtctgggcaacatagtgagactctgtctctacaaaaactaaaaaaataactagctggatgtggttgtgtgtgcctgtagtgccacctgtagtcccaggctgggtgacagaatgagactctgtctccaaacaaaaagaaaaaaggaagagagacctgagctagcatattcagcctctttgccatgtgattccctgttctgccgttctgctcagtactctgcagagagtccccacctgaaagaaggcccttggctgggtgcagtggctaacgcctgtaatcccagcactttgggaggccgaggcgggtggatcatgaggtcaggggatgaagaccatcctggccaacatggtgaaaccccgtctctactaaaaatacaaaaattagctgggcatggtggcgtgcacctgtagtcccagctacttgggaggctgagccaggagaatcacttgaacgcgggaggcagaggttgcggtgagccaagatcacaccactgcactccaccctggtgacagagcgagactccgttgcaaaaaaaaaaaaaaaaaagaaagaaagaaagaaagaaggctctcaccagatgctgcccatttaccttgggcttctcagcatccataactgtaagaaatcattttttt

SEQ ID NO: 461 - DNA, 1212 bp, Homo sapiens
ggaaaaggactgacgttctccaggtctccatcagctctttgagaatacagaaattggactggatgaagtattcattatcttaaaagacacaacaaattaactcaaagcctagcagcttgaaacaaagaactctgatgatctcatgaagtctgtagtcaggaacccaggcactgtgtggccaagcccccagcgtcagagtctccctgaggctgcagtggaggcgtcagctggggcagtgatcactcagggctccaccaggtatgatcaactttttagctcgcccaagtgattgttaggcagaattcaatccctcttggagtcccagagtaagagtctcatttggaataaggacctcagttccttgctggctgttagctggaggcctccctcagtttctcgatatctgggtctctccatagggcagctcataacatggcgacaggcttcaatcgagctagcaagagacacttctgctttctggtacttcaaagcttggaagatgccactgccccctaacaacaagcaaaaagctgaacaaactgaataatcaactcttcttagaactctaagagaagtgaggacccagggacaaccactgcccccagaattggagagacaagacagatggatacagagaatcacaacttacctaccagagcagaaattcatgagcagaaatctctgtgggaactagtgccaagatagaaaaatccaaactgtaaatgataaattactgttggctgtgtgtggacaagtctgagagtaaaaagactccagggggacccagacataaggggggctccatccacacttttgtgaaacttaccttcaaaatctcgaccaggttctcacattaaatgtcagagaaaaatgccctcatgcttctggcaaagggagggagaaaggaacgattttgaaatgcacagagcaccctgttcttaacaaggccttcccttaggagaaactattcaaccagagcctaagcccctgagattttatcacagcctacccgacctgggggagggaaataccctactccagcaactctagccatcctgtcccacataaggtggggaggagacaagggactgagaagcacttgtgaagttcagaggcacaggctcactaagaggctgagactaaccacaggaccacagaatgccttccccacttcacccccccattactagaggtctgtttacagcagttcct

SEQ ID NO: 462 - DNA, 1235 bp, Homo sapiens
acaattgtcacacattagcttgttctcattataaggaattacagcagcatttaacagcgtggacaagtcttagaaacaaaatagacgaagcaaccacagaagaccatatttttaaattttatttaataaatgcttataaatcacttggtatgtactagacactttttttttgagacggagtcttgctctgtcacccaagcgggagtgcagtggtacgatctcggctcactacaagctccgcctcctgggttctcgccattctcctgcctcagcctcccatactagacacttttctaacattacaaatactattatttaatccacacatacaataaaatatgatttttaaagctcaaaaataggcaaaagtaggaatacagacaaatgtcggggaaaaaataagggaatgatcttaaagttcaaggtaatggttacttctggacaggaagcaaggagatgaagtagagaaggaacatacagatagatgcaacagtattgatgatgtcgtagttcttttttaaagtagtttaccccaacatattaaaatattaacatgtaaccaataaaaaagttaatagatattttacattaatttttcatgttaactcttcaaaatcttgtctattttatattcaaatacacctcaattcagaatagacccacgaaacagtagtcacatgtggcaagtggttatattggacagcacagtatagcgagtgactacaggcgagttgtcatctgagtttaataagatggaagaatggcaagaactggcacattagtaccccgctcaaatcccacttcttccttgaagctttctctgatcccatcagcaaggaatgacatttttttgcacagaattcttatgaaactcctgtttaaacttttctgtgctacttttttatatcttctattgctgttattgatgtacatatgccaacatccccgtgccatttccttgaggaatcttttagctctccttagggatgttgtagtcataagttgactggtctttcacaaatgtttattatgttgtttgataacaacaagtgtcacatgtgttgataattttttcttagggcaggagtctcaccatgttgcccagactggtctcaaactcctaagcagtctgcccgcctcagcctcccgaagtgctgagattacaggcatgagccaccgttcccggcaataatttttgtgaaatcacgattctcacacaaatatgaaatgaatat

SEQ ID NO: 463 - DNA, 1173 bp, Homo sapiens
aataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatgcatttaatttctaaagtaaatgttgaattattaaaaaaaaagtttgaaggtaagatgccttagaattttaatgaaaaatgacactcaaacaaaggctatatgtcgaatgttataaactcttgagacataatgaattttagcagtggcctagagtaaggtaatgctttgtgactgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgtt

SEQ ID NO: 464 - DNA, 1210 bp, Homo sapiens
gaggaaacaccttgaaaggacactcctggtatgaaatacgtttttttttttttttggtaaaatcctctatgggaataattatcaattaggggataacctgtgaaaaacttctctgagtggtttaagtttaaaagatactacactaaattgccagtattgatgaacacataagtgtctgttgtcatgatgtagttggcaatggggcaaaactcagttacccacctgaatgccataataggttgtttttgttgtttgtttgagacggagtcttgctctgtcacccaggctggagtgcagtggtgcgatcttggctcactgcagcctccacctcctgggctcaagcaattcttgtgcctcagcctcccaagtagctgggattacaggcacacgtcaccatgcctggctaatttttgtattttcagtacagatgggttttcaccatattggcctggctggtctcaaactcctggcctcaagtaattcacctgccttgacctcccaacgtgctgggactacaaatgtgagccactgtgcctggccagttttcaaggtcaggtttttgtatgtgtctaaaaaatctcgttggattacatcactataaagaagatgttaatcgtccgaggacagtgctaacagtttgtcttctcttttagcccgttggcctactaagaaaaatgtgagaacctcatatcgccatcaagacttttttcaccccaagtaactctaatggcctgtctggctttcacatctgaggggtgggaggtcactaggataaccagaattggattttgatcagagcagtttgaatgctctcaaaatgtgaagtgaaagcctcatctgtaaattggctcatacttgtaaaagtacatccagtctacatattctgtcacattgtagtggggaaggctgagaggtaccacatcaggaggagagtcaggagtggcagcagcaggagaccccatgtgagagatctcagtgggaagggcagtctggagagccagggccatccacagcagctcagaagcttgcgaactgcaagttcttcttgattgatttcttctgagtgaaaagaccttcagtttcaccagttgaacattcagcagtatgtagctgtcagaaataatgctactgaaaaccagactttcagactggcttaaaatcctgccatatactgcttataaaacacatacctgtagaatttcagcagaga

SEQ ID NO: 465 - DNA, 1211 bp, Homo sapiens
tctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtattaaatcttatgagtaggaagatgaaatacaggtttattgtatagatacattatttatgaaggataaagatctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatacttagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagat

SEQ ID NO: 466 - DNA, 2333 bp, Homo sapiens
ttgacttttttttagccttcaaaaggatttcattcaactttctatggttagcttttaagaatattatctaaaaactgtgtaagctttttttttttttggatggattgaaacctattatggaaaggctgtcatcattaatgttatcccatacattatggggataccatatgtggcacccatttcacagaagagacgtacaagagatcgctaagttttaccaggttagacgtgattatacagaccttattattcccaaggcacacatggagtaaagaagaaatatagtcctaagaaattaagctagtcctagtataaatgatccagaattcttcctagtgccaacatatcagttggtttgaacccatgttaaatagtcatgggaaaacccatgagacatttcttatctgccttaactaacctgaataatttccaaatgcatgtttctaataataatgtgaacaactgcaaaacccatgagtcgtctgaagttttatcatttacaggtatgtgacgcattcccagactcttcagccaactgagcatcagcttcttcacagcaattgggtcctgattaatgtcctcccaagacagacttcattggatccacgatcaagaggactctgccaggtttttctgacccctctacattgctataaagtgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctagtaagtgactgataacattataaactggatcggtccctgagttcagagactgagttgcaattgagtgaaaaatagacaacgaaatcttgaagaattgcacggaggtgcaagccaagtttatttggctctccaaataatattggttgaactaagaaattggtaaacgaaacctgtaataggactggtgtttgggcgtctctctctgtcactgttgtctcttgctgtcacattgctgtctgtgttgtctttctaggtccagatgttttcagataattcacattgccctgattgtggacaacagtggttccctagtttagaactaggccactggttgtaccaaactgaacttgttgaaaatgaatgttaccaggtattcttagaccgtattaacagagctgattattgtcctgagtgttatcctgataatcctgctaatagaagccttgttcttccttggtctttcccacttgagtgggctccccagaatctcaccagatggacctttgagaaagcttgccatccatttcttctgggtcctccactggttagaaaaagaatacatgactctcgagtagctggttttaaccctgcattacagttaatcttgaccagaacagataaaaccttaaacaaaaaactgggccaaaacaaatagcttctataatagtcaaaattgtcaagtctagaggcttttgtgtaggtagcccaaggaagatggaaaaataattcatttctaagtctgacccagattgtcactactttgggaactgcttaaattgttggatctgcttccgtggcctatacatattttattcacatgaatttagttagtattccagccagcctgttcatctagactgaggctaatctgttcatctagactgaggctaatccgtatttcctataaactgttttggaactaacttaccactcctaaaaaaatttctgcaacctaatgagtgtcatatgacaaagtagtcctagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaat

SEQ ID NO: 467 - DNA, 1199 bp, Homo sapiens
gtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatggg

SEQ ID NO: 468 - DNA, 1186 bp, Homo sapiens
gagaaagcacaaagactgagaggaatttgcctgaggttgcatagcaagtccttgaagggccaagaacctgactcccaacactgatttacccatcgggccagcttcttagcccttaaatctggtatttcctccatggtttcattacgttccaacaaacagagattcctccatagcccctcagtttccattttgcttataccagttaccactggaacttggggttttaactaatttgctcctggattcaagagcttcctactctaaagtcgaccagccaggcactgcagataatggttgcctctagaaggtctcatttcatttttaaaattcatccatgtcattttagcaaggggggaaacagctaccatgtagcaccttataccccataatagacttccaagcaacagaggagtgcctctaagagaagctaaaagtaatgaatgcccggcttttctccatttccaaaccccagaagagtcctgtcatgcaatggctcattagtggcaccagcccacccataatgctaacccaacctgtagggagatccatttaaaatcttagacctactgtggctgtgcttctaaacaggcagcagtgtttgctgctttctggggaggtggctctggaaaacaaagctctcctggttttcaggccagtgctctcaagggtttttccagctaaccagccctactgatgccaaagaactattgacctcgtcaactgctcactgagttcctcaagagatttattatattattagtataaatgaggaaggcctctccttccactattgaactgggaattagtatgattaacttacaaaaactggtcaacttacttacagtgatcttaaacagtgctacacagaggaggatgccccccccccttttaaaaagcctgctctcccccacactatactcaccaaaaacttcaagggcctctgaaatcccatgagttgctaagccaaatagtcaacctgcaacagtgatctgggtgggcagcttttcatctggttcattgcccagcagagccttttctcctgtgtattttaagcagcctgctaagaagggtgtatttaaaaagccatcctccaaaaagacgactgcattttcctttcctcacatggcatttgtgtcttcctccccaccccagtgttcatgattggagaattcccaatagcacagaa

SEQ ID NO: 469 - DNA, 1218 bp, Homo sapiens
gctctgttgcccaggctggagtgcagtggcgcaatctcggctcactgcaagctccacctcccgggttcacaccgttctcctgcctcagcctcccgagtagctgggactacaggcgcccgccaccattcctggctaattttttgtatttttagtaaagacacggtttcactgtgttagccaggatggtctcaatctcctgacctcgtgatccacccgcctcggcctcccaacgtgctgggattacaggcatgagccaccgtgcccggcccacaagaaactttttaaacaaattttcagttaaactgaatgagtagaggtttgacctaaaactaagatttactatagagttttttttttttagtttgagtgctgtgtcaattctagagactacatattatgtcctgttcatatctttctaggaggatttgcttcattcatagacgatttataggtttctgaactttatgtaccaaaaataaatggtcagaattgatgcttctgtaggagaccctcaagtcccataatggcatttatttctattataatcttttggggaatgccacgtgagtggcatttagattgaaaacatgagtacaattagatttatgtaattctctgtgactgtgagaaggatttttgtgaggaggattttgtacaatgaaatgataataatcagcccttgcattctgcaggatttaggaatgccaccctttaccaaagttaagtagaaaatattaagtgtagggctagtgagtctgaggagcacataagcacctgaagagaatttcatttatgctaagaagtttactcctttgcatttagctgtaaattgtataataaagttgcctaactaaggttttactatctcaactcccctaaacacatgttgtgttttacctggtaacagatatcctaaatgtaggtagaaattaattcacctccatgtactactttaggttatagaaatgcttattgggttctttcattgcaagcaactgaagttggatgacaaagtaaaatgggcatttattgaaggatgttatggtggcacatagaattgaaagaacagaatattcagatcaattcaaaagaaaaaagtaggtcaactttggtgctcccagcagtgcaatgcatgaacttatttgtggaagaatgtttctcaaattgtctgcagcaaaaaaaaatctatatctgtttttttttaactcaatatttttt

SEQ ID NO: 470 - DNA, 1200 bp, Homo sapiens
cagactgccatagcagaatactacagactgggtgctttaaacaacagaaatttgttttctcgtatttctggaggcttgaaagtccatgatcaagattcaggcagaattcgtttctagtaaggcctcttttcttctttgcaagcatttccccaaacatggcctatcctctgtgtgtgattggagtgagggaggcagagagagaaagagacagagagagagaaagagagagaacatacgtgtgtgttgggcgggggcagtgggggaatctctggtgtctctttttttataggaacattagttttgtgggattaaggctccattagccttaagtcctcatttaaccttagttgcctctttaaaggccctgtctccaaatacaagtcacattgtggggttagggctcccacatatgattttgggtacacagttcacttcataatacccatgtagcacgtagtagtcacttttatacagttaatatgtttatattccttatttgataataaaatacagtgatttttctataaaacttatattgatattggggtggggaaaactcatgtcacctaggctctttgtacctcagttttctcatctataaaataacaatattgggctcgttgatttttgaatgctgaaattctctgattctccaattcagagttactgatttctaacattattcagcaggtacattataggaaacatcttataatagaaattgatgttctgtaaatgagcattctataagcttctcataactgaagtgaaaggcttaatcattctatatactggtatagataatctatttcctgtggtcccagctactagggaggctaaggtgggaggatcgattgagcctgggaggttgaggctgtagtgagccatgaatgtgccactgcacttcagcctaggtgacacagctaggtgctgtctcaacaaacaaacaaacaaaaactctattcaactagctatgctgggctgtttagtttttattatgtataatttaaaggtctggatatggtatgtttctttttttcttccagttaataatatcctttatttatacagtataatttatcctttatgaataccttttcattttgatgggttcaaacaatttaataagtgaagatagcaaaatgtgagaatccttctcatacctactcccctttcaaaggaggtaaccacaacagattg

SEQ ID NO: 471 - DNA, 1213 bp, Homo sapiens
tttcaggggactggcaaagttgtgactgcatgcgaagtgcaggccaagaacagagcagcattagagcatcaggcacctaggcaggtgtaagatcatggccccgtcatttgcacgttctgccccttttctgcttcaaagggtgccataaattccatataactgtatcttggggaatgtggagtccctgtgagagctaatccccatgtcctgccttccagatcggcgccaatggtgtgccatagccatcctctttgcagtcctgttggttgtgctcatcctcttcttagtgctgtgacggcggggcctctgggtgcgagttcctcctgcatatgaaccgaggggaggaggagaagctgagcacgtgtgacattgccgtctactcacattcctatcctggaaacatactgctgcactgacttttctccgtgtgaccccacaattgacatggctcctccatcccagcgctggaagggccagtgggaagaggaaatagatgtctgcactcctggctgcagctggacaacagaagccccatgccgcctgtccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacag

SEQ ID NO: 472 - DNA, 2073 bp, Homo sapiens
agtcatatatcattatataaatatatatcgatatatatatttgtgacatatgtcatggtgacagggaaaagttgacaaattcatgcatttgaaaatcttttagaactaaattagtaacaatacaggcatgtggataagcttaatgcttatgagggggagaaagtttcaaatgattagtcttttcaacaaacagtaactttgtactgcttgtcgggcactgttctcaccactgagacacacaggtaagaagatgcagccactgccctcatgaagtatttgttctactggtatcatattttggtgcacttcattcttggctccatacctggagacaaggttggactgccatcttttctgtttactctaggtacatcgaggaggccattgagaaactaagcaagcggcaccagtaccacatccgtgcctatgatcccaagggaggcctggacaatgcccgacgtctaactggattccatgaaacctccaacatcaacgacttttctgctggtgtagccaatcgtagcgccagcatacgcattccccggactgttggccaggagaagaagggttactttgaagatcgtcgcccctctgccaactgcgaccccttttcggtgacagaagccctcatccgcacgtgtcttctcaatgaaaccggcgatgagcccttccagtacaaaaattaagtggactagacctccagctgttgagcccctcctagttcttcatcccactccaactcttccccctctcccagttgtcccgattgtaactcaaagggtggaatatcaaggtcgtttttttcattccatgtgcccagttaatcttgctttctttgtttggctgggatagaggggtcaagttattaatttcttcacacctaccctcctttttttccctatcactgaagctttttagtgcattagtggggaggagggtggggagacataaccactgcttccatttaatggggtgcacctgtccaataggcgtagctatccggacagagcacgtttgcagaagggggtctcttcttccaggtagctgaaaggggaagacctgacgtactctggttaggttaggacttgccctcgtggtggaaacttttcttaaaaagttataaccaacttttctattaaaagtgggaattaggagagaaggtaggggttgggaatcagagagaatggctttggtctcttgcttgtgggactagcctggcttgggactaaatgccctgctctgaacacgaagcttagtataaactgatggatatccctaccttgaaagaagaaaaggttcttactgcttggtccttgatttatcacacaaagcagaatagtatttttatatttaaatgtaaagacaaaaaactatatgtatggttttgtggattatgtgtgttttgctaaaggaaaaaaccatccaggtcacggggcaccaaatttgagacaaatagtcggattagaaataaagcatctcattttgagtagagagcaagggaagtggttcttagatggtgatctgggattaggccctcaagacccttttgggtttctgccctgcccaccctctggagaaggtgggcactggattagttaacagacaacacgttactagcagtcacttgatctccgtggctttggtttaaaagacacacttgtccacataggtttagagataagagttggctggtcaacttgagcatgttactgacagagggggtattggggttattttctggtaggaatagcatgtcactaaagcaggccttttgatattaaattttttaaaaagcaaaattatagaagtttagattttaatcaaatttgtagggtttctaggtaatttttacagaattgcttgtttgcttcaactgtctcctacctctgctcttggaggagatggggacagggctggagtcaaaacacttgtaattttgtatcttgatgtctttgttaagactgctgaagaattattttttttcttttataataaggaataaaccccacctttattccttcatttcatctaccattttctggttcttgtgttggctgtggcaggccagctgtg

SEQ ID NO: 473 - DNA, 1192 bp, Homo sapiens
gtattggttttgatttgtttcctctgatagtttagtatttggatagtttagtgttaacctcagctacactgaaggaatagaccttagtcctcacaagtataagttctagcttggaagcctgggttctgcagtagctgtggaacttaagcctgtgagctcagggatgcagaggcattgagttactaccaagggcctgatcttttctttagcaggcatctgtgttaattgtttcaaaaggtggtgatcagttttacagcctattataaaggagatttttgcctactataaaactaatccccctgaaagagtgagtaaacataactttttgtgtgttgacttccacaagggaaggagttggcacttacactctgacttttgattcagtcgtccttcttgagccatttttgcaggggatcagtttggagtgggcgttaacaatgttattctttttttcttctccagaacaccttccaccatgaccacctcagcaagttcccacttaaataaaggcatcaagcaggtgtacatgtccctgcctcagggtgagaaagtccaggccatgtatatctggatcgatggtactggagaaggactgcgctgcaagacccggaccctggacagtgagcccaagtgtgtggaaggtgagacagcaatgtggagtggagcacatgctgggtgggatctgcagaggggtgggcagcagcctttgactcagcctctggattaggcctctttcttctgtttgtaaaggttttctaaggcagggcttttcagactttattcagtcaacattaagctcctacactgcctcaaagcagagcgacgatggaaccctttatttcaatggaattgtgcacgtaggccagtgtattgaagaaaaactaagtctggtttatggagagttggcatggggcttagaggttgccgacctggacatccccacttagctggctctaaggcaccctcagaaaaccactgctctaacctgagaatgccatctagtttacaaactcttagaaaactgtgtttaatactcatatcactggcttctagatgtgaagcaaatgctctacaatggtttttaaataggactaatttttagttgatgccacttttggaaattcttaaactaattgcgtatccctctaggagctacagttagattatagttgtgaccttcatttttcagtct

SEQ ID NO: 474 - DNA, 1191 bp, Homo sapiens
tgatttgggacttagttaacagcaaagcttaggattaggatattcacaagttaataattgggtgcatcttttaagaggttatttgagactacttattagcacaagtcatcataaagctaaactacccatttactcttgttattcacattgcctatggaggaaaaaaacagtatttttttcttggtagtaataaaaagatctcctcttcagctttataggaaatgtaattatctcaggggaccttattttatgagcacttagagtaaaaaaaagtctttagtatagcttatttttccacttcatgtattcagtgttaaaacaagcacaaagaagttgtcattttttttttttggaagaatttaaatgcaatgtattaactaatagcttgtttatataatagggcctttagatgcaataaaaagtaattctggttcagtttttgactaggattataaactatcaaaaacagcttttgcattataaaggatagtacaaagacagtattaaaaatttctgtgccttgtttgtatacctaaacttaacacagccaaatttaattatcattgattctacagactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggtttgcttgtttcattcttttccttctgtagtaagttaaggtggttttggatattcactgttgaatataatctatttttgtacgttgtctggttaattgtgtggattagaattgaattgttaaaagataacgttaatttgcacaagaataattattgatttgtgcagtttccatggttttcacatgagtgaattttagctgtgtaagaagttcagcgtaaatctttttgacatgctagacatttaagatgctcatttgaatctgaaaggcaaaagtcatgaccacaattgctggtttgtccctagttgatgtaaaagccagccaaaggtggtgattttttttttcaccttggtattgttagaggcagttactatttctttaatgggtcaggttagatacttaagctttgagtcccagaattagattgtattgcatctacatccacatttcacttaagccttgaaaac

SEQ ID NO: 475 - DNA, 1151 bp, Homo sapiens
actgtggtatattgtattgaagttacttctttccatgtataactcccacacaatggaagtgtatagataaatgtttgattgaatgttatacacagaggataccccaactggctctgggaacatgtataaaagacacctcaccctccttcaaggtctaagagagggaaacactgagtttgattaggaaaataaggttattgctactggaactttttggcatttgtgaagaatcagactagaggggtattaaagtagttttgaactatgaattagcaaatgaatttaggtctgctccattgtgaaagttgatagtacttaacctgactggattgtccctggcagaatattttctggaagactgcattcagatgacccactttgttcctccaccaaaagacaaaaagaagaaggataaggatgatgatggtggtgaggatgatgatgtaagtgaatttcatgaagaatttccattatgggcaaattgtcaatgcagagaaaaaaatgagttaatgtaacatgcaatgtattagcattacagcaaactttcttaaaaactgactgtaatgtctgcctttggattaattgatgtattttactgcaaaaaaattccaggttcagtgacaagctgttttctatcacaagttaaattatctctggcgtaaagatcaaaggaaaaagaagaaagaatgcgatgtttaaaggccaggcatggttagggacaatgctgttgtataaggttttgctactcaaagtttttcagtaggctgcagcatctgggaaactggtagaaagacagaatgctgtgccccaccctagatctactgagtcagaatctacagtttaacaagatcctcaggtgatctgtatatacaataaagtttaagaaacagcagctatagctttagctacaggagaccggtgatgacattatcaggtggacagagtattaaatcagggagcaatgagggatttcctaggagaaacaggaaagaaaagactttgtagtgcttgagagttggacgacgatagtatagaaatggattatctggaaatacagactgagacagccagcaatgcagaatttgctagaaaacctaagattatatctttttaatcaaaagatctgaagatgtaaatgaacagcagattag

SEQ ID NO: 476 - DNA, 1248 bp, Homo sapiens
gggaaatgatgacagtgttagtgagtacagtagtcctcccttaattatggttttagttaccttgtggtcaatggtaactaaaagtaggtggtcagaaaataggtgagtacagtacaatatattttgagagagtgagagaccatgttcacataacttattatagcttatgtcataattattccattttattattagctattgttagtctctcactgtgcctaatttataagttaaactatcataggtaaatctgtataggaaaaaagtggtatatatagtgtttgttaccacctgaagtttcaggcatccacagagtcatctcccatggataatggaggactaatgtacatgtaattctgaaaacagctttgggctaataggacttcatttatagaatcctcaccttgagataaggaggtagaatggaggtagagttgtgggaaggagaagttctacagcattagggggaaatatcagaaatctttagttactaaggttaagtgaagtgtctttggatttaactttttcaagtcataaagaagaaaaactttgcagaccctttgatgattagtgttttgttctcacagttcttgatggcattttcctactgttgtgtcttgtcttaaatgacaagcatgattctgaaagtctgttataactgctatattgcattaatattctcatctgtttcccaaaactctttgggttcttttctcagatcgcagaagttgagttctttttctttccttctccttcccaaagacatataatagtatttcagtgctgtgttagttgggatacagtataatggatgtgtctgttttactaatactgcctcttagaaaggttacgaattatttacttttgtatcaggtgatcacctaaccagattatctttgagatactgtacagtaatgagataattagtagtgaggtaatcaaaggaaaatgcaactggaagatggtattcaaagagaaaaatgagttaaagactgcttacttgaaattttttttattactggtgaaaaaagtaaaaaagcatagtgttgagagaaccaccataggataaatttggacattaaagagtgtcttaggacatctgcagaattttgtgtgtgtgcatacatacaacttgtgtaatatattatgaggtgaaatttttgtacttttaacatctaattctatgaaatcatattcctcaatttctgtttaagtaaccaaaatgacagtattataccttgtctgaaa

SEQ ID NO: 477 - DNA, 1199 bp, Homo sapiens
ctgtttctcgctgtcaagagggtgtaagtattccaccagcccgctgagtgtgcacgaaatgttcgcagtgcaacaaaaagaaaaatccatcaggaactctccgtccccccggggccctccggagggagagagagaggaactgctgtttatctcactcagttacttggtatcaccgcctctcaccttctccatcgtgcatgtccccagccacatgggaagtgaaagctgagaagggaaggcagatgggagaagccaatgggaacttctcagtccttttttcctctttggggaataaaataggaatccattaatgattgctttgctgactgagaatgtagttgaaattattcttaaacatcttttattattattactctcagtagtaaaatatcacactgaattcttccatacacaggtgtgcttctagtcagtgtgtagcaaggaaagccccgttcactgctcctgtgagaggttggtggtgacaggatggggaaccgacctcttcagccagtggaaatgttccataagggagagttcaaggcctgtcagaaggctctggtaggccttcctctggccaggagactccagcagggaatgcccttcactctgtaggtgctcgagccccaatcgaggatacagtgtgggtggtggtgctgggctggactagcaggtagactgctgtaggatttcaaattacgtttttgattcctgtacattttacagtcgcacagcaagcagtctcacagaaggcaggctagtccattcacagcctgacacgttctaataggtagaagctttcagtgtggttattttttctttggttggtttttgtgcccccattctacttcccaccctcctgccccatctccatcccttcttttacccaatgctgtatgctagtaattgtttttattcctaatgtgtgcaacatcacatctccccaagaagcaacagcatggggtccagcagttggggcccaaaagacagtctgaagaggaaggaagcagcagtatctgcgtagcccacagagggcccaggcccctgcccagctgcagtctcccagcctccactttcagagtgaaattcaaggcagcacggacatgtgcccatcaggcacagaagaaaacacgacgtcgtccattttggaagagacgaaagaaaggaaaataaactctttgtatgatatttattaggaggaa

SEQ ID NO: 478 - DNA, 1182 bp, Homo sapiens
ctatgcttaccacatccagcctgtattattgcaattgcctcctaattgctctccctgcttctaccttatcccctactcccacagcttattttctgtaacatagatgccaaagcaatcctgttaaaatgtgagtcagattatggcactgctcttaaaaccttccaatgtcttctcatttctctcagtaaaagccaaactccttacaatgcctgtaggccttacacgatctgtcctcccataacctctgacttactcacgtgcttttctcccaccaatccactccaaccacattgggtttttttctgttcctggaacacactgaacacacactaatagcactgttctttcctctgtctgaaacactttcctcagttatcccaagccttctttcacgtccttcaggtccttactcaaatgtcacattcatagtgtagactttctgaaattctaaaccctcctcatacagatatgtctaaatgttctgttatttattgacccaccaggaccgggcaggcagcattgtcttgaaggtgctcatctcttttaaagctaatgatatagaaaaggcagttcaatctctggacaagaatggtgtggatctcctaatgaagtatatttataaaggatttgagagcccgtctgacaatagcagtgctatgttactgcaatggcatgaaaaggtaagttatgaattataaatctatatgactggttcttttacaatagggaatgacaatgacaacctctctcacctaaataaccattttgatttgttgtacatttttgttattacaaataaaatgcatgaaaaggatagttcatatttatgtttactagccttggtcttaagagattctgattccaacacttgtgtttattcaacaatgattattagtaattaaacataatcttgaactctgaattaaatcaaaactttgtaaaagaaaataagcaatacaaatcaagaattctttcacagtgaccaaaaggtgaaaacaacacaaggatcataacagatgaacagctaaattgtggtacatacatacaatggaatatgattcaaccattaaaaggaatgacattctgacacatgctataacattaataaaccttgaaaacataccaagtgaaatgagccaaacacaaaagaactaatattttataattttacttatatgaaat

SEQ ID NO: 479 - DNA, 1243 bp, Homo sapiens
tgaggaaacaggctgggcaaggtggcccacacctgtaatcccagtgttttgggaggctgaggtaggaagatcacttgaggccaggagttcaataccagcctgggcaacatagcgagatcccatctttatgaaaagttaaaaaagtagctgagcgtggtcatgagtctgtagtcctagctgcttgggaggctgacatgggaggatcgcttgagcctaggagtttgaggttacagtgagccatgagtcactgagccactgcactccactctgggtgctggagtgagaccctatttctctctctctttttttttttttttttgagacggaatctcgctctgacgcccaggctggagtgcagtggcgggatctcggctcactgcaagctctgcctcccgggttcacgccattctcctgcctcagcctcccgagtagctgggactacaggcgcccgccaccatgcccggctaattttttgtatttttagtagagacggggtttcaccatgttagccaggatggtctcaagaccctatctcttaaaaggggaaaaaaaaagggaaacagaaatgaaagcttctgatctcaggcagaaaccaacccaccaaacaaaaaaaaacacacaagatcacaaaaccccgaatgtgcagcctttagcaccaaggccaacagtatagaggaaaacgatagctagctcattgtttcaaatacatatgcaattatggcaggtggatgtggagaagtatggaactagctattctctttaagacagagtgggaaaaaaacggcaggaatcattagctatgacttgggggaagctagatgtgtgaattttaatatgcagtatacctctttttgacttagaagataaaagattagaggaaacaactggttgctggctgaagtattcaagttgaaagacattgctaaaggtagagtattttcttagctcaggagaacaagactgtttttaggcaatgtactgtcagaaacatttagcatgctttgatccacagaatattacagtttagagagctcttgatgctacttaacataaaggtttaaatttacaaatgaggaaactggaccctcagctataagtgaccagccctgtggttcacccaagaatctagaagcagtgcttctttaccattcacgtgtatttgtataatagaaaatttgtgcttactcctgtttcagtaaccagtattcctgtaatcaagttatctccaccttgtagcagcaaa

SEQ ID NO: 480 - DNA, 1177 bp, Homo sapiens
ccgcatctggccccaaaatcattttatacagttggaaagccctaagatatttttctgctttcctataatctcttctgagtcttaattctgtacattgggctgatataaagtccagtgcacagaactattctggtttgctacttagtagctgcatctgtaggataattgtccagcttcttcctgcttttcttcttctctgaaataataatagtaactaccacagagttggtgaaaattgtacttatttagatgctgctactgcttcctctccctcccccttttaagttgcctaagttccacgtgggaatggtttttttattgatttgattcccagctcttagagagtatttgtcatattaggcatttaataaattctttttgacaaaatgaacaggcatttctatttttaaaaccactgatttttaagcaaaagacagatttaggggagttttaccttattacactttaatctctggatttaccccatctcatttctcttttaggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagtagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaac

SEQ ID NO: 481 - DNA, 1206 bp, Homo sapiens
taaaatgaggtgtaccaaaagtagctgaaaaaagttataacctaaatagttgatggtcatggacccattaagaaggaaagctgcaattttaatcatttgattatgaacttcctgtgttccttctccatcaatcaaattaaaattgaactatattaagtatcaattaattataccagccagacacagtggcaatcccagcactttgggacgccgaggcgggagaatcgctcgaggccaggagttcaagaccagcctggccaacatggcgaaccactgtatctactaaaaatacaaaaattagctgggcctggtggtacatgcctgtaattccagctactcaggaggctgaggcgcaagaatcgcttgaacccaagaggcagaggttgcagagagccaagattgcaccactgcattccagcctgggcaacacagtgagactctgtctccaaaaaaaaaggaaaaaaaaaattaattacacctttatagagatctttcctaatgttctgatgtttgctttcttaaagcagaagcagtctacagccagaccaccctgaaggcaccccatctcgtctgatctcggaagctaagcagggtggggcctggtcagaacttggatgggaaaagcaaagcacaagacatatcatcctcctaagaaatgtcaggatctttaacatcttgtgaactttctaaaacttaatgatgtaagaaaagtaagaaagagattagctatcaatcttttataggaattaggccttaaaggggaaatatcctgagattcatagatatttataaaaattattaaaaaatggagttaaaacataaatataatgaaatcaataggcttcgattcttcaacataaaaacaagccactctctacttctttagttgcataatgctttcacctttttaaaaagatttcaagaactcttatctcatttgatttacaaagctgtctaggtagacagacatgtgggtctaaccattttataaacaataatcagatactgttaagatttacatgtggcaaaagcaattttaatagcaaaatcagaataagaatccagacctcctgaccattaaattctgtgttctcacaaaatctttaccactaagtgaaaaatcaaaatatcaccataataaaaaccaatgatgcttaatcaatattttcatgtttagtaagcaaatgtttccaaagtatataaagg

SEQ ID NO: 482 - DNA, 1270 bp, Homo sapiens
gctagagacatatatcacaatttgttgagatagtcctgcttcctacatgcttttctagtataaattattaacaatatcccctttcaatatcaaaagtattctggtttggacaataattatgcagtttctctaattagagagaacattagtggtttaaataaagtgtcacacagacctttgaaggacaacactttagaaaggctgaataaccaccatcgattactttgtatctgttgaagatgtttactggctttgaaaagaatctgaatagtagagtgagggaaatttacagtttagatgccacttacatagtggaaatgatgaacaatttgacacctgtgtcactgcctttttcaaatttaatcctttatagcctgaagtgagtcttttttctcgctaatgaaagctttttagtgttctaataataaacctaaataagcttgtatgtcacccgcacacatatattaggaggtgaaaagagtttagcccagtattctgttagagggatacagtccaccactgactatgaaactaactatcctcagtttgataattagacaaaataattcaaagaactcactgacagctactatacccatatatatgcttaattaaaggaaaaggttataaattaaaattagacaaaggaggatgaagtacatagggtgaaatctgagaaagtacctgttactttcccagcttcaatgtatgacagtatgcaagaggtatggccaagctcccacaggtttgaggttcagagattgattgattgattaattgattggttgatttcttcttagggacaggtcttgccatgttgcccaggctggacccaatctcctgtgctcaagagatcatcccaccttagcatctgaagtagttgagactacaggtgcatgccatcgtaccctgcgaggctcaaagttttcactggggcctcattatataggcataattgataaatgtctacatggttgatttaatctctaggtttactagtaccccatgattcaatgtctgtaccttaaatcacaccattggtctttctgatatggtcagtccccatggtaaatcagtgttaatatctgtctagtccaaaccaccaagggaaataaatacctcccaggagcgatgagaaaaggctagacctcttcctggcccaagttaaattcttttttgtttgtttgttttaatagcttttgtttttatcattttttatttttttatttgttattatactttaagttttagggtacctgtgcgcaatgtg

SEQ ID NO: 483 - DNA, 1914 bp, Homo sapiens
ctatctactaaactagctcttggggaaatagcttcaggatactgtagtttcctctatctaatagagaactttttgttaacagacactgtaaaatagttttgctttgttgaataatacgtgtgtacctaaaagaggtaagagcaaaaagtgtaattccacatcatgttacttgagaagtgcttaacgttttcttaaatgttttcattgggaaaggacagctttgataatgtccaaatactctgaaatgcactagaccatataactgtgatgaaatatgaaactcatctgtaaacttttataccaagggggtaaaaaaaaaaactaaggcatttgattaaattatgaatgagttttacaaattcctttcagagttttactaagatcacacaaataacagctttcttattcagtgaaaaagatattttatttctgatgttttatttgcacttgtggaatatgttaccattaatcagaaacatcatggcaacccctaagaatagactaagtttgtgttggctgagggattctatttggtttgcttttttttttttgctttgttatattttattgctacaaggggtgtgacttgataatgatttcctctgaattataataacatagccagatgtagtctcacactgtttttcatactcttaagtgtaaataatataaaatgtttcaagcgcttaactccccctcattcacaaagtataacaattaaaatctcaactataaccagtttagctttttccttacttttaaaataaaattttttacttttaactatttttttagttaatatttttaaaagtatacatgtcaatggcctctttgtccattattcattttgtggcaaaatattcttctttgatagtgtaaacaaataataaagcaatctaggtcctttaggtttgaaaggcaatttttgagtagcatattaccagctagccagtcactaggaatttttttcagtattatttgtatgtattaaacttttcattacactaaagtgcattattttattgagcaagtatccttcattgtgaggtttaacattaaagcaatctgttgaaatgccattatctttgctcataattttattatggccgtctaaggtagcttacacataaaacctgtttgcgtatctgttgttctctaaatattaattgaagatttactgaggatttgtaaggtccttctcgctgttatgtgaaaagtcaaactgtagttaatgtaaattatagccttttaggtgcttgggggttagagggtttatgttttttgggaaagggggactttagtagtctgaggatttctgtacatattttcttctgttttatgtgaaatttgggctctgggaataagaaaatattcctttcaaatttatttgacatattaatgctggttttgatatgtacccattccttcaaggcaactggtatcagtttttaagtgtgatttacctgagatatttttgttcagcaaagctcatagcaccctcacccccactccagacatgcattgcttctgatgttgttcacgtttttaaccctgtcaagcattgaactgaatatattagctacttttgacacattaaaatattacgttcagattgaatttaaagtttaaagaaactaatagaattacgtaatagttattgaattgtttaagtaaacccaagatcttaaaaattataacatgatcattttattcctaatagaaatgttaaatagaatatagtacaaaagtgcattaccttcagttgtgtactatttccataatacttttagacaaatatatctataagttaatattaaatccatcaaggatacaagattggatggatatgacctttctgaagtatttaggtaggtctaattaaatggactagggtaacatttaagaaagaaagga

SEQ ID NO: 484 - DNA, 1177 bp, Homo sapiens
atttttaatgaagaatttgcattaaataacaaaatgttagtttgtgtgaccatctcagacaaattgactatatggaatattaataaaatataatcttcagacattactaaaataaacatctaactacaaactttttatcaaaatttcagaatagacataatttaatcttttacatataaggggtaaagggacaactgtttgctgtgatttattgtactgaattttcaacaaaagttttctactactgtggctgcagtataaacttatgtatacacaactagaaaattttttagaaatagctattaaacattattatgtgtcatatgagttcaaaaaataaaaggtttgtgctcttttggatacattaaattctacctcagggttgtggtattgggaaacagtgcagatagtagtgtaacgtggagaaatagcttttttacaaaatatctaggtaatgaaataatctgtacaacaaacccccacgacataagtttacctatgtaacaaacctgcacatgtacccctgaaattaaaagttaaaaaaatacgtatctctctctgtctctgtctctctgtctctctctctctctctctctatatatatatatatatatatattatatatatatatatataatatatatatataataaaatacaattaaatcttgcaaaagaaaatttagatgattatcttttttgggagattttcccactcacacttctcaaatgttattatataatggaaaccacatataaatgttattgagcataatagtattattatctaacaataaaattaggccaggtgccgtgggtcatgcctgtaatcctggcactttgggaggccaaggtggggggatcacctgaggtcaggagttcgagaccagcctgaccaacatggtgaaaccccgtttctactaaaaatacaaaattagccaggtatgtggtgcatgcctgtaattccagctactcttgaggctgaggcaggagaattgcttgaacccaggatgtggaggttgcagtgagccaagatggcgccattgcactccagcctggacaacaagagcaaactccatctcaaaacaaacaaacaaacaaacaataaaattaaccagatttagtttgcatgaagcattaatagaattgttttcgtacaatctgagttgtgcaatttt

SEQ ID NO: 485 - DNA, 1177 bp, Homo sapiens
aaaggataaaattcatcttgcaaaagatttgtttttcttggtcattttttaaaagaatgagtatattatttgcttcctgaatttggagattttagataccatgatgagtaatatctatctttgctcatagctttgcaagatgaaaaaaataccattaaagtgcatatctcttacattaatctttaactaaaaaagtaggaagggatatcaattaaatattaacccaataaagacattgaggtttttttttgtatttaaagaataaaacattatttttttaagattatataaaaacgcagaataagagcttagtggatctaacaaaataaaattgactctgacagttcaccatgtctctcaaatatgaaatgattcaaaaacaaagttttgaaatttaaataaccattagtgttcaaaatggccctgttctcttacttgaacttaaagaaagacactagatttcaggaattagaaacttctttcagtaattactattggagagtctatatttttgcttaggttgctgtcagatctcaattttcctcaacagttcagaaagctttgctgctgtcagtctctccatataaacacatattaaaggtttagtctatggaagtggtctgtggcctctggaccccggaaagagttgagggctaggagtatcacactgaattctgaacgctaagttaaaagatacattctgtacgctttacacttcagcagattgaaagactctttcttagggaaactgaccaacccacgtggaaggccctaaaaatacagatgtgggagattctttaagtttgtaatccagccagatcaccatgaaatgcagcaataaaaagaatctcacccagagctttcagttaacttattagtcatttactctaagaagaagacaactaaaaattcccaacagaagtgaaaaagcttataatatgaagttcaggaagttattgataaactagagcaagaattcaaaacatggacaatgagtaaagaaaagataaaattagagaattagtctaggagttctaagatttgaatcacaagatttcaagaaagaggaaatgcatacaaattgaagaaatattactgtaataattctagaaaaatcagtagtgtgttagtttccaaatggtaagggttaccatgtgtccacaacagtgaattaaac

SEQ ID NO: 486 - DNA, 1210 bp, Homo sapiens
tatatatggcaaggaagtaaaaattatctgagatcacaacacctagaataaatacttttagcatttttaaagactccatttacaaattctctctatacacagacatatagataacatatacatactggtatgacctaaagtaatattttaatgactttttcctcatttgtaatgtttttgttgttttacttgatgatgatgcatctgctacttaaattctcttcttattaggtattcaggtagattccagttactctcctgctgtaaataatactgaaataaatattattgtgcatgttttctttcctcctagtgttttttttatcaatgagattaaattttcatttgaaattataatttggctgtcagctttggtttcactcctcattttggaggttatctacgaatgtgcagattagatcccacattctttttttttatgataaattcattttatgaaggagggtttgaacactagtttttaccaaaatatatacatttccttctatgtatttatccaacttaatgttaaggaaactggtaaaagtatgtctttccattggagatctctttgaaatttatatatgagatttgtaggacttttttttttatggattctgaagcctatttcacaagacatagtctagactgggaaataagtatgtcttttttaaaactcttatttaaattctttatgacatttcaattgcctaccaatatcacagaccaaagaaaatgccattagtttgacgtaagcagatttcttttggaattttaaaaatacgaagttgattgtattacaaatttcagatatacacattagaaaattatttcttttggaccctttaggaaagtattaatttcaccaaatctgctatactggcagtgtaaaagtcttaaactaactttattattatttttgtccattttccttcccctcgccccccaatccccaacaggccttggtatgtgttgttcccctccctgtgtccatgtgatctcattgttcaatgtctaccgatgagtgagaatatgtggtgtttggttttctgttcctatgttagtttgctgaggatgatgccttccaccttcatccatgtccctaaaaaggacctgatctcattcctttttatgactgcataatattccatgatgtgtatgtaccacatttttttatccagtctatcattgataggcattctggttggtt

SEQ ID NO: 487 - DNA, 1177 bp, Homo sapiens
taagaaacccaacctattttttttgcagcctaaaatcccatttaaggttaggggttggtccttatgccagcaagatttaaccaactgtaaagatagtagtctttgcatacatttaagtaattaaggcatttattgctgggagaataggagtagcaaaaatatggttttaaattggtgctttattaggtgacttccttttaggcgatggcaggtcatgaaataggtacactaataattttctatcaaccttaaaaagtgtcaaagcatctttgtagggtgactctaaactgctaattaagggttaataagtaattatcattggttgcttttcaatataattgcaaacaaattaaaaacacagttaaactaatatgtttataagcttgagttttcttcctaccatatcactctcatatatcagtgatgaaatgtcagattttgagcagtagctctttgacagtgtccttttatacccagtcttttctgcattgaatgctttgtgccttttcgatgtgttgtagttgcttagagttgattctgctggctagattgtactgattaatagatttttatttttatttttttttggttatgggtgttatgattgtgttgcctgctggttgggcaactttttttttttaggttgctttatgtttatataggcaaattggcactaagtgttagtgtgaatatttgtttttatgatttatatatcattttaaaaatctctgttgtggcctttatagttactgtgaagccactcttgggcctgtctctatatgcttattagaggaatctgacaagtaaaataaaatgagtagtgtgtctgcatctgtgtctctgtttctctgtcttttaaataaccagtaaccataactacacagccctgcactgaatgaccttatttcagtttgcctaaaactgaacaagaggtgatggtttgagatgagtttctcattaggagcagcaacatcccaaccaatatataatgagttgatcaactcaggaaaaattaggactttaaagaaggttgtatttggatattctaagattcagtgccaaatttaaaatgcctagaaatgtattctacaagtagcatttctaaaactttaagtagtgttatagtaaatgctacttgctgttagagtgaataatggataatgtgagaataattttc

SEQ ID NO: 488 - DNA, 1229 bp, Homo sapiens
aaatgttgagactgggatactagaaacattcatggttcttttcaaagatctgatagttatcctagtagttcttaaaaactcattcatcataacacagaaatgttaagaatgaactatcaactctaagcacttatttttttgcattgtctgatatcgacatgtcacttgcttgattatgggaagtactggatgactcagttaaatggaggcaggtgagtgaggtcaggaatattcctgctgaatggtgacttggggccaagaaaaatattagttctggatttgagtgttcagactctgccaagtatcagtcaccatcaagtttccatgataccctttcattttttaggtatcacatgtacatacagctcagtcaataattttcctttggatgggagtagtgttgctacttaaatatgattgatcctctttttttgttatttatgagctgtagttgtaatcaatgaaatgtcttattaatattctcagaatatttaaatggtacatgtaactagaaggaatattgagtttttgaataaccttgaagattgaaaagacactttatttcaggaaaaggaaactattaataagcttggacgaatatgcttcaactctagaattctgaaaaaaatcagaaaactaaaaacttctgaagctctatttgaaatctctcttcaaattggtaagcacatattttgatatttaagatttcatactgtgtcaataattcattttagggaaactttgatagcatcatggaattattacttggaagcataaagaggaagtctatttaaataatctttggaaacataaagaggaagtccgtttgaacaactagaatctatggatattcttggttaaattggatttacgttacattttaaattaaaagttgagtttgaaagattatgagattgaccagtctttaaatctttcttcattaagtatatatagaatgaagtatttttctttggtttaacattctttaatataattaattttttttctgcctaaagaccaattataaagtttttttgacaaaaattatgatcacaggtaaaatgcaccaatgatttttcttaaaaacatatttttaagcctcattaaaaaaacttttatattacacgttttaaaactatataattggccaagaatcagattaatgttttgaaatgtatattggtttattttaggtcaatttctgcaaaataaattttcaaagattaaat

SEQ ID NO: 489 - DNA, 1197 bp, Homo sapiens
ggagccccagcagaacctactcttcctggagtgcttcctttcccaggccccagggaggggcaggggccccatcctgcagatgctacagacactaaggcttccagcagacctggcacactgtgttcagctctgcagatgacaaggcaaggtcctcagcctgcagcacttggggaggcccagcctcccagtctggggaaggtaaggctttggggttcgttctttccatgtcagactttcaggatccaagacccttctggcttaccgtgccagatcttctctttttttcttcccactacaggatgctcgctctatggcagcagctgctgcatccctcgggggaccccgagcaaacacagtcctggagcgtgtggaaggtgcccagcagcggtggaagctgcaggtgcaggagcagcggaagacagtcttcgatcggcacaagatgctcagctagatgggctggtgtggttgggtcaaggccccaacaccatggctgccagcttccaggctggacaaagcagggggctacttctcccttccctcggttccagtcttccctttaaaagcctgtggcatttttcctccttctccctaactttagaaatgttgtacttggctattttgattagggaagagggatgtggtctctgatctctgttgtcttcttgggtctttggggttgaagggagggggaaggcaggccagaagggaatggagacattcgaggcggcctcaggagtggatgcgatctgtctctcctggctccactcttgccgccttccagctctgagtcttgggaatgttgttacccttggaagataaagctgggtcttcaggaactcagtgtctgggaggaaagcatggcccagcattcagcatgtgttcctttctgcagtggttcttatcaccacctccctcccagccccagcgcctcagccccagccccagctccagccctgaggacagctctgatgggagagctgggccccctgagcccactgggtcttcagggtgcactggaagctggtgttcgctgtcccctgtgcacttctcgcactggggcatggagtgcccatgcatactctgctgccggtcccctcacctgcacttgaggggtctgggcagtccctcctctccccagtgtccacagtcactgagccagacggtcggttggaacatgagactcgaggctgagcgtgg

SEQ ID NO: 490 - DNA, 1199 bp, Homo sapiens
tggtcaaagagccaagagaacatgtccactgcattgactcctgcatatgacactgcatgctagagtggagcctccctgacaacccgacacatttgggttcaaattttaactctgctactcactgagatgtggctttgggcaagttacttcaaactttgggactcagcttcttcacatggaaagtggatataacaaagaacttctggggtcattttcaggattaaatgaactaatgtacatgaaaaaagattacaataattcttaagattatttgttaaattaacatggatagaggttattttagatcctgtaatcctggctctgtctgctttctaagtgatctcaatccactatacttcatctatccatttactgaacaaatatttattgagccctaattctgtgacaagcactgcagtagatgctcaggatacaaccacaccagccagtgcaggaattttctgctgctctaaagtcaggagtaccgggctagatgacacccaaggtttctcctagcctccaaattctatgactttcatttactttcgctgatgcaacattagcctgcattattcttgggaattcttttgtaaggccctcaagacattgtcagatggggattaaaggctgcttctctgtgggaatctggggttctgtcttggtggggccttaggatgaagcagcatttgctttaagacacagatgtctcacagatatcactcctgattgactgtcaaaggtcctgggtcctggggagaggagagggtgaggagtttataagtttggtgttcttttgtcatttgcttgattcttccattcctgagttcttttgggggctaattttggaggctatgtctttcttacatattacagcttggggatgaaaggagacaattaactagatttgctgtgaatttacttccctcgcttttttcctgattcttgatggcaaatgacactcttagtgcaaaataaacccagcacactgagcccggtaaactgacagatcaagcacagatgtgaataaaagggcttttacacaaagggtgatgaccaaattgagaaaatggcttaggaatgcagcataaagggattagatgaaacccaaggaaggcagatcactgcaccagcagccggaatggatgattatgctgacagtacagatggtacgtgtctttacttaaatgacattaccagtt

SEQ ID NO: 491 - DNA, 1173 bp, Homo sapiens
tctagaggctatgttgtgaaggtccttggggtgatacagccttggaaaaatgttgtttccctgtggattacctaaactagatccaagaacatgaaagaccatccctcagggagctggcatttgtctaaaaaccagcattccctgtgccatttgattgtggttcttgctccactgcaaatgggtgacttgcaatgtctcactaatgccactcttgctctttcctccaggcatatctcacagatttcctctgccagtttgctcagcagccctgctacataatgttttcaggccaccttaatgacaatgagaggcgagttctacagaccatcggcatctaaaaaggggagcctttctacatttgctccttctgggccagccgcaaaccattttgcagccctcactggccttgagatgcactttcttctcaacctaaagtggcatcttgacccttggcccttggcctcggcagtgacactgatgacaattcagaccaggctcaccggtgccgtcacttaggaatgctggaacaaaggacatttctcaaagttcccctgaagacatgccatctctagaaccttttttctccccgactctacccccacctctgttcctagagccctctgctggcgagtccagaaacattattgcccagaaggattatgtgtttatggattattttgccccgcctcaggagcgcaggaagtcactaccatttatattctaaaacagacctatctatgttcataggacttctgatgtgttcagataggaatcctcatgagagatcattatgctttgtgccctggaccactgctgctctgggttctcaggaggaacaggcaagagcagcttcattctaagcctttccagtgacctcagccttgcttctcttctacaacactaaggctcctctgtcagaggaggtcgtcttgtttttgcttcattgcatgacataacccttcccctcaagctgttcctatatatacatgcacacacaaaataagccagacagatggcaatttgatcttccttttttagaaaaaaaaaaaaaaatggggaaaagggattttttttaaatccacctgacccaactatatttaatatgcctctcccacacattaccacagagtctgatattcaaaggttatcccctttccctcaggaagcctctaa

SEQ ID NO: 492 - DNA, 1175 bp, Homo sapiens
gaatcgcttgaacttgggaagcagaggttgcagtgaaccgatatcacaccgttgcattccaaggcaagactcaatcacacacacacacacacacacacacaaatcatggggagaaagatgaaacctgtgttcccctttttttggtagtgcccacatctggtgccccatttttaataaccacaggatatttctttagattgatattctcacaaagaagaaatagaatataggctgggcgtggtgtgtcacacctgtaatcccagcacttacggaggccgaagccagcggatcaccagaggtcaggagttcgagaccagcctgaccaacatgatgaaaccctgtctctactaaaaatacaaaaattagccaggcatggtggcatgcacttgtaatcccagctactcgggaggctgagacaggagaatcgcttgaacctgggaggcagaggttgcagtaagccaagatcgcaccattgcactacagcctgggcaacaagaggagcgaaactctgtctcaaaaaaaaaaaagagaaagaatataaagtgaatctgaatctccactcaaggggatggccccaaggatattgtagctggtaatttcttcatgccactaggtgtccccagtgttcaacctccatgactgagattggaagaagtagagttaaaagtttttactacctttgagaagcctgcgggcatgttcacagtcgtcccatgccagccaggttctgaggctaactgcttgtgcccctgctgcttcacatggcattgtgggagttgctgatactggggaaatgatggcagatctgaccaagtggtgctgagaaaaccaccctcggccttgcagactccatagtttatctcaaggcagtgccagtcggatttggtgctaaaggcataaggccaagtcagcctctgatattggcacaaaagaatggtctcatgccagtagcattgaactgctgagcttgggaaggcttaaggctcccacacacagactgagaatgatgggggtccctctgcgtctgctaattagacaaacattctatatctagtgccaaaagtggtcctaaatcctttggcaagggtcctttctgctctcatgctgatttgggggaggactgggcatcctgcctcaggagaacttgagtcctgaggaaagggccctagtaacac

SEQ ID NO: 493 - DNA, 1222 bp, Homo sapiens
agcttgtcgccaagcggttgtgtgatctcgggcaaatcgatccccgctctgggcttcacctcctcgtttctaagattccagggctggacccggtgattctcaggtccctgctggctctgacatgctgtggctctgtctctttcccagcacctgaattccgctactactcattcagggccatgtggcgcttgccagctctggacttcttgtttgtttttgagaaagtgtctcgctctgtcacccaggctggagttcagtggcgtgaccatagctcactgcagcctccaactccactcctgggttcaagcaatcctctcacctgagcttcccatgtagctgagactccaggtgtgcgccacccctcctggcatctctggacttctgatacccttaggtttggtttcttgggcctctctgctgccccagcacggccagtacttgcaggccttataagctgttctcttttctcctatcagacatcaccctacagtggcttattcaacactcgaagtcacggagaagctgagactccagcccttctccctcagaccagggaccgtcatcatctaaacctgaagccgagctccccgcccacccctgtcgtccccctaagcccacccctcctcacccagtgtgaggagggccctctggggaccccagagtcctgttctgctgaggtttgaactcctgtttttattgtaaaataaattgccccccattctggtcccctaacttctcacccttccccgctgcctttgtcccatcacccagccctgcctccctcccagcagccctgggccacagcccccgcccctggcttttccccggcccgctcttgtacctcccttttcaacactctctgttattgtcctgtgtgtacagtatatatatgtatatatattttaattttttaatttaagcaaagactaaaatcaaccatttgatgctgcaggggcctttcaggatctgggagggggcagtctggagagaaggagggagacgcaggtggacttggggcaagttcagatcagaagaggtgcaggctggcacctgcggcaggtaccagcctgggcactggtggccgcctccctgtcccgtgtgtttccaccgcccaatctggcttgtcctggcagtgcttgaatgccacaggctggcaggggcctctgggggcccctcccctcgacccccagcctgggtagagccaccaggtacgacgaccagg

SEQ ID NO: 494 - DNA, 1187 bp, Homo sapiens
tgacggggcgaaagtgcacgggccttcctgtcccgcgggtagagggtcacgggacggggcggccgagaggcttgaggagggggtttgggcaagcccagccccacccagagggcttaacccctccttgccggaagaggaagccccggccctattgagggggaggggaggtatcccccggggtagaggagtcagctgaggcccttggctcaagcccagactcctccccaacttctccccgacccgcagtgtctagccgggggtccagggaggatcgcatggtaacgggagtttggagactccgtctggctcagaagtttgcaggagcaggtgctcccgacaagagaggatgaggtgtaggggcacggcccactggggccttgggagagtggctctaagggctttgggtcgtcaacactgaagtgggtgattgtaagtctttcagcgccaggggagtggtggggaaggagttaaaatctctctcaaaaaaggggaagatgagctccatgggtgtgagctgaggctgccgtaatggctgcggcctgcctgtcagagccaggctagacagggcttgtgggtcgaggaagcatgggacaggggctggggttgtccagggacctggccccagtcccaaagctgaggtttcccacaactgtgagttggccagatagtaaccaaagatactgatgagataggtcagcagaggaatgtatccagccggcctaggtacctctacctgtccgtgttgttgccccaccttgcagaagatgggcctcctcgacagttctcagcgtcctagaaggcaggggacgtcacttcattggacctgaggcatgaaggcagatggaaagctcgaggggcgggcatcctgtggttacacaattgaacactggcttcctttcccaaacatgctctgcaaatgacctctgccctttctcgacccagtgtctcctgtctcctgacctgacagggcaggatcttcaggccaatgctgcggttttggcacagtaattttcggagctaacacccctgggctctgtctgcctaggctctgcccttggggtcagagaccctctggttaaacttggcattgacttaggctcttggattcccagagcaggcacataacacctggactctgacctgactctgcaggcctaggtggcttgggttctaggcgtttaggtctg

SEQ ID NO: 495 - DNA, 1220 bp, Homo sapiens
tcctttttttcccccctgaaaagctcaagtgtgcttgaatgtattctctttataagatggaaaggaatagaacaatatgctccctattttacaaatgggaatgctgaggccctaagagcatagagtcatttgcttaatatgacactctgagtcagaggcacagtagagaccatcacctaggccttcttttcctcctcattgaatttactgaccatttcttctattgaatttaagtattatccattcagaataaaggttttgactcaggggccagtccacagctcagaatgcaacagtctctatctttagggctttctgataactgccattcagtctttggattgcttgtgagaactatagaaaccaacaaggtcatctgattataaagggactgatttgacaggacagaaatggcaagtggcaagctgttggcagatagctctgcagaaataccagggccaggcagcagctgtcacaatagggtagtggttgggttcattttccaaagctccaagttttccttagcaacaaaatgtaaacaattcccattgctaatattagagtctaatagtgtctgactttgattcttttgtttttcctttagctttttctctctcacccaaccctgaattttacctcttttttaattgtgctctttcttttctttgtagaaatggttaaaaatagtttttctccacaataagctaaaattgtctttcccaaatagctcacattacatatgactctgctttgcttggtcaagatacagtgagtactggctgagtcatatataccacacttatggaccttcttcagtcccttggggtctttataagctaggtagttatacctactaatgtgaagctgtcagcagattaatttggcatcatctttggaatgttcaaaatttaaaccaagaatttaaactctgagttatggtttttaaaagtcatttgatttgttcccctgtgtccaagctaaagactggcagttgtcaattcaaaaaggtactcaaagaggttccacaaacgactccaatctttctccagttttgttctaaagtgattagttatctaaaagtctgcggccatgctgccattaccaagttttttctctactgatagaaataagctctctcttcctaagtatgaatattgaacaagaagagagtgaaacatatgtagcagtgggtacattttctactatattacaattctgga

SEQ ID NO: 496 - DNA, 1220 bp, Homo sapiens
cccaggagaagacatttcaaccacttctgagcactggcactttggccaacacaaacaacaggaggtcaggtgggtgggcaaaagagcagggcatgaggccagttaggagagcgtcaagtactgttccctgtgttctctgggtagccactttcctcccctgtgcttcccatcctcccctgacaccagcatcaccagctcagccctctgcagtggcatttagcctagaagaacgcatgcctgtggcctcagaatcgtaactttactaaacctttgattaagacatagggatgattcccttttattctgaatgtattgacctcaataaataaactcttagcaccttaacccagagttccccttgaatcctcctaagtcaggctagattgatggaaggcagagggagaagggagacaaaaatctgagattcaggaggttgcggggagggcactagccttagctcagcctccacccctactctctaaaaaaagatctctgcacagccttagacctttctactctcagttgcctcacgaaataatagatgtgaagtactttgaactacgtttaaagtgctgtgcccactccacttcctgggagatgtgggtgtgggaaacttgagaggagagccttgcgcagcttcttctgtttacctggtgttggaccgagcatcagcttgctctctaccacactaggaggtagggcggtgggggtttttaactccccaatttacagagaggaaactagaacttgaacaacccagatgacttgcccagaattacacaacacgcagacagtgagctgagactggaagctgagttttctgactcctggcccactcctagcttcttaatgtttgcgggaatgtgggaatgattttaacagaatcccattctggaacaactcaaactttatcatttaactgcagagcacccagatcccactattccccacctgtcccagaggccttggattttccatttaaacccatttctgaagaggcaaaacgatgcgggtcaagggatgtttgcctgatgaaagcctcaaagtacaaagtcccaaagtactgcagcttagtgctgctgccccaaactgaagtcttccttcccaggggccctggctctgcgcagagctggtcagaagcccaggaggagcgtgggggcagagcttccccaaaggaggacagatgggcaggctggcctcagtacccgtgctttcaacaa

SEQ ID NO: 497 - DNA, 1256 bp, Homo sapiens
tcgcccctgggtcgcggcctatcccgggaagtcagagcggatccttcagcttcgccgtaacgacccctcccccccacctcccggtcgcggccctcgccggggctggctgggagccccaggctcccgctcacttttcccatcctccccacccccaccccgttcaccccacccccacggcgcctgctcctttcccagccaaccttcctcccctcccccacatccggtgttcgctaatctcgaggagcccggagcagccccgaaaaccgactgttcccccgaatcccgaagagagaactgacactagattgctttcttcggggcaacagtttctctagttgagcggaccctcactgcctaaatcaatcagactgagtgccgggcgctgaatttacctactctcattcctctccagggtcccggtactttggagcttgtctcaaactccacatacagaaagccaccgaccttattccggtatcctacacccattccccactctcattacactcccacccctggccctcagcgtcggagtcaagagcaacagggacacttccgttctccttgtaggactggtgaaaccgtaatgaagaacacccctaaactcccataatcggtgcggattcctatggggaaggcctatattgttgacatcttccaggccttggttctggaccttgagaaagaggctgtggaactagagatagcgatgctttttagggtaaatgtatgtaggtattgggggaaggggagggatcaatcgaaaaatggaagtggtttaaagttcatatttcactttttgctatctctatagcgtacaacttgtgagttacttacaggctgtaaaagcttctcaagtctaaaaatatctgaaaactaaacttgaattaactcttaatacaaacagtactttgaaaatgcagcatttaaccttgttttaaaatttttttctcaaagcatttttttccagccactcacattttaaaaggttgtattacttttagttagaactgaaagggctcaactagcatttgctgtgaccagtatgcggagtctgtgttggctttccagaattgactttttgggttgtattggcaaatcacagtcctaaatgatgaatgttgaatgatgcactatgtttttgtttaaatgagatttcctgaaaatagttaatttcagaattaagggaaattgatgtcgctatcatgaggcatcataaaaatatgtattttacaaggtgaaggcatttcaagtag

SEQ ID NO: 498 - DNA, 1198 bp, Homo sapiens
aagtgggaaaagaataacacctactttgagagattaaaaggatttaatgaagtgatgtatatattatggcccttagtataggacctggagtatagaaggctttggtaagtgggagctgatattagtgtgatggctgctgtggaggtggttgttgaagtctgtcctggggtggggacagtccagcattcctgggcctacttggatttagggggctgctcctcctagggtcatgggcatggcctttatggggtatgggaaaggaggggaatcagcttcccggtgtgtggtggggacaggcactgtctcctataacacctcctttggttgctacgtgcagatttgctgtgcagcacgggtcaagttacttagcctctctgtgtttccgcttcctaactgaaatgccattaatcacaatgctctcacttgagaagagagaacattagaagggtcacatgagaagagtctagaatagtgcgtgggaatcttatccaggtgttggctatttgttgctgtgattattctgtttttggagtgacccccattcagtcaaagaagcaagggtgagagctgctgtcccaagtgtatcagcatagggacgtggggacgtgggggaggtggactggggcatggacctcgctatgctggccccagggagcagcctagagaaggaaagaaactgtttctcgaatgctagctgtaggtagggcgttcccaggtgtgactgaaatgacagtctggctcagagcacactgccttttcttcccaccttaactggttactaaggggacagttctacactacacaggattgatttctgtgaaatctatggaatttacatatagttttgaggggctgctttgaggcatgaagccaccgtattcacaaaacccagctgcgggtgaattgcaatttataataataaacagcctgtacctgacctttggaccctgggtgctcaggatgatgcctgtggggcctgacaggaagtgaaggcggtggcatgggtgtggggggccacccctccctctgaccatggtggcgggtggcatccaggcccagagaagccttgtcactggctgtccccttggcacccagcccagcaggcggagagggttaattgggatttggagtgtctgtggaaagtagcctcttctcaaatatcttgtgctatggtttggaactttggaatcaggcatac

SEQ ID NO: 499 - DNA, 1172 bp, Homo sapiens
gaggactttgacgagaagaggagtgaggcaggcagtggggagtgtgagtaacttttgccagcccctacctgctcccctatgcagcccagctggtgtagtgggtatgttcaagggagtgataactaatagctgacttttggcccctgattgtaatggcaaatctcattcacatgcattaactcccttgatcccagcaacaatcctgtgacagaggaggtattaatatttccattttcaaaagagggaagtcaggttcagagcatttcagggacttgtgtgggatcaagcatcgtgtgagtcactgagcctggactgaaacccaggtcttttgttttgaaatcttctgttcttttcctaaacaaagcttgggcaggtggaggccaaagggacctagtgagtggagaagtaggacttggatagggctgggatccctcagggtacacatctttggggtgcccagccctccctgcagcctgtccccttctcttgggggttatggtgacaattcagtatgtcttgcaggactgtagctctccagagggtaatgggtccccagaacccaagagaccaggagtgtcggaggctgcctctggaagccaggagaagctggacttcaaccgaaatttgaaagaaggtaggatgtctgccctagttagaagcagaggcctgaggcagggaggtgttaagacggttattcctcacccctttgctgtcttccagtggtgccagccatagagaagctgttgtccagtgactggaaggagaggtttctaggaaggaactctatggaagccaaagatgtcaaaggtgaaggcctgttgggggtgggggagatgtttgaaccccatctctcttctcctggtctggccacgcagcctggctctgtagggcagttcttggtacatacctatcctgtgccatctggctcctgcctggccttaggggtcatcaccatccctcgcctggaggccccaagcattaggtctcactcatcccatgcaggagaggcctggtaggaatcaaatcccatgactctgaatctgggctctcaccaggcacccttgtgacttcaggcatgtcattgccacttcccgagtctaaccgcaaaatgagcagaaagttccctttcactctaattaattctaggtcagttggacctcactaagtgagtg

SEQ ID NO: 500 - DNA, 1238 bp, Homo sapiens
tttagagagtttagtaaatactggtaacttatcaaacatgaaacagctgaagaacacatgttcttcatggaacatgtgtgaatggaacaaaaagaaaaggaaaggaaaatatttgttttgctttatcttgctaaaacaaaaaacaaaaaaaaccctttaattctaattaaaacctaaatgtagctacttaaaaggaagcaggccgggcgcggtggctcacgcctataatcccagtactttggaaggccaaggtgggcggatcatgaggtcaagaaatcgagaccgtcctggccaacatgatgaaactccgtcttttccaaaaatacaaaaattagctgggagtggtagcgcgcgcctgtagtctcagctactcgggaggctgaggcaggagaatcacttgaacccgggaggcggtggttgcagtgagccgagatcgcgctactgcactccagcctggcgacagagtaagacaccatctcaaaactgaaaaaaaaaaaaaaagaaaaaaaggtagcaacctatatggagtgaacagaaagagcttttcttcgggagcgcccggatagctcagtcggtagagcatcagacttttaatctgagggtccagggttcaagtccctgttcgggcgtttgtagttttcgttactttaacctgctaaattatcccatcaagtcccaagagcggacatcgtaaacccttacatttcaagttgaattcaaatcatttttcactgggttcagaatatgctagatagacgtgttttcagggaggaaaaaaaatgactgaaaagtcatttaatttcttggagagtatcgaggtctggcacagtggtttcccagaaaaatatttgttttttgatggctcataattgagaaaggaagaaaaaaacttaaaagcaagcaccttgtgctctcaccacaaaaaaaggtatgcgaggtaatgcataaccttatcagtttgatttaatcattcaacaatatatacgtatttcagaacatggtgttatacaccataatgtgtacaatttgtatttgttcattgaggaaaagagaacaagacgcccgaacagggacttgaaccctggaccctcagattaaaagtctgatgctctaccgactgagctatccgggctcccgtagacaacagcttgttctgccgtttcttacataagaatgaggacccttgagtgattgcatcatccacactgtgagactgctttaacgccaagaaagttcgt

SEQ ID NO: 501 - DNA, 1153 bp, Homo sapiens
aaaaaaaacaaaaacaaaaacaaaaaaacaacttggatgctttcaggcgacctattggataacctcaccatccttcctttctctcactttataccgcacagtgcaacccgatagcttcagaacagcatattcatagtctcttagacagattcatttttttctattattggataggttttagcactgatgcccattctgttatcaatggtaaaatagatcgaaggttattacagcacttcaaaagtgacacctcgccattcttttaatcctgaacctatttaactacaaataaaaaaagcctacctaatcatgcttactaggcgcataaatatctcgcaattctaaattagctggtgatgctggtgaaaggcgcagaatttgggccttctgtttttccttttacgcacgaatcacgaactttcttggcgttaaagcagtctcacagtgtggatgatgcaatcactcaagggtcctcattcttatgtaagaaacggcagaacaagctgttgtctacgggagcccggatagctcagtcggtagagcatcagacttttaatctgagggtccagggttcaagtccctgttcgggcgtcttgttctcttttcctcaatgaacaaatacaaattgtacacattatggtgtataacaccatgttctgaaatacgtatatattgttgaatgattaaatcaaactgataaggttatgcattacctcgcatacctttttttgtggtgagagcacaaggtgcttgcttttaagtttttttcttcctttctcaattatgagccatcaaaaaacaaatatttttctgggaaaccactgtgccagacctcgatactctccaagaaattaaatgacttttcagtcattttttttcctccctgaaaacacgtctatctagcatattctgaacccagtgaaaaatgatttgaattcaacttgaaatgtaagggtttacgatgtccgctcttgggacttgatgggataatttagcaggttaaagtaacgaaaactacaaacgcccgaacagggacttgaaccctggaccctcagattaaaagtctgatgctctaccgactgagctatccgggcgctcccgaagaaaagctctttctgttcactccatataggttgctacctttttttctttt

SEQ ID NO: 502 - DNA, 1185 bp, Homo sapiens
tgtgagttaggcgaatttggtaatatataggaagagatgacaaaaatagactccattatgtcctgcttggaaccagttttcatataaaaatttaaaagcttgatatggaagaacatttttagctatttttcactgttttttttcccgattatattttggtaatatattttggatatggcctgtcttggtctttgtcatttttatcaattttgatttttcccttgcaaatgagagctttgtccagccaacatggagaagtacatttctagggactaaacctggctcccgggttgtttgctgaggtcctttttgtgtggaaagaatggttattaccagggaaggttttccttttgttttacttgctatccagatgctgctcagactctcgctctcgcacaggatcacagtatggatattccaagtcaagaccaactgaaggtaaaatcaccacacggtgacttcttttgttgtacagagtggccccttctctgtacctatggatcttggactcccaagacctttccctgaatgtggtaagaatttaataagaaaggttcttgggagttcacagaccagggacagagtgaaccttctctgttctgcccataacagagttccagtctctgaacctttctttgggatgtagcacttctgatcttcagttcttccagttgcatttttctttgggtttgtgtgtacctgtgtgtgtgtgtttgaggatattgctttattagattttaataggcgtgttgcagttaagttcatgtcaggccatttcctaaagcttccccaaacctggggaaactttatagtcatcttggtacgtggcgagggtttcatatgttttctgaattatgcctaattttgtagtagactggagggtttatacagatagcctgtttttaacagtagattttggcctttgtgcagaggttttttttccccccaggtttgggattcttctagctttgctcacagtgggttgaggagaggtgttgcctttatttgatgactgttgtgaacttgagttctctttcttgtgtgtaacccattgtgttgcacactaactggtgagccagaatggaactgctacatcccctggtctcagttatttctactgcactgatggacacctttcccttctttcagcaaagtgcagaggaaagttccacttccagaaaaaga

SEQ ID NO: 503 - DNA, 1178 bp, Homo sapiens
acaggcatgagccacagcgcccagcttaaactattttcttggtctgtttttgattttcttttttccttgccactgcggtacagattttttttactcactgccactaaactaaagcaaggcatagtttatatgtgaagtgttcagagtttactgctataaggaaacttccaaatactgacatttaccttttagctgtagttattgggaccatgtgctctggttttctggagactgccaaattgctcccatttttctgcatcccacctggtttctttctgcatgtcccctttcactttcaaacctcttcatttggatgttaaattatatggtcacctagttataggtaagccttgttcgagttgatatcttgattgtgaggaaggatctgtgtcattggagcttgtttctgctgcaacgtgctgtagactatgaataatgaaatcacaccacattaccatcagatttcttgttttagttgtcaaattaatatttatgattgttatcttgggcgaaaagttcagagcagagatgacaaatcattagaacaacgatgaatttcagtattacggctaaaaagttcttctgtctgaatattaactcactctccttccagtgtacttcacagtaattggtatgcttttttatttaatgcttaaatcaaactttataaaaatcttagaccagatctttaatatggtatgccatttccccagtctaccaatggaatagtatgggtttctaatcctaggcttgtacaatggattggagttgagccatgccagcctccacactgccactaacttctgtaatgtaagattgagtcactgccaagcatttgaaatatgcagttgtgttttaattataatttatgtatagttagatgtatgtagtgcattgtgtggtattatttggtttgtaagaatttatttttaagggtcaaggtcatttgtaacattttgtgtgtgtcaattcaatgcaatgttggctgccttttgaagtctttgatatattggtgaatattcttctgatctataatacaaagctatgtaatgttacctcttgactcgcttttgaaaggaagacaattgttaactagatatttgagttttttcccctcagaattatgtgaatttctgatatatggctttagatactgtgaatctgttttccatttagtc

SEQ ID NO: 504 - DNA, 1244 bp, Homo sapiens
agtggtcctcaaccagaggccattctcccacttaagtaatatttaccaatgtctgcggacattttttattgtcataattaggggagtgctactggcatctagggagcagaggccaagaatgctgctaaacatcttagaacacacaggacagcccccatcacagaattcttcaatccaaaatgtcaacagtcctgaggctgaaaagccctggtctgcaaattggacagtctcaggcaattgccttgtggaaattttcctactctgttctctcccctattctccagaatacctgttccagacctgctccactctcttcaaactcttatcccaaccaccatctctgctgtatggctggaggctctgggaggccggtggaaggcgcagcagggcagaccggcggtgcttgggcgtagaaggggagagcagtccgaccgcaggcgagcagctcaggggtccccagtccgagccccacgaccctggggtggcagtgacgcctggagtcgggcgggcgtggctgggccgggctcttgaagaggcagccaggcaccaccattagtgtctacggccataccaccctgaacacgccagatctcggaaactaagcagggtcgggcctggttagtacttggatgggagaccgcctgggaatacctggtgctgtaggctttttggctccctccctccttttgtctccgagcttcccaactgccccctgactctgctcccccttttccgcccgcctgtgtaccccgcggtagcccaggacctcctcgtggaggtctgccgccgcagcaccgccaggcagcagcatcccacctcttccgcctcactgcagccccaccaggagctggcttcagccctggcggggcagacctggacctgaccccgaaagcgcaggcgcgggttccctgccatcagggtgtcttcccgttcccaggatgcccaggcaattcaattcactcatctctctctgtccatgctttcagcgacactaaactttctagttcttcccagatgccactgttttctcacctcaagaccttggcatgtttcctcctaactacggcacttttcccttcctctcctaactcctaaccttcctttaatctcagctcatctcttcccggaggttgttcagaagctcttggctacattacgtcccccttctgtatttctcatagcagcatgtagtctcacaacaaaacattcactatgctaatatttacatgcttaaccagtttccc

SEQ ID NO: 505 - DNA, 1383 bp, Homo sapiens
gcctgggcaacatggtgagaccctgtctctacaaaaagaatttaaaaattagccgggtgtggtagcgtgcacctgtagtcctagctgcttgggaggctgaggtgggaggatcacttgagcccacgaggttgaagctgcagtcaggcgtgattgcaccactgcactccagcctgggtgacagattgagaccccatctccattttaaaaaaatcgtcatctcagcctcgccattctgctttctagtatgtatgcgacacagaaaagtaactgctctctatgtcttagatttgtaaagtggggaaaaagttgtcatcaattgtgggtgcacttgggcattggcaggtgattagagaatgcaggttttccatccatgtgttgccttaacctctgggaggcacaagccccggggactagaaagggaaccactggttatacgtccagtggagatggccttgggccacctggctcctcagaaaacagatgaggtccccaccctcttctccctcttcttttttttttttaacagcagttcctggaaaacctagggtcagagggttgtatttctccttctctcatctctcccaggcctggttaggcatcaatcccttctctccttgttcagaacctctccccagctgatccctgggcttgtgcatggagtgtcaggaaggggacgcagcacaggagtgctggatttacagccagccagcccctgactgtgtcctgctcaccccttcccctcctgcagtgtggctgagaagcagcacggggcagagctgggagggcttctggacagcttcaggagactctgtggaggtgctggggacaggaggactcttatgacaggccccactttgagagcaggcaggaaggaagagagggccaagatctccccagtcgtgctgcaggtgaagtgaggagggtggagagatgacaacgtcctgactggatgcttccctgtggcctcatggtgttatctccaggctccagacagggaaaccagtggagttcagcccatcacctaagcgagagcagactctgaatgccctgtgctctccgtccactcccacaccagatttatccaacaagatttcttctctgccccagcataaataagcacccctgtttactctgaaggatggtgagtgaggggcccccccaacccctggctcttgccaagaagacagatcttggcagctgcccaggggccttggtttgtttatgtctgggagtctgctggttcagaggtgggtggggcgggctctgctgagagaggtttccaaacatgaccgctcagccagccggccgtgggggcccctggtataactgaacttgtaggccaggttgcatgggaggctgaaggggcccagacgggccactctg

SEQ ID NO: 506 - DNA, 1196 bp, Homo sapiens
gaggtgtgggcgttcttatccaggcctggggtgtccttcactcattcctaaggcagaaactacacagtggcactaaagtcaaacgggcaacagtccatcatggcccatggtaggttagggtaccctccaccgtatgtccaatgttgagacctctggggaaggaggggatagctctttctttcccacaggggcatgtttgattatatttgggaagtggttcctaaggtctcacttagatcttctttgctacagttgtctcatttcctattgcttttgttctcatcttcagaaatctttttgtccttcactatgactcagaaggcaggaagaagggtgtgagagacccagtttaccctgaacacagtctctaccctcagagggttgaatttcaatggagagagagaggatagacaccaacatacacacaagggcttatgaaggggtcacagtcctgaggggtcagaggacagagaggcagctggaggagtcagtccaggaactctggactggggagctgtcctgggccaaggcatgtatagagccctaggttggaagggacgcatccgacccaggagtatgcagtgtcatagctcaaaaggggatgagctggggacaggggacagggagtgcctattctgggagctgccaaactgaagcacctgccttttgtcttccagatgcctgtggcctgatccggtggctgttgatggtgaaccccacccgccgggccaccctggaggatgtggccagtcactggtgggtcaactggggctacgccacccgagtgggagagcaggaggctccgcatgagggtgggcaccctggcagtgactctgcccgcgcctccatggctgactggctccggcgttcctcccgccccctcctggagaatggggccaaggtgtgcagcttcttcaagcagcatgcacctggtgggggaagcaccacccctggcctggagcgccagcattcgctcaagaagtcccgcaaggagaatgacatggcccagtctctccacagtgacacggctgatgacactgcccatcgccctggcaagagcaacctcaagctgccaaagggcattctcaagaagaaggtgtcagcctctgcagaaggggtacaggaggaccctccggagctcagcccaatccctgcgagcccagggcaggctgcccccctgctccccaagaagggca

SEQ ID NO: 507 - DNA, 1199 bp, Homo sapiens
caggcagataaccaaaccgggttgatttagacagatgctggaatggtggtctcctgagagaatacagcaatgagattttaggattcaaatttaacaacagtgattgacagtcactagtgattgacaatcattgttttttcctataatttagggaactagctttatcctccttgcaagttgcttgttgcttaagacatttcttaagcagcgtggcatccttaagagtttggattctgggtccagattgcctgggcttagatcttagcttcaccgtttacttgtgtgatgttgtacaagttccttaaccctcttatgaatcagttttttcttacgtaaaatgaggatgcagtagtatctaccttatagaaatgtggggatgaattaatacatttagagcacttaaaacagtgcatgacatacagtgttaaataggtgttggctgttaatattatcacatatcttatctatattctttcagctcattgctatggacagtgctatcaccctgtggcagttccttcttcagctcctgcagaagcctcagaacaagcacatgatctgttggacctctaatgatgggcagtttaagcttttgcaggcagaagaggtggctcgtctctgggggattcgcaagaacaagcctaacatgaattatgacaaactcagccgagccctcagatactattatgtaaaggtagtacacatcctgatcttatactatacagagaacctccagacaagaacgattccttcttggctgggcacagtggctcacgcctgtaatcccagcactttgggaggccaaggagggtggatcacctgaggtcaggagttcaagaccagcctaaccgatgtggtgaaaccctgtctctaccaaaaatacaaaaaaaacgttagctgggcgtggtggtgggcacctgtaatcccagctactcaggaggctgaggcaggagaatcgtttgaacccgggaggcggaggttgtagtgagccaagattgtgccattgcactccagcctgggtgacagtgagactccgtctcaaaaaaaaaaaaaaaaagattccttgttttctgttgaggttatagataccaatttcctagtttattttaatccagtgtattttgtagcttcagcagtttggaattaggatacaaggtataaatgttccggctgaatctctaccaaatcttcttcttttt

SEQ ID NO: 508 - DNA, 3580 bp, Homo sapiens
agaaatgtgataagaagtacatccctgtgatcctgctgcttcgtagagcaccactgcacaccctaccccgagtgccaaccacctctgctataggacactattttcctggccctattcttcacttacttcccatcctgtccttgactaggaatatgttaaatgctgctcccatacaattcagttagctcttgtctttttatttggtccaacccctgctttactgctcatgctgcttaaagcaggagggactagagaaacaaggcattttaggaggcctgtgtgcagttgaaaaccgacttttacacgccttataaaagcagtcaggagatagatccgtaggtttgatccttcacatctaataccaggcgctaatgggaacaaggtttaaagggtcctggtatgctaataaattgaaaaattagtgaaatttaaacttctgcctttttttcctgccttttaatctagatttgcttcctcaatatcctactttgtggtttactaggaacatgcttactctgatctttttttaaaaaacacacagtggcagagtcatttcactattgcactgtgtgttaaagaatgaataaggagttttcagttacatggccaaaaatacaggacttgaacataaatagcagttggatcattctctttcatgacggttaaattcagaggtgtgaactttgtaatgagggtgttaaagattaatctatttgcctaaatgggtttgttcaggtatccatttttaacaaagaagtttgtgttcatatagtaaaagacctatcagtgtttccaccatgcacttctattttttaggagtttataattttaagtcttacattcctagtaacatttgggcttttcttaggttatgtttcgtgaagatttggggggagggctcttttaaaacttcagcctcagttgtttaacagtctctttaatatattaatctgcactaacatctctgtgatatatgcacatattttagaggtaatcatgtcttctagattacttgtgtgcatttgattgggcttcttgtttagggtcccttttaaaattaattcattagattgaaaaatgtattctatatttctgatagactggacagaaggatctgtgtccccaagtgagacaggctctgaataacctttgttttctccactttttattgatgatttaaaacactctagtcttcccctcaaatcatgcatgcaaataggaggacagtggtggtgactcaactggatacaggtgctcaatagtcaggcttgatagtgatgtcaggacgcattacaagctgtaagccgatactgactggccattggcaccatccttgactaaccttcctctttttctctagtgtgcctatggtgaaatggcaatagcattcactgtcgtattttgcagtgctcaggaagtgggacgttaactttgaaggtgcttgtttgtattagctctgctaggtttacctctacaacgtagatttcagcagctatgctgactgacactacattctagttcttaagattttttttccagatccccccttccccagctagacatacgtagcatactttcatcttattcagtctttctgtaacctgctgctgcttttagtcctcctcacctcagatcggaatcaatggagtgggcccagaggatacattttaattccagtaatggtaggtagatttgtcctgctttctaaaacatctcctcatttcatatttccactccatattgattccataagggaaaattaatgggtgtttcctcctttagggaggtaatgcaaagagtgtggacatcttctaatcttgaggaacagtagttgatttcccttgaaggagcttacatattgactgttttcacaataacctgtttgccccagttcaatcctcattttaatacttaatttggtactggctcaaatagcattttcttacagataacaaatcaagagtgaaatttgaggttatactccagtaaagtttttaacacttgtgaatatggtcagctagactaaacttgactcttttttttaatggcttttttatctgtgaacattcagataagtggattttcaagtactggttggggatgggaatcgtgcttttctttaaacttcagtttacgagatgctttgagagcgttaggcaaaagcagaaataaatatcaggagcaacggggaaagctttataaaagatcatggtggccactgttgcagctttgaagaatgagtgctggcttgaacagttctttgcctgcatcattggtagctgcactgaaaggaaaaaactttcaccttaagaatttgaaaaggaagaaacctgggctctggtcttcatggcatttagactgagatgcttaaacagaacagaagtaatacgcatttcctgccataggatagggaaaatgtaacaagctggttgctcttgaggttagaaaattgtctgtttctctgtggatgaagctggatttacttgaaaatggagagttggcttattgtttgaatattgggacatcaagctatctatagccaagtttcagtcgcaaccagttttccctttgtctggggtaaattcgatacaaaatgattctttttgaatcctgaatccataaattacacttttttttttcaaattcacaaaattcacagtggtgctgactgtgtaataaccactattgggaaacatcccgtaaacctgcctgttgccatgccaatggagtgactgaactggtgacatctgtttgagcatgctttgtgtggctggtagaatgccaccgttgtgcatacactttgtacatcaggggtgaagggagggttttctagattattgggggagggtaaaattgggatttttttgttgttccttttttgatggggtgtgggggtatagtactcagcttatgccctaaaataacatgtataaaaacccctgaagtattgtgtgggtgtgtacgtgtgagtgtgtgtttgtatacatctggcaattaaagctttgtcttctggaacttagtgaattcttttctctttttcctccagaagtatttgttacaagatttgtaaataagagctctacttagtttgtttaccatgaacatgttgcagcaaaccttatgcatctaattcctacaaggttaaagaaaggcttttagacttgccaggttaagcaacagccaagttctcagtaattgtttgccttgatttatcttttagacttcattttgccagctctaaaactcccagtcttccttgattttagtccttaatcttttatgttctgagcaggaagggtaaaagacaggaacctgcttcactgtattaactagtccatgggctgagaccggggcatctcttttcttcatactgcaatgttgctagatacatgatcagacaccagagggttgggcattcttgcaataccttaacagtgctgaaatctgcagcatggtactaaggaagttaaagtttgaatgtaaccactttatttaaaaggtttttttctttaatttaaatgaaatggggttgaagtgaacatgattttgttgaccatgttcgtgaattacagatgcaaca

SEQ ID NO: 509 - DNA, 1418 bp, Homo sapiens
aacaacttttatcataaacaactgttagtttaccaagcaattaaggatgttgtgcatattctatagcatggtgcttcttctttacaggtattactgctaacatcatagagtgttggtaaaaactgatgggaaatactgtagcatagtgtagtaacttatgaccagtttagaaactgagatagatttacctagggatatatgtgctcccttgtgcccaccttggtttttagtaagttgcatattgtctttatagattttattcttacagattgttgtattttgtagctgacttttattaaagacatttttttctcttcccttccccaaattatttttctattttcagtgacgccaagtccagtgaaaggcaaagggaaagtgggtcgccccacagcttcaaaggcatcaaaggaaaagactccttctcccaaagaagaagatgaggaaccggaaagcccgccagaaaagaaaacatctacaagccccccacccgagaaatctggggatgaagggtctgaagatgaagccccttctggggaggattaaaagtgatgatggtctggggagagattttattaaaaaaaaaaagaaaaaaaaagaaaaaagagggaggaaaaaaaagaacctacttaagatagaacatggttttggctatggcttgactcatgggctttcagtgcttttttccatttgttgaaagtaacatttctctctctctctctttttttttttttttttttaaagcaaaccattgtatgtgtaagtgtttaagttacctttttgtctattggtctctttgccagccctcccctttcccaatgaaagccatgtcaaattaatcactggattgactgcttcatctttttatttttaatgaaaggtgtaccacggttgtaaagcaataagatttgagatgaacactattgaaacttcgctttttgctaaaaaatagcaagttgaatagtaatcaaaaaacatagaaagattttagttcaaaatgattgctcctttctctacctggacttttaaaaaatcaattgtcatctaatatgagtttatttgtctatagacacaagtatcaatgtctaaaaaaaatcatgactttaaacttccaccgatgaggcaggtaggagataaagatgaattctgaactgttactaaaagtactcattttttaccttgtagggagggtgggcaatggggttacctgaccttatttgagggtatgggctttcttttttatttcatcacttgttatctcaaagagactcggagccagtgatccttttatcctgctacagtctttagggagctaaaaaaaaaaaaaaagcaggggctgccaaaactcttgatttcatatttccttctctaaatatatatgtatcctgttttttggataaaattttaccaagaatcca

SEQ ID NO: 510 - DNA, 1324 bp, Homo sapiens
ccctgagggttaatgccgaagccagggtaaggggcttgtaggtttaaggtcaaattttttgaacctaaggaatttccctccaattctgtagcagccccgcagtgacgaatctgctgcctctcccacgggttttgctattagaggattttcaaggtgatcaaggcagacgagatgaaacaccattaaactaacactgagcaacgctgaaccctacataaatctttttttctagtctttctaagatacgaccccagacgaatctgcaactctggagtggaaaccagggggcgggctaagcagcgaccatttttgttttgcggccgtgcgctctcagagcatcttgactaacaggacccccacggtgaaggtggagcctatcagagagcagggcggggcctggaagacgtgatgattcaaacggactaatgatctgggcgcatctggcagaagtctccaatgagcaggcgtgttggggaggagcgcacaaaccctagtgggtttggttgcacggcggctttggcgcattttcggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcctgtttcgacagcgaacatgtcgcggcctgtcaggtcagtgcggagtctgaggcctggagcgggttggagggggatgggggcgagtggtgaaaagagtgggggacagaaggctagagtccgccatccccggtgccgcgcgcggcctcctccctttcggggcccgcgcgcacccttgagcgtggggggccctgctggcgcgcgggggtggtggctgcgcgcccgtgcgcgcgcccctccccgccccgcgccgctgcagggctccggtctgctcagctgcctcccccacccaccgcactagagcgggcggggtgtccctgagccgccagcggccggagggggaggggtgtgaagtcagcgcccccaagaggccccacctcctcggggccgtccccttggagccagcgcggggaggcgggcggactcgagctccactccccaccttcagcgaggaggggcggaggcacccgtattgccccttcccccagcgactggcgcgggggtgggggccctgagccctctctgtagcggacgggggtgttcctggcaaagggggaggggcagcactgccaaccggccccgcctctgtcc

SEQ ID NO: 511 - DNA, 1238 bp, Homo sapiens
attagctttgcttggtttcatactttatataagtagaattgcacagtatgtactcttttttgtttggtttctttcaatattatgtttgtgagatttattcatactgttgtgtatagttgcagatcgtaggaatttctcttgatctttgtaactttggatcaattaaattgtagttgattagagacatgcccagggttgttgaatggccaatgattactatcccacagggtgaataatctcttttctccctcccttggggcattcccatgtaggcagaaaactcttaaattaggagctggttggcagatcataaaaatagattgagccaagcaccatggatcattcctgtaatcccaacaactcaggaggtcaaggtgggaaaatgcttgaggccagaagttcaagaacaacctgggcaacataacaagaccttgtctctaaaaaaattttaaaagttagctgagcatggtggcctgtgcctgtagccacagctacttgggatgctgaggtgggagtattgcatgagcccaggtgtttgaggatgcagtgagccgtgatcatgccactgcactccagcctgggcaacagaacgagaccctgatagtttgaggatgcagtgagctgtaatcatgccactgcactccagcctgggcaacagagagagaccctgatggtttgaggatgcagtgagctgtaatcatgccactgcactccagcctgggcaacagagagagaccctgactcctaaaaaaaaaaaattgattcattctcttttggctgggtaaagagcctctctgctttctagtaatgggcaaacaaacattcttcataccacaccccagttttttaacctcttttgtttagagtgtcgttgcacatgaattagaatcctactggttaagatatagtatcagataagagtcctaaggaatgtcctcagccattctgtagttacatgaatcttcccggggatttgctttgtgctatcagaggagatgccttttccaagtgaccctttctcttgggcctagctctgctcttaactctgagaccttggacaatgacttctttctgtgcctcagttccctaaactttaaaaaaagagtgtggtctatgtgatctccatggtgccttccaaattcaggataccacagttctgtgacgataaggggatcctacactgggggcttccttctggttgttaggttacctttgttaaattgtgataggtaaattgt

SEQ ID NO: 512 - DNA, 1211 bp, Homo sapiens
ggtgaaaccccgtccctactaaaaatagaaaaaattagccaggcgtggtggtgggcacctatggtcccagctactcgggaagctgaggcaggagaatggcgtgaacccgggaagcggagcttgcagtgagcggagatcgtgccactgcactccagcctgggcaacagggcgagactctgtctcaaaaacaaaaacaaaaacaaaaaaaaacaaagaaacaaaagaaaacttttgattcccctagaactactattaaataatagcctactgttgacccgaagccttactgattacatagttgattaacacatattttgtctgttgcgtgtattatatctttattcttgaataaaataagctaaagaaaataagcatcgttaagaaaatcactttgagtaggctgaggaagaggaggaggaagaggaagggttggtcttgctgctgcagggctggcagaagtggaagaaaatccctgtataaatggatccacgcagttcaaacctgggttgttcaagggccaacagtacttagcagccatttagcacagagcactgccagcccccctcggcctgcagcctgctccagcaccttgctaagaggttgctgaggctcacctgcagcagctgccctcccgagtcctctttcctttacacccctcagagcacccgggccagccatcctccatgtggtgcagcagaggcgccggtggtccgggaaccagagtgggtggccctggcctggaggcacggtgggttagtgtgtgacacacgtggctttcccccgacccccagctgcctcctgggagtgaagaggaggtcttatttgccaacacataccgcaccacacacccacaacacacttggtgccagaatcagccttttgcatcgctcttggcgctgaatcagagtctgtcttggggagggatgtcttccttctctcattacatgcgcccagcttaggtggtgtagtgagggagtgtacagggctgggatgccacagcctgctttcctccccgtgtcctggggtcccccgtctgtccagtgcccagagctattaataacaccttcattgaaatgggtgtaatggaatcccagttgccccccccagtgggactccaacacatggggagtggggagcagaataataatagcaaacacggatgcagtacttattacgtgccaagcgttattcttagttatttacatcatgca

SEQ ID NO: 513 - DNA, 1589 bp, Homo sapiens
cccaagtctcttcctcctatcctgcgggatcactggggggctctcagggaacagcagcagtgccatagccaggctctctgctgcccagcgctggggtgaggctgccgttgtcagcgtggaccactaaccagcccgtcttctctctctgctcccacccctgccgccctcaccctgcccttgttgtctctgtctctcacgtctctcttctgctgtctctcctacctgtcttctggctctctctgtacccttcctggtgctgccgtgcccccaggaggagatgaccagtgccttggccacaatgcgcgttgactacgagcagatcaagataaaaaagattgaagatgcatccaaccctctgctgctgaagaggcggaagaaagctcgggccctggaggctgcggctctggcccactgagccaccgcgccctcctgcccacgggaggacaagcaataactctctacaggaatatattttttaaacgaagagacagaactgtccacatctgcctcctctcctcctcagctgcatggagcctggaactgcatcagtgactgaattctgccttggttctggccaccccagagtgggagaggctgggaggttgggaggctgtggagagaagtgagcaaggtgctcttgaacctgtgctcattttgcaattttatcagtaatttgacttagagtttttacgaaacctcttttgttgtccttgccccactcctctccaccagacgccttcctctctggatactgcaaaggcttgtggtttgttagagggtatttgtggaaactgtcatagggattgtccctgtgttgtcccatctgccctccctgtttctccacaacagcctggggttgtccccgctggctcacgcgttctgggagctcaaggccaccttggaggaggatgccacgcacttcctctctcggagccctcagacatctccagtgtgccagacaaataggagtgagtgtatgtgtgtgtgtgtgtgtgtgtgtgtgcacacgtgtgtatgagtgcgcagatctgtgcctgggatcgtgcatttgaggggccaggggcaggcagggctgcagagggagacggccctgctggggcttaggaaccttctcccttcttgggtctgccctgcccatactgagcctgccaaagtgcctgggaagcccacccagattctgaaacaggccctctgtggcctgtctctattagctgggttccgggaggcagagaggagtgaccgggcactggcactgcgatcaggaagactggacccccagcccccagggcccccctccccccacttagtgctggtcctaggtcctctgaggcactcatctactgaatgacctctctacttccccttcttgccattattaacccatttttgtttattttccttaaatttttagccatttctccatgggccaccgcccagctcatgtaggtgagcctgggcagcttctgttggcagagcttttgcatttcctgtgtttgtcctgggttctggggcatcagccagctaccccttgtgggcaaaggcagggccacttttgaagtcttccctcagatttccattgtgtggcctgg

SEQ ID NO: 514 - DNA, 1179 bp, Homo sapiens
tatgggctttgtatgaattatggatgcacgagagcgtccaaccatctggatctaacaaagatgtcaaagtaaaggatgaaattcactattttatgggagtgaatttggttaacttcatatattcctttgaagacaaggactatttcttttcttaattttttatttttatagatttacagtacagagatttcttaaaaaactaaaaatagaactcccctttgattcccactattgagtatctacccaaaggaaagggactttttcctaacacaaacttaggatatgttgtgttctccaaagggaatgggaagtggtgatgaagattaaaaaaaaaagtccttactaattttgctttaaacaagtctatatagtctgatttaaaaataaaagtgcatttgccatgtatatttttcatatatatatatgtgtgtgtgtgtgtttatgatcatttttcaaaactgcaaattgcttcatggtttattgcctttgtcaatagttctcacaaggaactcccaatacttctatacggcgactcaactctttctctctatcccatcattttcctgcctttttgttttttttttttttttttatgtttgtacctttcttttaagtcctctgtcatttctttgttagatcatctggccaattgcaagtcttctcactcaacctccctgtttctttcctctaatccctttaatttatcttgtgcatgtctgccataatgatcttaaagcataataattatgtcattcctcagcttaaaaacaaacattcacatcaaaaacaagcacttttattccccaaggagtaaagtctatgaatttcctaaacttgacgtttacatcccactcagacacatctgtaaactgtcccttccccatctcagacattcagccaaattggaatattatctattgttccctcaacatgccctgcatccattctgcagtgtcttcagtatacctagtgcagatgcagtctcctctgcaaagcccactccctccctccacttggaatcaatctctcttctgagctcacagcttctgcagaggccaatccttactgtcttgtgctgtaacatttgtgctcaggggtttttttgttttgtttccactccaggctgtcatttccttgaagacatggatcccataacatttattctagtgctttatgaca

SEQ ID NO: 515 - DNA, 1197 bp, Homo sapiens
cactgacctctgcagcctctctcatctgccagttttgattccgcaaggagaggtggccctgggctcacagctggtgtttgtccacagatgttcatgggtttctttgtgttctctcattttttcaaagctgggtgttgggaccaacatcaccactgacattctgtggctctaaacaagtcctcacgaccacttctcagttttctcatctttatgaagtatggagtaatccccactagccttatagagggactgtgtgagaagggaagagactgctattgtttgccctatatccacctacttccctagttccagaacgctggactttaatgagataacaaagtacctagtaaaaacactgcatcattttccatcccccaccccttgcagtaaaatgtggcccatgagacagaagcactaactactgagcaggacttctaggggagttctttaaaactcagaggagcaccacttttaccttctgctcttccctttttcctgcctggaacgcagaagtgatggctgaagctcctgaggctataagctctgtacgtaggagagtggtgaagaaaggagcttggttctgcaaggatgttgtagagctgccataccagtcctgcatggtattcctgtgcactactgttacgtgaacacacaaacacctaatttgtttaagccattaggccaggcctctattagccattcctgactgatacagaagacaaaaatggcatcacagactcctgaactccaaagacactgcctattctttcgtctgttcttggcaagcaccaacattgagactgtacttcagggttgatgctggccatttggtggcgtgaggagtgggcactcacatgtctctgctagcagttctgacgtgtccattccacactggatccatagaacgagggaacacaagtgtcttctcataagatttatagaaacagtgatcgttgcagaaaaataattagcaagagaacagacttcagctctctgaaggctgatgaccacctgtttctcatctcttctagtgtatgtcaaagctaaattaggtcaaataggaaataagtcagaatccccaattcgatagaaacttacaggtcttgtgatctaatctgccacttgatccgtgaattacctataggtcatccctaagaggtggcctccagcttctgcttgaattccttcaaggatggg

SEQ ID NO: 516 - DNA, 1184 bp, Homo sapiens
tcatgtgaggtcagtagttcaagagtagcctggccaacatggtgaaatcctgtctctactaaaaatacaaaagctagctgggcttgctgacgcatgcttgtagtcccagctacttgggaggcttgaggcaggagaatcacttgaacccgggagatggaggttgcagtgagccaagactgcaccactgcactccagcctgggtgacagagcaagactctgtcgcagaaaaaaaaaaaaggagttacagtgtccatccaagaggtgtgatggagattaaatgaaatcatgtacaaggagcagtatgacacgttcaagtcacactcaatgtccttctttctgtgggaaatttcatgcacatgaatgatggtaaaaagaagatgataactatgattatgacgcttatttatacctcaggaaaaactgtataagacatgcccttgtccttgggcagcacagccgtcaccagggaggacctacatggaataacgggcggcaatccatgcctgccgggcacaggctataactgatgggccagggcaaggaatggcttttcatggtcagggacttcacaggcgtgagcacgcaagctgggttcagaaggacgtggagatttgggcaggctgaagggaagggacattcacgtgaaggcaagggtgtcgcagaggtgcagagtgggagctgaactttgcttgaagactgaatgggacttgcttgttaggaggtgttgtattggtgtatgtgcttccaggacaggcccagtgggaaacaggttggcaagggagatagggatcagattacatagtgatcaaaatctggtctgaactaacaatcagtctaccagagcctggggtaggtgctgagccccaggccccaccataccctgtaccctccattctctggttgcaatggcctgcttagccctctgtctctcctggactgagtgctctgggagtgagacagggatgaaaccctgtttgctgctgagcccaaaattagtgctgtgtttgagggaggcacatgtggtgtgcctagaggctgaatgagagggtctcttcaggacctccagacagtgagcccctaccgcagcaccatgcccagtccctatgggcacttggtaaatgggaatggaatggacacatgtgcccaggggtgactgttctaaggccgacggcagcgtctgtagg

SEQ ID NO: 517 - DNA, 1242 bp, Homo sapiens
attccctggtatatatatacaccacgttttctttatccacttgttgattgaagggcatttgggctggttccacatttttgcagttgcaaattatgttgctataaacatgcatgggcaagtgtttttttcatataataactttttttcctctgggtagatacccagtagtgggattgctggatcaaatggtagatctacttttagttctttacagaatctctgtactgttttccatagtggttgtactagtttacattcccaccagcagtgtaaaagtgttccctttccaccacatccaccccaatgatggccattcttgcaggagtaaggtggtattgcattgtggtttttatttacatttccctgattattagtgatgttgagcattttttcataagtttgatggccctgtgtatatcttttttttgagaattgtctattcatgtccttagcccactttttgatgggattatttggttttttttccttgctgattttaaaactggaaaagttcccttgtcccccttgcagggcgtgcgatgagggtgtggcttccttcttcaatgccccggtgctcagacctctacgggagcatacagatgggcaggctgtagggctccgaccccacagcagtgtctgggggtgaatgtttatagctcctgaagccccagtgggcgtgtgttacagtgtgctcttttagttttgctgtctataggcggcttgtgttaaccagctctattagacccctgccttatcgcaaggacagagggctttctgtatcccggggttcttgccttggtgtaccagaagactcggatcacatgtgggcttggagaatttgagtgcaaggttccactgagcagaagtagctttccgcggatgggggagccagaagggaaatggctttcccctggagttgggcccttggcggccccagttctcctccgactgccccgaccaaactgcatcattccaccggttgatgccctgctggcctgccggcctgcctatgcctgtcagtgtgctcttctgccagcgtgcttctcaacgtctgcttgacgaccagccacttgtgtctttctctgcccatgtgttcctcacaacatccagccaccatgtgttcctgctagggtcttgggggtttttataggcacaggatgggggcgtggcaggccaaggtggtcttgggaaatgcaacatttgggcaggaaatgcctgtcctcacctaggtctgtggggatg

SEQ ID NO: 518 - DNA, 1193 bp, Homo sapiens
gaatttagggactttgtatggctttcacttctgatcttcatgatcctctcctctttttcagtaacagtaacgagtagccagagtactcctgccaaagcccccagggcaaagtgcaatccatccaattcttccccgtcatccgcagcttgtgccccaagctgtgctggagacctccctcttccttcaaatactcctacgttctctattaaaacctctcctgccaaggcccggtctcccatcaacagaagaggctctgtctcctccgtctctcccaagccaccttcatctttcaagatgtcgattagaaactgggtgacccgaacaccttcctcatcaccacccatcactccacctgcttcggagaccaagatcatgtctccgagaaaagcccttattcctgtgagccagaagtcatcccaagcagaggcttgctctgagtctagaaatagagtaaagaggaggctagactcaagctgtctggagagtgtgaaacaaaagtgtgtgaagagttgtaactgtgtgactgagcttgatggccaagttgaaaatcttcatttggatctgtgctgccttgctggtaaccaggaagaccttagtaaggactctctaggtcctaccaaatcaagcaaaattgaaggagctggtaccagtatctcagagcctccgtctcctatcagtccgtatgcttcagaaagctgtggaacgctacctcttcctttgagaccttgtggagaagggtctgaaatggtaggcaaagagaatagttccccagagaataaaaactggttgttggccatggcagccaaacggaaggctgagaatccatctccacgaagtccgtcatcccagacacccaattccaggagacagagcggaaagaaattgccaagcccggtaagtcagcagtggtgggaagatacatttcctaacttaaaaggggccagacacccagatgtctcaagtcaggatgcttttttttttttttaaagaaagaaatctatttattcctagtgctgccaaattcagcacataaatacaaaacaaattttgcatgggccatatttttagtaaaaatgttttatgctaagaaactatttttgtttgtctgaaattcaaatgtaactgaatgtgctgtattttatctggcaactctacttactcccattaaaatccctcctgtcagggtccatact

SEQ ID NO: 519 - DNA, 1308 bp, Homo sapiens
cctctgttgcttgtcccccaggagtcggagaagctggaaagtgtgaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaagcagtcgtggtatgggggcgactggggagtcctcattgaatcctcattttatacccaaaaccctgaagccattggagagctgtcttcctgtgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggcccccagctggtgtcctgcccgcctttcatctggattctacaaaaaaccaggatgcccaccgttaggattcaggcagcagtgtctgtacctcgggtgggagggatggggccatctccttcaccgtggctaccattgtcactcgtaggggatgtggagtgagaacagcatttagtgaagttgtgcaacggccagggttgtgctttctagcaaatatgctgttatgtccagaaattgtgtgtgcaagaaaactaggcaatgtactcttccgatgtttgtgtcacacaacactgatgtgacttttatatgctttttctcagatctggtttctaagagttttggggggcggggctgtcaccacgtgcagtatctcaagatattcaggtggccagaagagcttgtcagcaagaggaggacagaattctcccagcgttaacacaaaatccatgggcagtatgatggcaggtcctctgttgcaaactcagttccaaagtcacaggaagaaagcagaaagttcaacttccaaagggttaggactctccactcaatgtcttaggtcaggagttgtgtctaggctggaagagccaaagaatattccattttcctttccttgtggttgaaaaccacagtcagtggagagatgtttggaaaccacagtcagtggagcctgggtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttct

SEQ ID NO: 520 - DNA, 1249 bp, Homo sapiens
acataaagattagcttgccttgtattttcactggacagcgctggtctaagtaattaataagacccagctgacattagcatctatttctttctcctctagcgtttctcgaactggttctacagtagcctggggcaccgttaattctgccaaggcctggcgtgggatctttctgaatcctaagatcctgggtgttgggtaagaggatgatgagtaaagaactggctaactggtcccgtacccactgcgcatctcgcagagcgggctcccgaatctcctccggcagagcgtccccgagcttttgcacgaagcggccgcacagttgtagcatttcggtcacagcccgcttcgaggtgcagcgcacccgaaagtcttctcggggagtggcggagaccaaggcctggctctctgtgccagccgcgagctccttgtcccatggagggtcaaggaccaccaactcaggagaccccgccatttttcgtcggaactgtgggcggggcactctgggagcggaaaagcgggttcacactggtgtaaccagcatgcatccggctggaaactcaggacgctgcagctgaaacgttccggctccggctctgctggccggtctaaagcggcagccgccggggcgcaatgcgagcggctggcgtaggcttggtggactgtcactgccacctctccgccccggactttgaccgcgtatgtgagggcgatacgggaccagagggagcagggaggcccccgtcctttcccctcgtgttatctttgctctcctcccttgggacgaaaccccatatcccccgcccagacccttgtttatggccatatgaccttgcccctcatttccctattccctatttaacctcagacataccgatttttttttcctgattcagtagcggtaagctatctccacaaggcttttgtttgctcttctgagttcctggaatcgttccctcactccccttggctggcctgtttttcccctcggggctctcacctcctggctgagatgccactctttgtgggaagcggtcctcgaaacgcgttcaaatcggggagaggtcgggcgcgggctcacgcccgtaatcccagcactttgggaggccgaggcgggcgctgcgcatctcctgtgtccaggagatcgtgaccagcctgggcaacatggtgaaacctcgtccctacaaaaaaaaaaaaaaagccggtgattgtggcgtttgcctgtggtcccagctactcgggaggctgaggt

SEQ ID NO: 521 - DNA, 1230 bp, Homo sapiens
attaaggcattaactctgtctacaagggaataagacaaagctaaacattttctcatagggcaaggaaggggaataacaaacattgctggagacataaaaaagtcttcataaaatataaattaattgagctaagacagaattgcacgtaaaatttgggagagtagggtggcattgtttgtgtatgtttacctacaatctgcaggaaactattttcaaagcacaattttgttattatttgcttgcatcttatttttctatatgccattgcaattgcttactacaactgatccagatctcattcaccaaaatgggaagttagttggacaggacaaaacaggaagaagaaacatcatctaaaaccaatgctgaaccactttagagaactccaagaatgccagcaacagacaaattcagggcagcaacttccctgaagaaagcatcaggtttataactatttaaaaacattgcagagtgtctcctttcaatttctccattccttcttcctggtcttttcatcttccgtatactctgcaatacaaatgttccttttacattgggaggccatagcagaggatcacttgagcccaggagttggagatcagcctgagcaacatagcgagaccccgtctctaaaacaaaaattaaataaaataaaaaaaattagccagcatggtggtgcgtgcccgtagtcccagctactcaggaggctgaggcaggaagttcacttaaacccaggagactgaggttacagtgagccatgatggagccactgtactccagcatgagtgacaaagtgagagcctgtctctaaaagataaataaataaaataaaatgttccctttacagtagtccctctcttatctgcagtgacccacagtcaagtgcagctcaaaaatattaaataaaaaattccagaattaacaacttatgttttaaattgtgttctgttctgagtactatgacaaaatctcacacctttccactctgttccacccaagatgtgaatcctcccttcgtccatcatatccatgctacacgccaactagtcacttagtagctgcttccattcctccagaggcacagcttctccaccccaccacccagtcaccttacttctagccatgatttctccatctttctacatgccccgaccttcagtactaaattttgcttccaccattatgtgtctctcttctctcttacccagatcatgcaagtggaaagcccct

SEQ ID NO: 522 - DNA, 1222 bp, Homo sapiens
cctgctggatcattttgaggacagaggcatgagggagcacatctcttgtgaagttgcagccagatttgtaaccaaccctgaaattcatcagcttaattcatttatcagcttgattcattcatcattcattgcttatatccaaagcaaagacggtaagaaaatgaattcatcctgaaatataaagaaaagggtctgaaggaacaaacacgattctcttatattttggggctcatgagccttgatagacagtttcctctcgtcttcatttccacccctcatcctcagtagtctcctctcccccacgccccaccccaacttcccccccaagcttgagttaaagacagaatagctaaagacagtgctgcctttacaatgcagtaattgccatctttggggccgaaagacaagctctgtgttgtgcttttcttgaccaccccttatcctgggctctggagcttgtgtttccctgctggcgactgtaccttgggtatttgttgctacctctcctgtttgctcagtaggaccctgtctggtggcattgaggctctggaccagaccatctgtgcagttaaggctctaccctgattgagagaggatagcagacctagaaagagaaaggagttgggcagggcctttgaggattgtgtttttcaggcagggccttgatgatcattgttttttatttaaataagatgtgtgtgctggacagagacctaaaagttgaggtcactaagtcattggaaaggccatcaaggaaacagatggggaagctgatttatgggagctgtaaggcatttagctacataacaggggtcctggccaggaaacacatcaaatgtgacccccgctgtgctgatatcatcttcaggctttggtctgcaagatcagaattaatcccactcgggaccccatagtccaaacttggggccacttgatgaacgatggtagaattgtcattggcagagccctgtgcttctttccttttcttcataaaatccactcgctggtcagttatcttcactttgaagcccagttcttagtttcttcctatggcttcattggtcagtgtccttctgaatttccaaggatggtacacaataaatcatgttttgtacttttttcctcttactgcattttgggggatttatcattctatgtctaccttttcttgagtacagctttgatatgcacctgttgttacgtggtgatgggaagtcacagg

SEQ ID NO: 523 - DNA, 1247 bp, Homo sapiens
gtttgctttttgcagcgaatgtcaggtagtgtgcaaaagaacgcttcttttccttcatcttctatattctctttaggtaagccaaaagagaaattttatagttatgtttgcattatttgttgagtttaaaaatagatacttcatagttcaactcattcattattatgattacgtaactgctaaagctctaaatgtatgaaggctgctatacatataatcgcatagaaaacatttctttaaaacctaaattcagatagggcagaaagaattattaaaaactgacaggatatttattagagaaattaggtattaaagaatacattagcttttacatatgggtagtcatatggaactgtagttccatagagttttgcatttagacctttaaaaactagtcttcagaggatatcctgcaccctatccttttttatataatagtgctaatgtattggaatgcatgtgatacactcagtgtttctggatagactgtccatctgaagtacaaaaagcaagagattcagtatgtgtcatttcagttaataaaccctgaaaagctgattaataactgaaaggaataataattctgaaattcagatttttgctgattgttcatactcacagaagatgacagtatcatttgtgtgtgtgtgcgtgtgtgtagagaaacatgaaagataaaactatctttttttaaagtttctgaaattttttaaaatttggaggactttactaaattattctttggggaaatatagaactgtagtctctttcaagtcgttatatgtgctatgtatgcaagtatacaataccccaaggataatattgtggcttcataggcaatatagatcaacaaaattttatttgtaataggaaggtggatgggtaactgtttagttttttttttgttttttgttgttgttttttgtttttggtgcattgatgtgtattccgtttgcttcattgctgctgagtctaccttatgtgcctgttcttccttaacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggtaggaagaatcttgtttatgttgcaatttgatgatattaatattttgaagttt

SEQ ID NO: 524 - DNA, 1211 bp, Homo sapiens
atgcaggaaaggcttgttttggattcatgttttccctgcccatattgaggaacatcaaagatgttcagtggaaggtttagtctggagcataccatagaccagagagagcatcatccagtctagcaaccttatttggcagatgaggaaattgagcaattcagtgactgcctgaagtttacacagctagttagtagctgagattgcactgaagtcagcttctctcactcttaatccatactttcagtgaacagtctcaagctgtgctttctggagacttgatgtcacttcaaccaatattacattcttttgcctatgaacacccttgcctcttacatacacccatacaccctaactctctgtcagtcatcaaccccacactcagcctccatgcatcctgctgcttttcttgccttctctgcatggtccatcatttcagtttgcaggctgacttggattgacccactgatgggcttttcctttgggataagccacattgcagacaagctatctggtcgcattcgtgaaacgagccaacatgaggctgatgccgtcaaaaggaccgagggcatcagctccatgatgttgccacaacctaaaggcagagttgagctagatgttccctggagtgtacccctacggttgtcaaacgaacctcctagatgacctttttacatttatgtgtaaaacaacttatggaaatgcttaattcaccaaaagagatatgtcagaaatacgttaagcagaatagttgcatcagttattcggctacatgaactcctacattccaaaatgagtcaatacatgtgaactacaaacgttttagttatgtataaatacaatgttattttccctgcctacatttcagcatgaatttttgttgttcttgaattattgttttaaagatattaatatccatgaaagagatactcatgagctataatcgaatttgtctcagagtacttattttggattgctgtgttagtgctatgtgccaggaataacatctcatatatctagctttctctttcactactgaaatagacattaggatatctgagtagtctctgccctttaaataatgcactaaatacaatgctcatggacaccctttccttctctcatttgatttcgagatacggagaataaatgagatgttcactggggttttgctgtcttttataaaatccaccccattctggagtgaatgagcg

SEQ ID NO: 525 - DNA, 1198 bp, Homo sapiens
ggaacagccgcccttcagggaagcggtgacactcgaccaagtgatacatccagaacaaggcttggtgagggccgggggcagtaatctggagtataaatatcttgttcttactcttcttcttctctccaatctcctactgagttttcccaatggccagagccaagtggaagtgagaaaacccaggagccccattaccaatatttgtcttatttaaggctggagattgtcctggaggggcaggtggaagatgtctggcctggaagagaagggaagggctggaggcaggaagggagaaaacatcacaaataaaacagctcttgaggttgtgaatgactaaaacactattaacaacaataataatgatgataatggctctatttactgaatttttattgtgttctactgctataaggactttctatgcattaagttgttggatgctcacaacagcctgataaggcagccctgtgatcacccctagtcttatagatgagaaacctgaggcagggaaaggttaacttaactgtgcaagtttacagctagctagcaggaagccaaatttatctggacaagtttacctagtttatcaagtttatcaagtcccctgggactgtactgacagttatcctgctctactctctccaaaggcattctctgagggaaggtgggttccatgctgagggaagaaggtgagcaaacaaatagaggacataaaggtgcctggggtgtgaggaaaacatgaaacatgatggtgtagtcagacactaagggatctggagagagacaagaaacccttgaacagccttggagttgctttttttcctactggcagtggggcgttccactgcctgacaaagcttttgaacatgctgttcctataacgtgggtactgagctaatccccggactttagctgaactcgacatgctgaggttgaagacagctttattgttactcacaaatggagtattacggatccctggttctttttcacctttcatttcttgcgactgatgtaactttttgtatcagtagcaatagaaacagaaactcaaaatatctcaaggcagtggaggtaaaaatagaatgtaatagtaaagcaaagcaatcttcgtcacaaatcttgtaaagtgaacctgtcgggttttgatctcttcattcagcatacttgtcctcacggaggtgcactcacatggaaa

SEQ ID NO: 526 - DNA, 1227 bp, Homo sapiens
agctggtatttttaacaaatgctgtgtgattctgaatcatattgtcatgtttaaaagtgagagctgcttgtacatctttagaatggcagaccatatgtgtcactgtgagtgtcagaaatacttgcatgagctcattttcaccaactggggggaaaatgtaatgtttctattgatggtataatttagacactataataagttcagccatttgagttcttcaaaatggttatattaaaatgatatttttattaagcttcaataatgaaaaacaatgtgatttaatatgtgtatttttatattattgtatggattaattgttaattcagcatttaatggctaacttaaatatgattggaaaagaaacttcaagttgccattgcttttacctaaagtttttaaagtctgaaagatttcagcaaatgcattaaacaggaatgtgtgacatcttcttttagattgcttgtctaatttggagagattaaaaatggtaaaatgcaactttgagtctctttacctttgcatatttaaaggtacaatagtgtggtgttggtaattgtaagtaagcttttctgtgctatgtctttggagtgaaaattcatgttttttttctgaattacataaatgcttttgttttattttgtataatgactgtcttttagatctgaataagtcactttaaaaccttggcctatgaactttgccttatcaatcatgaatctagatgaatgctatctagttcttggttcagttttacctatttttatttttggttcactgcttgcttgagcatagctgggatttgtagcccattttctaggcttattgcaatctcactgtggtattttatagaagctattacaactgataggctagcttcatggtattgatgatacatggcttaaccatactaaaagctgctttccctctctaaattgtaaaaaggtgatgaagtttcacttgatggagacatactatatatgtgtgtttatcatggaactagtgcattaggccataagctgtttttctggtctatgttttttgtatttaaaactttactgaagacaatggactccttcgggttttctttctttcaaccctgaattgtccttgtttgaatttttaagtactgtaatttttttttttcaataaaatctctgacttgggcaagaaaggtaagagttccaatttgtgctgctatttctctgatttcatttgctaagttttcat

SEQ ID NO: 527 - DNA, 1187 bp, Homo sapiens
ggtgttaagccacctcttccctaatattcaggtttcaccaggtctcctgactcttggagggactggagatggtgatgattacagtcatatgtccccgatttattttacttccactcaaagataagatttctcccccaacctcttagctctctatttaggtgccaagttaggccaagtctttttcttctatgcacctagattagtaattaaaatcacctgtcacagggttacaaatgccttcatgctccattcatatgtgcaaaaaaaaatgtagcttctttattatgttacaaaatgctcccattgtcatcaaacgccaccattcattggaagcaggataaagcggaataaagcaaaaaaaaaaaaagaaagaaagaaaagaaaaacttagcttgcttacttttttcaggattgattacagtttaatgcaataattgaaataatctacatatcccaggcacttatgaatatatttcttagtctcctgctcttcaaaagcaggcacctgggtgtgcagtgggggcccacacaatagaaatgaacacgtgggctcctcacccgtcttttgctcctcttgtactgcagcaatgtcttgtctctcccgacaccaccttgtgttgctgccttctgatcctcaaatctcagctgacgggacaggtggtcctccctgctgacccccttcacctctcctgggaatgtgaaagccctgagatctcaatgggactcgaatttggttcccagccagatagtatgccctgaagttcacaaccacaaggcactttcacaccaaccactggactcccctcttgtaatcctagattctcagtaatattacatcctccatttggaacaaataggaattgctgagtcctgcccatgctacctgggagcccaacttagttaggaagatctaagctcaagtgctctctctgcctgtcagagcaacctttttggcactgatgccaccttctgctggtgccctaccagtctgcaggacatgcttcttctgtcagagtcccaaacctaaaactaggactgaaaccttgctgccctcatttccccagcacagctgccttttacacctcatctagtcttgtagctacatccagctgatttaaaaactgatttcatctttaggatattcactgaacactttagatgtactacatactgtgcactacacaggg

SEQ ID NO: 528 - DNA, 1164 bp, Homo sapiens
aggctggagtgtagtggcacgatctcagctcactgcaatctccgcctcccaggttcaagtgattctcctgcctcagcctcctgagtagttgggattagaggcatgtgccaccacgcccggctaattttatatatatatattttttagtagagacggggtttctccatgttggtcaggctggtctcaaactcccgacctcaagtgatccgcccgcctcagcctcccaaagtgctgggattacaggcgtgagccactgtgcccggctactcttcttttcactatttagagagcaagatgtctagggaatttcactgaagtgattgaggtgggtggggattccttggtggaatagccctctggactctgaggtggatcatatgtatgtattagtaaatatagcaaactggtttaattgatacatcctgataattaaatggtacataggttgactggtcagtaagttaggttaaataaatatgagctttgtcagaaaaacacaagttttcattaggtatatttatgttttatttactcaatacatttacatggtagtgttacagattatcttctgtgtacctgccattgcgttggttgcgtggtgttagtcgatttctgatattgaagtagcacagtcatacagaatattggcctaaagaaatgacagacaaactcagctatattgtctgtcaattcataggtcattttcctgtataccatttctgaatgatgactttaatcctcttccattattggatctttttggtgttacaaaacttgaatttaagaaaattgatattaattcttaatcatttgttaattttataaaacaggctgaaaatctttttttctgctggaatcaaatgagagtccaagtgaccacaattttctgtctttctttattatacctttatattgtagcaagttggtaaccatcaaaagtaacagcatctccactggaaattggtacacagtccacatggagttgctgttacacttgataacaccattaaacatataaggagattccttttgctcatcatgggagctgtacgatatctctaagtatacttgtttcacagaagaaagtctcgatttattcatgttctaaataagtttagggactggtagatttgaaacgctgatgttttattttgatttgaatta

SEQ ID NO: 529 - DNA, 1183 bp, Homo sapiens
cattgtcagccactgttgtttataggctaaatttaatattgcctgcttgaaatgttcattatgatggagagagatgaaatttcagattgttttttaggttgaagagtgcattctgaagaaatataagtattttgatggtactgatagacaaaacttggcccttgccaaagatggcccagaaaactctgaaatgtatactggttgagtcagggccattagtgcaggactccttataaatatctgaactcaccatccttgcccatgagtctccaatctactcctgaccctcatgtttcatccagccaagtagtaatatttgtgaaatagcatgtatgtgttgctttgtgatgtatcctcagtatccatcagctttcaagttaaaagctcattcaagttaatattgattcagaatctttggcaaagaatcaccagtgcattttttattagttttcccaaacagttttgggtgctgattcagaggccctcactgattcctgggaggcactttctcttgacactgagtactggaaactccttctgaaacagctggaggattgtctcatacttcagactctgcttcacagcaaagggaacactcagacctccaaagtgtcatcactgcaggctgagccacttccaaggctttctgttaaaaagttattagaaggaggaaaaggtaagctgaagtttatttgagcatttgcatccatttttttatgttacgagggtttcttttaatagaaatgacggaaagaatagagaaagaaaaatacactcagatttaaaaataacaataaccttctatatactacctttaaattaattttctctaaagtctcatttggtcagttccacgctcaggaactgctaggtgcttccctctgcctaagaaaattggcagtgattctcaaagagtggtcagaggacctcaggagtcctccttttttcacctacatgtctatatgagaccagattttcctcttatacttcaaccaaaacacagagcacaatagattgaatggcaaaactgattggagaatccagatataaaccaggcattacagagatttgcaaatatgtaaagtagtgccatatttctcaccaaatatcctttttttttttgcattgggaaatataactacttttttattattatactttaagttatgggatacatatgcag

SEQ ID NO: 530 - DNA, 1177 bp, Homo sapiens
tcttcttgcagccactataagagagcttactgtgttaggtactgagggtatagagatgtaaagacatgcttctctgttgtctgaaagtgtgagtctaggagcctggttagaagaaacacatgagaatggctacaatactacaacatagtaattgtaacagacaaggggaccagctgtagtgggagcagaggaggacacacttattgtttctccagcacaccatacacttttatccctagatctatgtgcatgtgggctagaatgcctcctctgtgtttgttcacttggtcaagttctactcattctatgcaaactggacactgggagagaaagagcaaggagaagaggaaggagagtgactctaaagaggctaaggatatctgacacacaggccatctttctatttactgcatagctcttacatggaatactctgtaataaaaacctattggtaaacatttcagtgtgtctacttttttgctagcataaaaatgctgcaaaattccaaagtgttaagttcagttcagggtagcttccctgctctgttaattaaactttggaacattgaaactggctagggaaaatgattggatagaaactattattctattcatttatccccagcctacaaaatgaaaaaaggtacaataaacgttattgtatgtacatctttatgtagaggtctggttaatttattcaacaaataaatgagtacctattaatatttgtgctagaaatacaagataggaccccaccctgataaagcttacgttttggtgatggggagacaaacaataaactaaatgaatatcaaactcttagtgggcatcatgaagaaaataagtaggttatggtagagagtaaaggaagagggtgctttaggtagactagtgaggaaaggcctctccaaggacatgacattcagactgagacttgaaggatgagaaggagccagctatggaaagaggtgtaggaagagcattctaggtagaggagcatcagggatataggcctgggagccttgaagacctcagagtgttcaagaaacagaaagggggttggtgtgacttgactgtaaagagtgaggggaaaacaggacaaggttaggttggagatgcagactggggttagatcacgtagggataaggagatccgattttattctaaatgcagtgga

SEQ ID NO: 531 - DNA, 1177 bp, Homo sapiens; identical to SEQ ID NO: 530

SEQ ID NO: 532 - DNA, 1198 bp, Homo sapiens
aaaactaaagctaagaaattgtgctttttaattattttttctcactaattaaaatgggatggaatagaaaaaaattattaatattgtaatgttacatacaaaagttatttgaaggccgggtgcagtggctcatgtctgtaatcccagcactttgggaggcagagatgggcagttcgcttgagcttacaagttcaagaccaacctggtcaacatggtgaaaccccgactctgcaaaaaatacaaaaatttgccggacatggtggcatatgcctgtagtcccagctacttgggaggctgaggtaagagaactgcttgcgcctgggagatagagcctgcagtgggccaggatcacatcattgcagtccaccctgggcaatagagctagaccttgtccctcccctgagccccacaaaaaaaaagttgtttgaaaaagatggtttggatcctgaatataagtctgtatatataaagtttataaaacataatcttttgtatttgttgtatttcttttgaaatgcaaaaggtttagaaacaaccactgatttgttcattatattataaaatattaatttaaatacagctgcttttatgggggtatatgcggaaggatttgagtaagaatgtcattttcaattactattcgtttagcaaatatttattaagtacttatgatacttttatgtatgtgtatgtgtgtgcacatacacaggatacacgttctctgccctgtaagagcctaatagttgtgtagacagggtgtacatttatgttagataagtacatgttaactaacaatgcagcaaatgacccaaaacagtatataattaagttctgaataagaaacacagtcaaatgctgtagtttcacaagagggaaagatcattggtggatgcaagaaaacttcataaaggattaaccttagtttggagaagttggatttggagaggtagagtcacttaggaggcatttagttaatgggtgtaggataggcaaaggcagagagtaagagagaatgttgtatttggagagtggtaattataacagctattaagggtgtctatgtgccaggcactgtaaaagtgctttgcatattttaactataacaactctgtgagataggtgcagtttttaactccatttttgctgaagaggaagccgaggcagtaagaaattaaataaattgcccaagatcatataa

SEQ ID NO: 533 - DNA, 1226 bp, Homo sapiens
agcccagtagtcttgaagatataggggaaatagtgtaaacggttgtcaagatgaatctaaaatggaaattaatcagttccctagaatagattgagaaattagctttaggaaaaagataaatttcacacacactgtaccatggaaggtacagtgctgattcagacagactgggaatggtctcatttttaagtggtgatgtgaggtacttcactgagcattgtgacaggcacgggcttgggaagagcctattaggaaatgggagaggcatgagactaaggagcacataagagtaatattagcagagaaattctttttgaggttgaaggtcatgaattttatggtataggaatagaaagaggggttaatccagaatgggatttgagttggaaagggaaagaaataaaggttttgggaaggaggttgctaatagaaaatgagaggggcaagggatttgaggtctcagtaaggagacagggatatgaggagtggagaggttcagaatagaaagccaaattagagttttgggatcaactttcttctcagtaaagtagtcctgggtcttcgtgagaaggaagtattcttcaggcataactgttctactattggttacttcctctttcattgtcttgtggaacacgatgaaacatttaagatgatattcatcttttgagccaataaataagggaaatagatagtttttgtgtttgagctaagtggagtatctcaggccattccaatgtcttcagagttttggctgtaatgctacctcttgagcaagtgtaggtagaggtaagctcttgacagaaaattttaaccctctcttcaaaatgttatatgcttaattaaataacttcttaatttaccttaataaatggcgtataaacattaagttagaaaaggttagtgtatatgaagctgtataatcaacattgtttgactttttttcctcagattgtaaaactgaaaactcagtatactaatactcttgtatactgtatacactcagtattagaaaatgagtacctttgatttctggaatctcggatgccaaaagaggtctcaatagatgaattatacatagatgattcatagacgatagttttagttttatttatttttcagggaaaaacatttgacaatgttcttgattcatttttttggtattaaattatgcagctaatcttagagaaccctgagtgatgccataaaagatgttgatgtggcct

SEQ ID NO: 534 - DNA, 1227 bp, Homo sapiens
tttttggaggttattacgagactgctaatagttgtcatttagtatgcatcattctagaattttttccagaaacataaaaaaatttatattttacgcttctgttttgttgttgttgctgttgtttgagacagggtcttaccctgtctcccaggctggagtgcagtggtgtgattgtagctcactgcctgctgccttgagctcctgggctcaagaaatgatcccacctcagctgcctgagtagctagtagtacgggtgtgcaccaccacacccagctaagtttttgtttttagaggtgggatcttgctgtgttgcccaggcttgtattgaacttctggcctcaagcgatcctcctgcctcagcctcccaaagtgctgggattacatcatgcctggacctaggcttctattttttatataaatgtggtcattctgtcttgatgactttctcatgtacgtaataacttaaaaatagatattgtataatagtctggatacagcagaatttacataataattctcctgttttggacatttagattgtttccagttgtaaatagaactctgctgaacttgtttcacgtatttttgtgcacctgtgatgggactatatgagatagatttttggaagtgaaaatcagggttgaagattgatatatattagattttgaaaaataatgctgtatcatccttcacaaaaactgtcagttacatgtgcccaccaacagtgtgtgaaaataaccatttcctatcaacaatggattatacctgtctttttattttttggcagttttattggcaaatcatattacattttagtatacatgtccctgattaccatgaggttgactatctccagtgatttgaaattatttgatcttatctttcaacccttttgctattgctgtctttttctttttttacattaattggtactctatgatggaaagtagtcttttatttaattatgtgttgacactatttttcccagtcttatgacttatatttaattttattatatagaatattataggttttgtttgtttgtttgtttgttttctgttttgagagtctcactccgtcgcccaggctggaatgcaatgatgcaatcttggcttactgcagcctccgcctcccgggttcaagcaattcttctgcctcagcttcccgtgcagctgggattacaggttcccaccaccatgcccagctaattttttgtatttttagtag

SEQ ID NO: 535 - DNA, 1177 bp, Homo sapiens
tatagtgacatgtataaaataaaaacaagttgaaggtatccacttaaatgtgtttgcatgaaaccgttgattttttttttttttgagatggagttttgctcttgttgcccaggctggagtgcaatggcgcgatctcggctcactacaacctccgcctcccaggttcaagcaattcttctgcctcagccttcccaagtagctgggattataggcatgcaccaccatgcatggctaatttttgtatttttagtaaaaatggggtttctccatgttggtcagggtggtctcgaactcctgacctcaggtgatccgcccacctcagcctcccaaagtagtgggattataggcctgagccaccatgcccggccaaaaccattgattttcaaatagtgtttttcactgggccaacataaaaagatgaagttcctcaggaaactagctatttaaaaaatttgaggggactggataagaaaaagtagggaaattaaaatttgaatatttggttattcttttatgtgtctgcataggaacttgacctgccaattttgaaagtggctgctccagagattgtgtctggagtatccggagagtctgagcagaagctgagagaactatttgagcaagctgtggtgagtcagttaatgactaatgccaggtggtcagacgctaccagcttatattaaagatcctgctttttctgatgctagtatttgttaacccactcactggccattcttttattaatataaacatggtaatttgctatgcatgatggctaaatatttaaagtagatttagtgataccagctgttggataaataacccttttcatttgaaatcaaacataaatgtaattggtgagaaattctgggccgtcataccctgtagtcatatgttgaaaatatattatccttatgatattttccactcacttttactttcctcaacttaagtttggccaaaaaaaacttgtaagcaatgtaaaaattgttatttaggctattataaaagcaaccataaaaataccagaataaattctgtcattccttactagtaaactagggcaataataatacccaaatctcacgtggctattgagagtattaaatgagagaattcttataaaaccttcgatatggtgccttgcacacagcacaagccctgtaaatattagctg

SEQ ID NO: 536 - DNA, 1355 bp, Homo sapiens
gatcggataggagtcggggtcgtggatggggtcggggcggaccccgccggcccgctggcctccctcccctgacccccgggacagcccccgatgcacgtgctgggtgacaggccccctataggttccatacctgccaccggaagtgagtgaggagggcagtataggcatttcctgtgacgcgagcgcctggactccattaggcagcagctgggggaagaatcaacacaccagggagcagagcggagcggatccgaggacagaggcggcagctgcctccgctgccgcccgccgccgccgccgccgcagccactgccggggctcagcccagcggcgggccccgcgcccccgcagccgccccgcggcgccccccggcgcgacccccgggccgcgcaccccgagctgcctccgggaggggggggggaaagggcccggatcctccttctccccctcctcctcctccccctcctctcaccctcaccctcaccctcctaccctgaccccctccccgcctccccggcccccctcaccccgaccctctccccggcccccgcctcccctcccccgcctcgccccaccggcttcccaccacggcctctctcggcgaggaaactctggcctccgcttcctcctcctccgactcggacaccggcggagcctccccgcccccgcggaagaaaccccgagcctcggcggcggagggagtaggagagcccggggcttcggcaggcagagcaggcctctcccctccgtcctcgtcgtcctcgtcctcctcctcctcctcctcctccgtggtggtagtggtgggacttcccccggctgctgcccctcccgccgccgctgctgtcccccaccgaagtagcggccacagcctggtcagcggcagcatcatgcaggccaatggggcaggaggaggaggaggaggtggcggcggcggcggtggaggaggagggggcggcgggggccagggacagaccccggaactcgcctgcttgtcggcccagaacggggagtcgtccccctcgtcgtcgtcgtccgcgggggacctggcccacgccaatgggctcctgccttccgccccctccgccgccagcaacaatagcaacagcctgaatgtcaataacggggttcccggcggggcggccgccgcatcctcagccaccgtcgcagctgcctccgccaccaccgccgcctcctcttccttggccaccccagaactgggcagcagcctcaagaagaagaagcggctctcccagtcagatgaggatgtcattaggctaataggacagcacttgaatggcttagggctcaagtaagtatcccttaccgccagctggtgatggacagaccgagggacg

SEQ ID NO: 537 - DNA, 1247 bp, Homo sapiens
tggcatttggttttttttatttttatttttatttttatttttgagacagagtctcgctctgttgcctaggctggagtgcagtggctcactgcaacctctgccttctgggttcaagtgattctcctgcctcagcctcccaagcagctggcttgtgccaccatgcccagctaatttttgcattttcagtagaggcggggtttcaccatattggccaggctggtctcaaactcctgaccgtgtgatccaccctccttggccttccaaagtgccgagattacaggcatgagccaccgcgccctgctggtttcttttttttttagacggaatctttctctgtcacccaggctggagtgcagtagcgcgatctcggctcactgcaaccttcgactcccgggttcaagcaattctcctgcctcagccttttgaatggatgggattacaggcgtgcgccaccacgcccggctaatttttgtatttttagtatagatgaggtttcaccatgttggtcaggctggtctcaaactcctgacctcgtgatccgcccacctcggcctcccaaagtgctgggattacaggcataagccaccacgcccggcccttttttttttttttttagtaaacatctttattaaagtataatatgtagaaaggagtatatacatccttaattgtacaactcagttttttctagtgaacgtacccgtgaaaccatcacccaggtcatgaaatagaacgttaccaggaccccagtagtatcttattgtagttttaatttgcatttctctgatgactaatggtgtgtgtatataaatacataagtaagtgtatgtatagtcctacatatatgtatgtctatatacattttttgctatttggatgttttcttttgtgaagtgccttttcaaatcttttgcttgttcctcctcttttaagattgtgttgccttttggccgggtgtggtggctcacacctataatctcagcactttgggaggccaaggtgggtgggtcacctgaggtcaggagttcgaaatcagcctggccaacatggtgaaaccctgtctctactaaaaatacgaaaattagccgggcgtggtggcgcatgcctgtaatcccagctacttgggagtctgaggcaggagagttgcttgaacctgggaggtggaggttgcaatgagctgagatcatgccactgcattccagcttgggtgacagagtgggactctgcttaaaaaaaaaaaaaaaaaa

SEQ ID NO: 538 - DNA, 1212 bp, Homo sapiens
aaaataggaaaccttgaaggaatcctagataaacttatttttttttagaattgcccctaatatcttctaaaatttattacagaatgtaaaatgcttattacccatcaaatgtatctgttatgttttgatttatttttaaacaaccatataaagaactttggaagagatcagctggaaatatatctcatttattttatgaataaatatgaaaattctctttagtatgaaaaaaaaaaagaaatcttttcttgccagaattgtttttctctccgttggtattattttcttgagatttaaactttatatgttaagtgcttatcctatttggtaaaagtagccttgtaccccgtctctactaaaaatacaaaaaattagccgggcgtagtggcgggcgcctgtagtcccagctacttgggaggctgaggcaggagaatggcatgaacccgggaggcggagcttgcagtgagccgagatcccgccactgcactccagcctgggcgacagagcgagactccgtctcaaaaaaaaaaaaaaaaaaaaaaaagtagccttgtgtaatatggcctttatagttatcttttctttttttttttttcttgaggtggagtgttgctctgtctcccaggctggagtgctgtggtgtgatctcgactcactgcaagctccgcctcctgggttcacgccattctcctgcctcagcctcccgagtagctgggactacaggtgcccaccaccatgcccagctaatattttttgtatttttagtagagacggggtttcaccgtgttagccaggatggtcttgatctcctgacctcgtgatctgcccgcctcggcctcccgaagtgttgggattacaggcatgagccactgcgcccggccatatcttttctttttaaagtatttaggtagatttgatgacaaggaaaaatattcacatgtattagtgaaaacaaacatatacaacatacacactatgtagtttgaagtttgaaaatatatgcatcgaaatattaacaatggttatctgtgggtggtaggaatcttgagtaattttactttcgtatatgtatatttctagatagtctaaattttgtacaatgcatatgtatttttttaatgttttttattaagtatacgatacctgcaaaaataagcaaacactcatgtaggcttcacccaacttaaaagtattcaatgtctcctattcatc

SEQ ID NO: 539 - DNA, 1209 bp, Homo sapiens
catggaacaaattaaaaaccatttatagaggaacatatcaaaagtaaattagtatcatacaagtgttgaaggatcacaggaaaaatgattgtaaagaaccactagagggtctctattaaagaagaatgttttcgcgtattttaaagattctctgagttagaaatagtgaaaaaagcctgttcagaattccaggtgtaagttgtaatcacacaaaggcgtaatcatgaaaagtagtaaaacatatgtaaggagggataaacagattcagaaaatcatgtagtattatagataagatattggtattgtctctgaagtcagaatccctacattcaaatactggttttatgcagtttttggtaagatggcagattagcacaggctcccaattctctctctgaaaccagttttggattcatcaaaccaatatagaaatcattataaatccctgaggtgacgtaagatggttagatcccaacaagaggaagcagcaacactgaacaaccctggacgccatgaataggagataaagtggaagaaaatatttaggtgtgtactttccccatcaactcaactctgaatgggctattgtccatcctttgccagttagtacaccacagcacagctaggggcaacaacaaaatgtcctattggcagggaagcctaactgggttagggagtaggtaaaaacatattttctcctactgccaccccccttcaaatcttaaaccaagatgattaaaaaagagagaccacacttagaacagtgccagagtggatacagattgttaacacacaagtgacctgctttgaagagtgaccacacacaagtgacctgctttgaagagtgaccactccctccccagattcacacttctgaattcatcagaagtgtaacccaggaaagttgcagtactggaaacaaagcaaaaagaatcagttaaaaaaaaacaacaactggaggttagaagtaaaaaaaaatgtattagttaaaataacataataaatgggttgaatgctggattggttagctgtataacagattagtgagagccataacaacagtcaaggaactctcagaatgcatcaggaagagctaaagaggttaaatattatgtattttaaatatacaacaaatatgtttctataatacagaaatatgtgtatatagttgaaagatgaataaaaattgaaaggttaacattcatataa

SEQ ID NO: 540 - DNA, 1771 bp, Homo sapiens
ggcgagaaatgaagagatgtgtattaactatgaggacagatgttttgattgtgatggattgttagaatggattcatcagtctttgagtagcttctaatttagatacgaccttctgccactttccagtgggattttacagacttgtttaattattctcatcattattagagaaaatgaagtaccttgtggttccatttttagagaatttgggggaaagcaggaaaaaatacattgtagtgataataaaaatatctaatactgtgtactattattatccacaggttttaaccacattctgccttatttctacataatttatttcaccatgttgcttgtccaccgagaagctcgtgacgagtaccactgtaagaagaaatacggcgtggcttgggaaaagtactgtcagcgtgtgccctaccgtatatttccatacatctactaatgctcttctggcttttctacaaaatactcctgcaattccagctgccatttgcaaaaacaaggaaaaaaatccgaaactttcttttgttgcactgacagggtctgtacttttttttttctttttgagtcaggactatggagccgagtagttgatcttttaatatagccgtgtttacttgtattaacttacagttaacataggaaaaatacaagtaaggatgtgagaatttgcattttaatgggaaattttcaacccttaatctgaaaacagaagacagtcttaatataaatgtactgtgaagaatgctattgatgtttatggtttctgattacttttcaaattttgatgtttttttgccagttggcttttcttaaatgaaaacactgttccatttaaagtacatttatgttttattcagtaagagaatagaattttcatttgtttttctttaaatcctttactaattatataatttgaaagcaaaaagaagggcctatattaaatgctgaaagtgaaaagtgatgacattattagcagacactgcttaaaggagaccatttgtagcagttggcttaacctcaacttctaaaactacattgaaaatgtaaatacatagcttagttttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtttgcctttataaactgttgcaaatagaaaaaaaatagaataagtatatatttttggagtaacatcaatatttaaacatttttacacagatcggtgtttgaaaatttgccatttcaggctaatatttttatatatttttgactttttaaaagttcatcagtgtttttgctactgttaagcttatgcagtttatactgtattttttatgtatcctttatatttaccaaacctgactccctgtaaaggagtgctgtcttaaaaacaactgaaggggttaaagtcgtttcttttagtttaatagatgtgcataaggtagctttagcaattaaattctagtgaagttgatatagtctcatttttaattgtcctgtaatggaacagtagcaaattcactaaacttttgtgttcagagttaaattgttctcagtactttcaatgtaggggaatgt

SEQ ID NO: 541 - DNA, 1414 bp, Homo sapiens
cttcatgcaattttgtagattaaaacataaaatttgtccagaacttaaagatttagatgccttcctaaattgttacaatgctttaccaaatctatgacttctacataacacaaaccagtggtcaaatgtaaacactatattgtagatttactgtaggttttcaaccttttttagatttatgcatgtggacatttttataatgtaattacaatcaccacaaggttagcttttttaattgcagacagtaatgcatgtcacactaatatgtagtggccttttcaaggcctagtcccagggaaaacattttgtagagtataggggagtgggaggaaggggaggaataattttttatttaaagttgatttctgcactatctttttctcagttacctgcatgaataaataatgagaaatattttgtgactttaattggtaaatatgttacaaaaccaagtacttaatcttttacatcatgtcttcagctatttgtattttaaccagtaatttcaatggtctgaaacatgattctgagcttcacataatatcttaactgtggaactcaaaagtttgatcactgaatttggcagttattattacctaggtacccccgctgttacacaggtgtttagatacgtgttcctgaatgaagctgcttttgaattttgttatgttgaaatgcaagaaataacaatgatggcagcaattaaggtcacagaaatcattaggtaaaggaaaaccaatgaggagttctgcagttttcttttaataagtaaagtgagacttgggtggtgggaagaaggaaggtgggaagaaggaattagacactctgcctgccactctgcgtgtgtgtgctctcgcgcacgtgctgtctatatggaagccactcccttttctttcctttgaaactggtaaggttaaaataggggagaaatcctacatgttggaatgatagctttttggaaaatttaagaaactctccaggctctccatcttgatttatgcttgagttgttatgtgccatatttgctttgaactctgattatcagaagttttactaaaactttgaaataattcactttcatctgctttctagattttgtacatctcagtccataaagcaaagcttgttgatagtgtagttttctaaacgctgcaaatttgcagcctttaccactacaaagaagtttggatgagggattttttttttctttgtcaaaatagttcctgtttctgtagaaatttcatttttagattaaactgtgatggatgagctatcataattcaagtatacatttcttttttctatcagatattcattgtcatgcagtagtagtaaaaacatcaaagatgcagcaagcttattaagtattattttctaaaagaaataggaggcattttcatctttattattgtac

SEQ ID NO: 542 - DNA, 1268 bp, Homo sapiens
ctctttgatatactttatgacagttcctcaatctttcataatactggcatttttgaagactgtaggacaattattttgcctgttatccttcactttggcttatctgatttttcctcaagattagattctagttatgcaggggttgttttagcaggaatattatcagagcaaagtcatgcccttttcatggcagcacaggaagagatacatgatactgtttcattgcattcttggtgatagtagttttgataaactcttgttgatatataaagtcatgctaagaatctattggttcttaaagcttaaaaaataatatttaggttttttaaaattaatgctgatgtttccttctgttttagatgtaatatattaataaaaatatggttgtctaacataggagttgattatgtctgtatattctcattaagatggaggatacctctttcccaagtggagggaatgctattggtgtgaactccgcctcatctaaaacagatacaggccgtggaaatggaccccttcctttagggggtagtggtttaatggaagaaatgagtgccctgctggccaggaggtaaggaatttcattataatggacatgcccagaattgagaggattttaattgtattccaaatacaactaactagatgcacttctttcctcgtagagaagtggtttttatactgaatcagataatatttttaaaaatcggatttgccttctttgtaggagaagaattgctgaaaagggatcaacaatagaaacagaacaaaaagaggacaaaggtgtaagttaataaagatagtctaccataccttaaaatatggaattcaggcacagctcattcaggaaatagtgtcagcatttatttaatttgggcttaattagtttgaacttatatttgctaatttttaactatgcatgtgaagtggcttgttttgactgttatttataaatttttaatggcagtcttagtaaagtgagttgaatatgtgaaattatgggaaaagcattgaagttcaaacctgtggagtttaattctgttccttaaatgagtgaatgacatttcactacttttttcatctcttagaatctcagttcccttgcattaatttaaaaggaaggaattcgcctaaattcatatgtttcccttaggagcttgatggttattggctgtgccccttcagagtgtaaccttcatgccctcctccctgattcagctgggcaaactctgctttgtctgtgctgtatattggtgtgcaacaaa

SEQ ID NO: 543 - DNA, 1158 bp, Homo sapiens
ctctgtgtcctcacatggtagggtgggtatgggaatcctggggtcggggagatgaggggggatttctctctcctcctcatttcataaggccattaatcctattgaattagggccctgtgcttataacttaatttaacattagttacctcctaaaagccctttttccaaatagagtcacattgagggttagggtattaacatataaattttaggggaacacagttcagtctatagcagaagataactacattttttttttttgtcagtgcatacaactttggaagaaaataatttgtttaatatttaggtgaactttagataagttttgttttaagtaaccagaagttgtttactaaagaagataaattaggggggttgattgatttatacaagatatccgttaaattttctagaaatctctttacactgggaaccttctattttacaatgattaaagtaagttttattaacaggcaacttttccaaagactactttgggtatgaggcaatgtatgtatatctaagtgtagagattgaatggtgtagggtaaagaggacaggctttgaagttaactctgggtttgactctagtttgacatttactaaataatttatttttgagtgggttataaacattttttgggatcgaatatactttgtgaattatagagctgttgagaaaattaaataaaattctggcataacacttggcacacaaaatgagcttgataagagtaaatcccccacttttatgaaagtctgacatctcttaagtttatgttaagaatgtgaaaaaccatgtaagatggtgcagctgctttagaaaacagtttggcagttcctcaaaagttaaacatagagttatcgtatgacccagcaattcctttcctagaaatgaaaacatttgtccacagaaaaacttgtacacaaatgtctatagtatcgttattcataacagccaaaaagcagaaataacccaggtgtgtctgatttcatgaatagatcatcaaaatgtggtatgtccatacaacagaataatatttggccatcaaaaggaatggaattctgatacatgccacagcgtagatggaagcattatgctaagtgaaataagccagacacaaaaggcgatatatgccatgattccatttatatgaa

SEQ ID NO: 544 - DNA, 1187 bp, Homo sapiens
cctcctcccgggttcctcgcggcgatcccgactctcctcccgcggctgcagcagctgccggttgcacacggcctcggcggcggcgcggcgagcgcgggcctgtggagcggcggccgggcgcgcggccccggcgggcacccctcagagggcggccgaggaagctccgggaggaggagcaggaccacgaggaggtgggaggcggcggccgcctggggaccagctccgcgcctcggcctctccgccccctccccagcctttctctcgccctcttctcccacactcccggccggcgcctcggctttgtgcgaggagatggtgtagccccctggccgccgaaggaggagccggacacttgtctcccgtctccgagctgctccccacccctggaggagagacccccccctcggctcggcgccttctgcgtctcccggctggtggggaagcctctgcgccgccggcaccatgaggtgaggggcgcgcggggcgggggccgggcgggccattgtgccgcgggagccgcgacccccgttctcctcggaccccgccttccctctcccggcccggcgcgtctcccctggtctccggtctgttcctcccccctccgccttttgtcccttccaatttctctttctttcttggaaacctccccaacccgtgtggtttgggggtctcgcttcatcgttctctcatttttcctcaaatgctcttctttcacccaggatttcccttcctaaatttaatttgcgcctggctccctcccccaagcctttgcaagcgaaacccgggagatggggaggggttcgagaatcgaagcgtgcgtgttgctgggaaacaggtattttttcgtatatatgtaaaaatttcatgcacttttgcctccgaactctcgtgtttaattaaaaaaggaagaaaagtttgaaaggtctgaaatctctgcgggtaataaagtgcctctggtaggggtaggtgaaggagctgtgaaaggtgaaatttcacgatggtgggggaagggaaagaattgattaggttcacgtggtgggggcagtaaaagactgggataagtaagttggtaggggtgtgtaagcgggggcggggaagggatctgtttggaaaagccttttctcccctttctctgtagcagcctgtgttgcattgcagcagctgctttttccctttgctctgtactc

SEQ ID NO: 545 - DNA, 1199 bp, Homo sapiens
tcctcctcaccttttatacagaaagtacatccctgtcttccggactaaaagggggccgtaattcgtacagttaaaaattttattattggatttgtttttagatttaaaaaaaaccgaaaacaaaaccttcaacaacgatcaattctggcttcctggatgccctcctccccgacttgacttgaaatgaaattgcctcgccagtattttatatctactttttaagggaggtgacttcaagaccattgggaatgacgaaaaatttaaaattatcattagttcctctctctccccgccccctgcccgggattccctctttgctaatgacgctggaaagcggctccactggctgcgtttctcttcttccactcttgcggcaacacactgttccgcgcgcgtctcccggcgactgcgtttccccgagagtcggctgcgttcgtttggggatgaagtcatccctatacctagtgtgcacatcaactcgttccatcggcgcagcacgctgggattcctcgggaagaaaaggagcgaagggaacaatgatgaccatattttccatttatatgcccctcctcaactccgcaggaatcgctgggcgcagccgcggcgagggcgggcagttgggctgaccgggatgccccccgattccctcatccccgtcctgagaccgcaacagggcgggctgagcactcgccccgcgcgagggcacccggccgcgagccgacccggagtctcctggcccggccctgtgcccagtcacgcgtccaagctccccacgccggtgcctacgggtctggcgcccaggaggtctcggcgcctcggtctccgcaccgtggccgtgggggaggcctcggagctccccaagcctctggggagcgggaggcgacggggagggggccgacggtcaaggacaaccacgggcgaggaaccccggccgacaactggccggaggtgttgggcgggaggggggggtggtggcccgcccgaatcccagaggggtgcagggggcggggtagggaggcaacaaagagcctctctccgccgccgccgccgtcgcgctcgctctctcccagcctcgctctccgcagtccggcgggggcccggccgccggcgcgggggagtgcgcccggccccccgcctcccctttcctcccctccccccgcaccgccccctcgcccccgggggaaggaggggaggagggc

SEQ ID NO: 546 - DNA, 1656 bp, Homo sapiens
tttctgtgtttttttttccagcataactcagttacttatggctgggagaaaatatgtagggagataatctaatacctaattcgaaggaagaaaatatctaattctaagtcttgagttcttctcatcagaccatagcaggatttaacatttaacatttttcagaagcttctaatagacttcattcagttttttgtccacagcagtggcatttaaattactgtactttaagacatggaattgctggaggcttggaaacttgagtgcaatttccctagtacgacctccaaggagaatagagcaaaacagtggtaggaaaaactctcaaaattttacccaattgtatgttttctacattgtcagtatctagttttatatagttaatatgtacttctaaaatttctgacagtgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtgggctgttcagaagcttagaggtcattttttgtaattttctttttaattactttagagagctagggatgcaaatgttttcagttagaaagcctttatttacttttggaaattgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttctttaaaagaacattaaatgtaaccattttgtcagatccatgtattttggagcataaaatgtatgctgttgtgaccaataaatataaaatatggtaattggaattaactccacaccatagtatgcattgttatacatactgtgtacctaattatgtatagcagtgtagtctcaattatatctgaaagtaattgtgactaacaagtatgctttgccttatttccacatttaaactacctgttaatataagggatttgtagtatcagcttgttgagcaatgactttgaatctagttttcagtgatcagaagcagcagttatttgagtgtatgaatggaatgatgatcactgtgctataatgtactgaaaccaccatattacagaaatatttactacatattttccatctgtagtttctcagaagggctatggattagtttgaactgtcaaatccttgcatacttctgtgacacccctgcccattttctgtctttaattaaccaaggtgttaggtgtgactgtcacaactgttatgttttccagtaaactagaagtacgatatttgataattatatttgtatttcaccacctaaatgtaatgttgattcctcaagaatgaaatgaaggcactacattgaaatatgttttgtataaatttgtcatgttgaacagcattttagcatggtaagttcccttagctatatgaattttggcatgtttcagagagatcagtaaataaaatattagataaaatatatattgtttgtgttgaagttttta

SEQ ID NO: 547 - DNA, 1207 bp, Homo sapiens
agtattcactgtgggctgaggggtgctggccacacaacctctgtgggaggcatctcttgcagtgaagctgttggtcctcagttcagtgcccactgagggtaaccaggccccagctctgcacccccagctccctgcctgggatcccagccctgatggcaggtggtttccctctcagcaatgacctcctttggctgcacaccatctttgctgtcatttacctcttcctcactgtgggtttcatgcggcaccacactcagtccattaagtacaaagaggagaacctggtgagtgaggcgggacttagggacatgtgctgggagggactcaggtgggagtcggagtggaagggcctcccaggctctgccacaggccctgactgcaatgagctctgggagggcctcaggagccccgcttgcttattcttgctcacacttggcaccatctttaaaaaaaacagtttcctggtggattgtttcaagatttggacagttactggtgctaagtaaagaaatttgggttgagagcagccctttctctttgccgcccacagcttcacaggggaggggagcttctgtggcttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccggtaagcaggtggggtgggaggggagctgagccccctccacgtaggaccaacacagccccacccgcagggcgagcaccttaggtgagcgccttctgtctctcgcttgggtatccaggtgagatctgagaaggacctggccctgccacacgtgtatggagtggctcctgtgtgccagccctgctggtgctgtgcagtgaatagcgccctggtggcctatcctcttcaagcagcctgtgcacagtgtcc

SEQ ID NO: 548 - DNA, 1219 bp, Homo sapiens
tgctgccataacaaagggcaacagcctggatagcttaaacaacagaaatgtattgtctcgcattctggaggctggaagtctgaaatcaaggtgtcagaagggctgcttggtcctcagagagctgtaagggaatctgtctgtggcctctctctttggctggtaggtagccgtcttctccctgtgtctctttgcaccatctttcctctatgcatgtctgtcaaatttctcccttggataagaacaccagtctttatacaatattgtttagaaaaaaaaaaaaagaacaccagtcatattggattaggggcccaccctattccagtatgacctcattttaactaattacatctgtaatgaccctatttcttattttttttaaataactaattacatctgtaatgacctatttctccttccttccttccttccttcctctttcttttttttttttgacagagtctcactctgtcacccaggctggagtgctgtggcacaatcttggctcactacaacctccacctactaggttcaggcaattctcgtgcctcagcctcccaagtagctgggattacaggcacgcaccaccatgtctggctaatttttgtgtattttgcaaagatggggttttgccatgttgctcaggccagtctcaaactcctgagctctagcaatcctcctgccttggcctcccaaagtgctggaattataggcatgaaccactgcacttgtcctgtaatgaccctatttctaaatcacgtcacattctgaagtgctatgggttagaactttaacatgtgaattttgggaggatgaaattcaactcatttcatagggatttgactctgatctctgatgggatgaagcctgagggccatctaattgtacatgaaggaatgatgcttaggaaatatgtggaaaagattgaaataactcaagaacccatcagaataagtaccgttgctttgtatttctggcagcatagaaaacagactttctctaaaacagctgttcatatgtttatgtttctgctttggtgtgccacatgtggcgtggctgggacatggtttgtttgtccccaccaaaactcgtgttgaaatttgatcccccatgtggtggtgctgagaggtgggcctagtgggaggtgtctggatcatgggggggatccctcatgaatggcttggtgtaagactggattagttcctgtcggaaaggattagtt

SEQ ID NO: 549 - DNA, 1232 bp, Homo sapiens
gacgtcgtcagtgcccttgctaagagagttcccacgcggggcctcaggggcggcggggccgccttcccccacggccagcctagggagcttgggaatcgcgacccaatgcacagacgggcagtgctcgctctctcttcacaggcgggaaaccgaggcacaacgacggctagcacctgccccgaggtcacacggcgacccaactcggttctctggccggcggccttgttggttccggtctgggaaagggaccccgcaatcgtccctccggccgccagcagcgccaggcccccccccgcaggggccgggggtggcgggcccgccgctgacctcccccgcccggcctgggtcccgcgctccgcggggtgacagcagccgggcgccctctggtggccgccgcgcgcagcaggcgggagcgcggagcgtcggggcctgcaaccgggcggggatgacgggggccggggaccctgcactttgggacgacctggcctggtggccgcgcttccttcgctacaaaaaggaagcacatcttggaaacaccgaacttctgtgacaccagtagttacacctggcctctgaatcgggcgagcagcgccctcgcgcccccagcgctgagcaggggcgggcggggagcggaaacggtggctgtggttgttgccgcgcggctgggcgcctggggagcccgcggaggggcgcggccgccagaccccgcccggcccggaggtgaggagacctcagccccggacgccgaggccccgccccgccggcgatgcaccccccgcccacctccgcgcccctttgttccgcgaccgcagtcccgccgagagccgcactgaagagccccagcctggccgtcccgcggtttcccgccgcctcaccagtctcgggcgggaggggccccggcgctggcgtggccgcggctcccacaacgcagccaggactgcactcggggctgctggggcccgcgtgcgtcccgggcggctccacgcgtcggggtcgcccccgcgcctcccacccccggcctctcggggccgccggctcgcgcgccttccaggcgaaggccagaggccgcagtgaggggcaccgagtggcgggctcctccgcaccacccccgggctttataataaaagtcgccgttgtttaagagccaggtcggaggcgccgctttctgggcggtgaaagccgaagcgagagcgggcaattcgctgcggcggcggccgcttcctgggcgtcgg

SEQ ID NO: 550 - DNA, 1232 bp, Homo sapiens; identical to SEQ ID NO: 549

SEQ ID NO: 551 - DNA, 1175 bp, Homo sapiens
tttggcttcatagagtatctcaaattgaaacttttctgcacaaagaataaaattaaggattttataaactcaaattggcacctactgaattaaaatacataaaatcatttaaatataattcagcatatgggaagtaacattgcactaatatggaaatcactgccagagacagtctattttcttttaatttgttactacttagtcacaaaccccacattattccagtttggaattacttattaaggagaattggaaatacatatgcccatgcttaaattttatagctttaatttgtgttatttctttattgacgggaagaggtacatctttttttccttactgaaaacaaatatggattaattgcctcaaatttgtataagtgattggctagtgattcttgttttcagaagggagagtggtatagatagaaaatgacaaagatggcaatatacacttaatgttgttattgtatgttgttactgaagtacttagatttttaaaatttcaaatcctaaatcacttcttgtaggagggttttcattaactgcagtatatacagttcactacatatgggttgtttgagttttttgtgtgctgtatttctttctgttttttaatacctggttttgtacatatctaactctgttctcttttggttgttcagaaactggattttttttttcttaagcagtgcttaatttgtgttttttaattttgattcagaagtagtcccagctcataggtgttcatactgttacatccagaacatttgtcaggctctctgtcagctttcatgtacatatggtatagaaaccatggagttaggcacttcctggattttttttttatgagaaaaatactgtatttaaaatgtaaaataaacttttaaaaagcaggcactaatatatatttcttccagcctttgattacaaatttgtccttgcacatgttaagatgaattatctcctaaaaatatcattgttcttgggagcagtgtatgttactttacatagcagcggttcctgtcatgtgttcatgtcagaatatttttggttttaaactttcttattgcctttggctgttgattagtacagtacaagtgcgatttcaaaaagatcttgaaagtaatatatttaatcaattaaaatgtttatctgtaacttgttgatgtttca

SEQ ID NO: 552 - DNA, 2112 bp, Homo sapiens
gaagtggccgctttgaaattctattgagccgaaatgtgatcctgtagggagggtactgccactgttctcattaaactcagtgaaggttgatgccctgggaactttggtttattgccttagttttatatctgaagaaagatagagcatgtctttaaaatgagcacatgaggctgggtgtggtggatcacctgaggtcaggagttcgagaccatcctggccaacatggtgaaaccctgtctctactaaaatacagaaaattagctgggtgtggtggcgcgcacctgtaatcccagctactcaggaggctgaggcacgagaattgcttgaatccgggaggcggaggttgcactgagctgaagtcacaccattgcactccggcctgggcgacagtgagactccatctcaaaaaggaaaaaaaaaaaaaagaaagaccacatggacccaacatcaaatagagctcatctccctggaagctttgccacatctgtactcacagttcatgtcacttgtgacttctgtttttcaggtttgggcaaaactacccctgatccttcagctaacattagtctggatggtgtagacgttcctcttgggaccgggatttcatctggtgtgaatgacacctctctactatataacgagtatcctttcttgagtatgctgtgtgagcacaaagggatgttctcgagctacagagtcacttatgtgctgtcagattacctggggcagacaaggattagaggctgtcctgtagtgtgtcccatggtgactgtttcccttctgtggtccctccctgtgcatagcctggcttacagggtatgagccttcccccagtttccagaggatgatctcctctcctcagtctgcctgaagaagacttagagtaactttcaggctggcattgagcatcctgccagccccggggagatgaggcaacccagccccatgaagaggccttagagtgactttcaggctggcactgagcgtcctgccagcctgggggagatgaggcacatgtacataccctctgttgtatggctgttggctccttaacaagcttcccctcaggtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctctatttgtgtattgcgtgtctggtctcattctgactacagatatggttaatcttcacagtgcaaggtcccaagagactttggggggattgtttctacccttaatctgtgaaaccccagaacgtgccaggcagcaaatagcattgcttaatgggaatgccccacctaagggtgggccaagcaccaggcataggagac

SEQ ID NO: 553 - DNA, 1231 bp, Homo sapiens
tatgtcaaagaaatctgttttggggtaaagtattaatattttgatttccttcacctgcatactcaagtcctgaggggaggtggacgacaggatggacaccacacaggcctctggatctctttctctgtcagcctctcccccagcctcctctgggcacacacttcatcttcagggctggtgcaagatggcagccccagttcagcctcagtgagaaggagaatgttcacaggaaaaaagtgcaagtagaaaataaaatcctaaggccctcaaccaaatgaacagaccccattttggccaaggggatcccagataaaccttaaaaacagtgcccagctgtgacaggacaggaggtcagacaagcctcattacaccccctcccttttgcggtttagacgcaacaactgaccagcattaatgataaaatagagattacaagacagacagaagaggctctttttggcaataagataccaaattatacataggacctaaggccatgccaggtaagggttaagcgtgcacagtttattaaagaataaactatgttctcagatgtgagggtgatctggctgcgacacctgtcaccccatggatcatcagggttgattcggctgatccggctggctaggtgggtatccccttcctccctctctctccaagtacgtccctcccaaagctgcgcactcaaagaggatgaccatccccgatggaggaggacccagctttggtcaaggatgtatgagtagccatgctcccctgctagaacctccaaacaagctctcaagaataagctatgttctgtcataaggtttttctttttttctagcagctgaacaagcaatggcctcaagataagcaagatgaaaataatcatagctccccgccagatgctgactgaccctcttcctccagccacaactacagctttgactggacaagaaactgatggctgtgactttctcttgataagagaccactgaccatgagctggttctagctggtttacagagcttgtgcacttgagtgcccccatatctctgcttcaccttttgatatatagggcccaactgtaatacatttacgtgttaagtctctgcctctaaatgaacatgggtcatatgtaacatgcatttttattcagtatgcaggtgttcatgaaccaccttcatgaatattcatagctcctcctatcatctgttgaatatatatacttggccaacccattcaacat

SEQ ID NO: 554 - DNA, 1183 bp, Homo sapiens
tgctgcctttgaagggctcacagccagtgcagggaagagagtgtcccttcttgggactgctctcccttcaggaattgtcctcattgtgtcgggtgacatgattctagtaaataggaaagcaaaaagcaaagcaaacccggttaaaaaaaaaagtgaaattgtacccagaaatctagtacagctcgagaccatggagaagaccaggaatgaagcctcgggaagtctccagggctgtgggaggctatctgctgtctcactcaccctgccagctcttcacacgaaacagtttctcacacacacacacacacacactcacacactcaggcacacatagactcgtgcacgcatgcacgccagggactgatgatgatggctgaaagtcctttacccatggtgttcttcgctgccagagggaaagctgagagcccctcgggccccagggccattgtcttcatgggagtaagggcaactgaaagggagggggggccagcagcagccgctcttactgtgacagcatgcactgcttttggaggctttagtcagattccgactcaggggctgtcctgcagtcttctccccagacaaatgggttgttctgtgggggggatggttgttctatgggatgaaggagacagaggctgcacagaggagacagtagggcgggggagagtgagtgcaaaaacccaaagtcactgccttgcttccaccactagcccaggcaggtgggagggcctggcctacccttttctttgggggaggtctgccccctcggcctcttccctgacacgcagccttactttttcattgtgatgagatagtatcatgagaggcggccccagactgccctccccgtgggcccaggatgctggaccttgttggaccttggtggaggatgatgccgtcaaaaagacattgctgtttgcaccttctcaatatctcaccatcttgcttctgtgtgctttctcaaaatgtctttacgcgtcatcatggtcatgtagtctcttttcaattttttctttatttttaattttaaaaatgtttttaaaaaactgagataaggtctcactatgttgcccaggctggtctcaaactctggccctcaagtgatcatcctgcatttagtcccccacaccaccgccccaacccccagctttttttttttttttttttttttgagaatgca

SEQ ID NO: 555 - DNA, 1242 bp, Homo sapiens
gcaccaccgagaagatccacaacctgattcccgtcatgctgaggcaccgtctcgtccccccacccgaggaaacctactccctgcacaggaagatggggggctccttcctcatctgctccaagctgaaggcccgcttcccctgcaaggccatgttcgaggaggcctacagcaactactgcaagaggcaggcccagcagtagggctgcgggccacgcccaggccggctccgcgggaactctctccctcagacaggccaaaaaccagtagcgaggtcgtggtgatgctctttttaactcctttgcccaataaggggggtggctgcctggagccccgtagccagcgctttccacggtttctgttgctaaatggttgtagggtgagaagtgcaagaatgaagatgaagccccactgctcggtcagtctgcctccgtgtgtcctctgaaataagcagatgaagatgaaagggcaactttgttttcttctttttcctgatgtgaatgttaagcagaagggagagagtccttactcccttccaatctctgttcagtgcaaaacccagaaacatgaacagatacgattgtgggattttatcatctgtgtagtaggtgtgtgtatgtgtttctagagtgagatttgtgttttctgcccttttcctctccagccgatgggctggagctgggagaggtgctgagctaacagtgccaacaagtgctccttaagcctgcgaggcccaggcctgtggggctggttctcacctttgacagctgaatgttcctaaagaactgctgccccacagtgagggtgggagcagcggaacagggaatgccagacacaggctcgctgctgctggaaggcggggtgggacttccttcctctgtccggagaggcacaggtgtcaccagttccagccaaaggctcctcacaggcgctgtgaatttttgtacaagtcttgtaattatcgaatcaacaacttgtttcaatttaataaaaatgctcatgggaagtgctttggcgcgtgtaccctcttctgtattctggagaatgacgacccgtatcttctagctcgtggtggtggttcttttctgacctgacggtcagcaggttcagtgtcacagcccatttgcaagggttgggactggttcagcgtgaggcccttggccctgaacctggaaggctcagccccgttccctgtaagaagggaggtgggaggggtggagaacaggaggagaggttgcggtgtca

SEQ ID NO: 556 - DNA, 1229 bp, Homo sapiens
tgtcccaacattgccttcctcttcctctgcagtccccatacagtgaccagcttcctgggccactctctttactcatgctcaggactcgtgcctttccacccagccgtatacacctctgggcagcgtgcctgagtcctcagggtcagaaggaacgcctatccccctgcatccctgcactctgactgctgtggctcttcgtgtatggcatcccacgctgcagctctgtccttcattcgctccaccctagacagtgtagaagtactcagctaggagacgggaagaggggagccccccaagccctgacctgggaaggcttgggtctggcaagggagcaggcaccagtatctgcaccataggaagggggtggccctggggccctgcctgggagtctgccccctctgcccgggggctttatggagcaggtaggctgcaggcgacatgtaatgctgtttcctcggggagacgcaccagggggccgccctgacgctggctcctgcgcgtgccccgcaggccatcgccagccacatgcacctcaagtgcaagtgccacgggctgtcgggcagctgcgaggtgaagacatgctggtggtcgcaacccgacttccgcgccatcggtgacttcctcaaggacaagtacgacagcgcctcggagatggtggtggagaagcaccgggagtcccgcggctgggtggagaccctgcggccgcgctacacctacttcaaggtgcccacggagcgcgacctggtctactacgaggcctcgcccaacttctgcgagcccaaccctgagacgggctccttcggcacgcgcgaccgcacctgcaacgtcagctcgcacggcatcgacggctgcgacctgctgtgctgcggccgcggccacaacgcgcgagcggagcggcgccgggagaagtgccgctgcgtgttccactggtgctgctacgtcagctgccaggagtgcacgcgcgtctacgacgtgcacacctgcaagtaggcaccggccgcggctccccctggacggggcgggccctgcctgagggtgggcttttccctgggtggagcaggactcccacctaaacggggcagtactcctccctgggggcgggactcctccctgggggtggggctcctacctgggggcagaactcctacctgaaggcagggctcctccctggagctagtgtctcctctctggtggctgggctgctcctgaatgaggcggagctccaggat

SEQ ID NO: 557 - DNA, 1225 bp, Homo sapiens
ggcctggctctgcccaccaccctcaggtcttcttgcctcttcccttgtgctgctgtgaggggttgggcttgtgggaaagtgtccctgcagcacagtgccctgggtattgtggaggtcgggaatcaacctgatttgtgcaggccgaggcccgggggcagggcctgaggggtgggatcactgggcctggcccaggcctcctgcgcccctttgctgcccccatcacctacgttgcttgccccttgggcagggcgtcctcactgcctctggaggctgcgatgggcagatctctcccccagggctgcacctgcgggggctacgaaggtccccaaaagcggtgaccctcctgcccccaaatttagtccctttttctgcctggggctcccttccgaaatctcacctctgtgaagctgtggcagggttgtctgtttaggggaaggacgtctcccaccctacaggcatctcagatactcttggaaagccccagggagggttgtggatgcctgtggaaccttctggttgtgctgcctctccctgctcagccagagcggggccatgtgcggacatttcacgggggttacatgtggttatggcctctttagggctgaagggacctggctttggttctctgctggcagagcgtggccaggggtggctccagggtcactgagcggggattgtgtgggaaccagagcctgcctccccttcctttaaaatactttttatttatttatttatttttgagatggagtcttgctctgtcgcccatactggagtgcagtgacacaatcttggctcactgcaatctccgcctcccgggttcaagcaattctcctgcctcagcctcccaagtagctgggattacaggcgcctgcccctatgcccagctaatttttgtatttttagtggagacagggtttcaccatgttggccatggctggtctcgaactcctgacctcaggtgatccacccgcctcggcctcccaaggtgctgggattacaagtgtgagccaccgtgcctggcccctttaaaatatatattttttaatgtgaaaaaatgcagacaggaaagagtgtatgtcagatacatgcacagtttaaaaagtaataaaatggattcctgtatagccagccctagggttaagaaatgtaccttccccagcctgggcaacataatctctacaaaaattttacaaagatagccaggtgtggtggcacacacctgtag

SEQ ID NO: 558 - DNA, 1364 bp, Homo sapiens
ctgtgttgggagagccggccacgcccttggctttagagctgtgttgaaatccattttggtggttggtttttaacccaaactcagtgcattttttaaaatagttaagaatccaagtcgagaacacttgaacacacagaagggagaccccgcctagcatagatttgcagttacggcctggatgccagtcgccagcccagctgttcccctcgggaacatgaggtggtggtggcgcagcagactgcgatcaattctgcatggtcacagtagagatccccgcaactcgcttgtccttgggtcaccctgcattccatagccatgtgcttgtccctgtgctcccacggttcccaggggccaggctgggagcccacagccaccccactatgccgcaggccgccctacccaccttcaggcagcctatgggacgcagggccccatctgtccctcggtcgccgtgtggccagagtgggtccgtcgtccccaacactcgtgctcgctcagacactttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttggggaaacctcagaactggtctatttggtgtcgtggaacctcttactgctttcaatacacgattagtaatcaactgttttgtatacttgttttcagttttcatttcgacaaacaagcactgtaattatagctattagaataaaatctcttaactatttcaccggctctccagtgcttccacacaggcatgctgcccccaggagatggtgggtgcatcagccagctttactctaggaagtacaggtgactgcctagggccgccacctcagtccacaccctccccatgttccctcctgagtgtgcaggcacttctctgtgtctgtgtgagaggctcttccagcatggttgcccacagtgaccttgatctcgtttgcagtcctgtcgggcccagccaatgagacctgggccatacagggcaggggtcagcaggcaccatggaagacctcagcctccgtccttccctccatcggcctgctgctgaaccccactttgtatagctggctatggggcagggccactgctagcatacatagggctttgtgccaaccagggaatggtccctgcctgagtgggcacagcccccacctctcctcaagatgccatgcagcagggggctgccagtctgggggtacctgtttctgg

SEQ ID NO: 559 - DNA, 1192 bp, Homo sapiens
aggcctcagaatctgtgtccccagctctccccagcagctctcaggccagtgtccttatgtcatgagactagagcaggcccatgggctgagttgaccatggtgtgtgccctgcagtggctgagccgggggtggtagggacagtagcatgatgtccttggggtgtgggtctggggtctgggtccggtctcatgtgaggacccctgtctgggtggtagggacagtagcgtgatgtcctcgggggtctggggtccgggtctggtcagatgtgatgatttctgtctgggtggtggggacagtggtgtgatgtccttggggtgggggtctgggtctggtctaatgtgatctgctgactcctctgtgggtgctgggccatgggagggcccggcagtgactggagagcgtgtactgggtggtgggggcttgtctctgtgctctgggccctagatctctgtaagcctgtgctgggccccttggtcatcaccatgtgtccacctgtctttctgatatccatctcccttccaccctgtccctgagctggggacaacagaccacactcagcttggcaccctctttccaatggccctgccaacactccgctgcctctgggctggcccaggttgctggtccatctctcctgacccttcacgtcctactgcctgtggccctgcgtggtggggagggctggcgacaggtgagggccccagggccctggaagaccgaggcagggaaggggccgcatcctgttcccaagggacatgatgatggtgctgccaacatgcagccttagacctttggctctggtagtgccggggggagctctgtgcgtcaccgtgcactgcttaatgatggacagccctgcctggctgtcactgggctgacacatgggctgtgtctgctctggagcctctgaccctgcatccctccttgtccatcccagagcccaaggtggtgtttgccaaggagcagccggcatgcagggaggtgcaggcggaggcgggggccagtgccacgctgagctgtgaggtggcccagggccagatggaggtgacatggtacaaggacgggaagaagctgagctccagctcaaaagtgcacatggaggccagcggctacacacggaggctggtagtgcagcaggcgggccaggcggatgctggggagtacagctgtgaggcggggggccaacggctgt

SEQ ID NO: 560 - DNA, 1170 bp, Homo sapiens
ccatggaggtgcagctgtcgcatgcggacgtggatggcagctggactcgtgacggtctgcggttccagcaggggcccacgtgccacctggctgtgcggggccccatgcacaccctcacactctcggggctgcggccagaggatagtggccttatggtcttcaaggccgaaggagtgcacacgtcggcgcggctcgtggtcaccggtgcgttggggggccggcagggcacagcacagagcacgcctgcctgtcccgagggggccccgggaaggtcggtgggttctctggggacctagatgagccagctccgtataactccgtccagctggggcactgccccacccctgtccctgtccccatcctgaaggcttctccaagccctttttctcttcccacctcctccttcctcctccccagagcttcccgtgagcttcagccgcccgctgcaggacgtggtgaccactgagaaggagaaggttaccctggagtgcgagctgtcgcgtcctaatgtggatgtgcgctggctgaaggtgcctccctgccgaccccactcggttgcctcctcccctcctctcatgtgggcgggcccaagcagaaccccagggctggaccacctgagtgcctgactcggcctctgccctgcacaggacggtgtggagctgcgggcaggcaagacgatggccatcgcagcccagggcgcctgcaggagcctcaccatttaccggtgcgagttcgcggatcagggagtgtatgtgtgtgatgcccatgatgcccagagctctgcctccgtgaaggtacaaggtgagggctgcgtggggcatgtggggcatggcaggtatgggcacctcctcctgtcctccgtgtcccccagccaggggcttggcagctctactttcacctgcacaacccttggcatgctggggcactgggtggggggtgctgggagcagctctgtgtgtccgggtgtggcagggcctcccttgccaccctaggccgcaacatccagatcgtgaggcccctggaggatgtggaagtgatggagaaggacggtgccaccttctcctgtgaggtctcccacgacgaagtgcctggccagtggttctgggagggcagtaaactgcggcccactgacaacgtgcgcatccgccaggaaggttcgaggacaggcgg

SEQ ID NO: 561 - DNA, 1167 bp, Homo sapiens
ctgttctctgttcccagggcactgtttcacgtccacatgtccatgctttaattcctagtttcctccagagcgggagtgtgtccttgctgagtgtccccaggtgtctccagagggcctcatggtttttgtgtcctctccagccttgccagccaggttcatagaaagtatgaggcctgaggatgcctcaaaaggggccataccgtggtgctggtgggctggaccgtgggaagccgcagtgcacagcctgtactcagcacaccccaggagcagcccatgttcagatggcttccctgtcttctcagtgttgtccatgtcctgtctcttctgtgggctcagagggtgtgactgtggccatctctttctgatccctcagccctgccagccaagttcacagagggtctgaggaatgaagaggccgtggaaggggccacagccatgttgtggtgtgaactgagcaaggtggcccctgtggagtggaggaaggggcccgagaacctcagagatggggacagatacatcctgaggcaggaggggaccaggtgtgagctgcagatctgtggcctggccatggcggacgccggggagtacttgtgtgtgtgcgggcaggagaggacctcagccacgctcaccatcaggggtaaagatcatgtgtggccttgtggacccgtggcttggtgtctacatgtcactgagtcatcctcatcttccaatgtggcacagcccctgtggcaatcccggggttgtcttttctccaactgaggtcctccggttgtctcccgcctactcttcttgtccaggaggtgtcctcatgctcatgttcatccctttgtgttctctgttcttcccgggccatttgcttcctccccgtgtgaatgtttatttgctccttcacatgtggtcctttggcggtttgtgtggctccttgtgggtgtccatgtcccgtccacagagtcttccagacagtctgatgatctcagcgactgcttggtccttcccagctctgcctgccaggttcatagaagatgtgaaaaaccaggaggccagagaaggggccacagctgtgctgcagtgtgagctgaacagtgcagcccctgtggagtggagaaaggggtctgagacccttagagatggggacagatacagcctgaggcaggacgggactaaatg

SEQ ID NO: 562 - DNA, 1163 bp, Homo sapiens
tgagttccctgattcaccaggcagatttcagtttgtccccattgtctttgaggaggggacagggtgtcaggtgcaaaagggcaggcttctgtgacaggactcatgtctcatggtcctgcctggcctctcccgcaggcgaagctggagaagtcactggagcatctccggaagcagatgcaggatgcgttgctgttccaagcccaggcggatgagacctgcgtcttgtggcaggcaggtgctggggctcccagggtcctgggtggcagggtagggggtgaaggtcctgtataggagaccccagggggcgatgctggccaggcacacttgcccttggcgccccaggaccagtcactgcttcagcctggccccaccgagcccactgaagggctggtcctttcccacgtgcacctgtcctgccaggtcgtgggcgtgggctcccatactgcaagggccccatcctggggtcccagcatgcttgggtggcaactctcaggtgtatttagggtctgggccctggaggtaaatttggaggttttgagggactaggtcatagatgtgggattcagccatcctgaggagtagatttgggatctgtccagttctggggtagatttggggtctgggaggctctgggtggtggatttgggatctgggaagccccaggggagaatttggaggtcaggagggaccctgggtggtagatttgtagtccagctggccccaggtggtagatgcagggttctaccaagccaatgggtggatttggaagttggggagggactagatagtggatttgggatctagtcggccctgggtttagatttggggtctagccagtcctgtgtggtagaatgggatttggctctccctgagtggtggatttggggtttgggaggtgccacaggtgggtttggggtctggccagcaccaggtggtgggtttggggtcctgccacacctggtgctgtgctttggctttagcaggccccgggggtggggttgggtgcagccaggcctctgggtgggcttggggtctgaccaaacttggggtctggctgggcctggggtctggcctcagctgtccttctccctgggctccacagaagatggtggagagccagcggcagaacgtgctgggtgagttcgagcgtcttcgccgtttgc

SEQ ID NO: 563 - DNA, 1254 bp, Homo sapiens
tcctggtggtggtggggtgtgtctgggtttctctcagcccctcacacccaggatcaggccgccgcctctagtgccagcccggggcaaagcagggccaaaccctgaaccgctatagcccacgccctcttgccaatagaccgggtcttggtcgggacaagcgaacgttgtgggggcgttgtgagaaaaacccccgcgaggctgggccggctgttcgtccttgggccagccttgacggctctggttggttggggcaagatggggcctcgcaggatcttctgagcggcgagggatccaaaacgatacatccgcgacagggcggaggaatggaaggggtcccaggatcgtgggccctgggccgtgacgcctcggagcactccctgttccgagcgggccggatgtggcaggatcccgggagctcgggagccacgggaaggccgcgggcgagcggctcgagggtccacgatccgagccccgcggccctgggcgggcggtgacagctggaatccggccggcaaggctggccgggcacttgggggagccaggctcctcttctggcgcctacgaccataccaccctgaacgcgactgatctcggaagctaagcagggacgagcctggttagtacttggatgggagaccgcctgagaataccaggtgctggaggcttttttttttttttttttttaatggctttttctttacttttcttccagacagagtctcgctctgtgacccaggctggagtgcagacgcgccatctcggctcactgcaagttccgcctcccgggttcacgccatactccggcctcaggctcccgagaagctgggcctacaggcgcccgccaccacgcccggctaatttgttctatttttcctagagacggggtttcaccctgttagccgggatggtctcgatctcctgacctcgtgatccacccgcctcggcctcccagagtgctgggattacaggcgggagccaccgcgcccgcccggcctgctgtaggcttttttgggtttcccgctgcctcccttccccctgcagtcgccatgcttccgaaccttctctgactctgctctccctttatagcacacctataccccagcggcagccggggacatcctacttggggtcccagctactcaggagttcagaggtgtcagggcccagggcccacgatcctgggacgccctccggtcctccgccctgtcgcggaggcagcgttttggatccctcgccgcacaggggctcctgcga

SEQ ID NO: 564 - DNA, 1253 bp, Homo sapiens
gtggcggtggggtgtgtctgggtttctctcaggccctctcacccgagatcaggccgccgcctctagtgccagcccggggcaaaacagggccaccccccgacccgctacaccccacgccctcttgcccccccggccgggtcttggtcgggacaagcgaccgtggtgggggcgttgtgagagaaaggccccgcgcggctgggccggctgttcgccttcggccagccctgacggctctgggtgggtggggcaagagggggcctcgcaggagcccctgtgcggcgagggatccaaaacgctgcctccgcgacagggcggaggaccggagggcgtcccaggatcgtgggccctgggccctgacgcctcggagcactccctgctccgagcgggcccgatgtggtggaagctcgggagcgcgggagccgggggaaggccgcgggccagcggctcgggggtccccgatccgagccccgcggccccgggctggcggtgtcggctgcaatccggcgggcacggccgggccgggctgggctcttggggcagccaggcgcctccttcagcgtctacggccataccaccctgaacgcgcccgatctcgtctgatctcggaagctaagcagggtcgggcctggttagtacttggacgggagaccgcctgggaataccgggtgctgtaggctttttctttggctttttgctgtttctttccttttcttccagacggagtctcgccctgtcgcccaggctggagtgcagtggcgccatctcggctcactgcaagctccgcctcccgggttcacgccattccccggcctcagcctcccgagtagctgggcctacaggcgcccgccaccacgcccggctactttgttctatttttcctagagacgggctttcaccctgttagccgggatggtctggagctcctgacctcgtgatccacccgcctcggcctcccagagtgctgggattacaggcgcgagccaccgcgcccgcccggcctgctgtaggcttttgtggcttcccggctgcctcccttccccccacagtcgccatgctacccaacctcccctgactctgctccccctttaccgcccacctacacccccgccgcagccgcagccggggtcctcctgctgggggtccgcccctactgcacgccggcccggcagcagcatcccaccgcttccgcctcgccgccgccccgccaggagcccggctccagcctgggagggcagggggccggaccccaaagg

SEQ ID NO: 565 - DNA, 1251 bp, Homo sapiens
tcaagtgattctcctgcctcagcctcccaatagctgggattacaggtgtgtaccaccacatctagctgatttttgtatttttagtagagaggggatttcaccatgttggccaggctggtctcgaactcctgaccttaggtgattcacccttctcagcctcccaaagtgctaggattacatgcgtgagccaccgtgcctggccggcaagggagaatttaaggaattataaaaaattatagtgagctgactagtaggggatagagtacacaaaactcattttccactatttgagtgaacaattgtttactcctctgaaagcacctgtgggcttcactggcccgctccactgaccggcactgcctccacccagacttgcgggagtgctcacccacctcagcgtgactgtccctcccctctgtactcttctctctattccccagttcccaagagttatccctttcttttttttttggttaccaaatttctttatttgaaggaatggtacaaatcaacgaacttaagtggatgttttggtacaacttatagaaaaggtaaaggaaaccccaacatgcatgcactgccttgaagaactttgccaaatactttcttcaccaatctcatgaggagagggaacatgctgagaaactgatgaagctgcagaaccaacgaggtggccgaatcttccttcaggatatcaagaaaccagactgtgatgactgggagagcgggctgaatgcgatggagtgtgcattacatttggaaaaaagtgtgaatcagtcactactggaactgcacaaactggccactgacaaaaatgacccccatttgtgtgacttcattgagacacattacctgaataagcaggtgaaagccatcaaagaattgggtgagcacgtgaccaacttgtgcaagatgggagcgcccgaatctggctcggcggaatacctcttagacaagcacaccctgggggacagtgataatgaaagctaagcctcaggctaatttccacatagccgtgggagtgacttccctggtcaccaagagttatccctttctaacatattgttctccccctctccctcctctgctccatctccctccctctgtcccttccttccttctgtccttcctccctccctccctccctcccttccttcctttcttccttcctttcatttgagtattgtttccaccccaccctcaccccacaaaatgtgagctgtacaagagcaaggattttgtttgtttgtt

SEQ ID NO: 566 - DNA, 1251 bp, Homo sapiens
ttgtgcactgtggacacagaagctcatacacggtgaagttctgctgccaggtgcgtacacctttaaacatgctgcgtcttcttggtgaattgacccttttatataaaaaccctctttatctctggtaatttcctttgctctgaaatcaactttgctattgctttcttttttgattagcgtttttatggtcctttttcattatttttattttttttgagacagagtcgcccaggctggagtgcagtggcgcgatctcagctcactgcaacctccacctcccaggttcaaccaattctcatgcctcagcctcctgagtagctgggattacaggcatgtgccaccacaccaggctaatttttgtatttgtttttgttgttgtagagacagggtttcactatattgaccaggctggtcttgaacacctggcctcaagtgatcgaccctcctcagcctcccaaagtgctgggattataggcgtgagccaccatgcccggcctggtccatctttttctgtcctttactattaacctactcatatggttgcatttaaaatgaatttgttgtagacatcatatagctgaatcatgttactgtcttttaattggtgtgtttacactatttacatttaatgtagttactaatgtgtgtggtttctgtttgttctctgttttttgttctttggttcccccttctgttttcttctgggttatttgaactttttgttgttgtggtggtggtggtggtggttgttgttgagatggagtctcgccctgtcgcccaggccggagtgcagtggtgcgatcttggctcactgcaactaccgccttctgggttctgggttcaagtgattctcctgcctcagcctcctgagtagctgagactacaggcacctgccaccatacccggctagttttgtatttttagtagagacagggtttcaccacgttggccaggctggtcttgaactcctcacctcagatgatccacctgcctgggcctcccaaagtcttgggattaacaggcgtgagccactgcacccggcgcatttgaacatgtttagtattccattttatctgttatgattttgactatatctttgtataaagttttgaaaggaaaacagcctatttagaaccgtttttgtcacttaaatatgcttggaatacagaaaccttcccaccatgtgggtccctttactcgcccctctttctgttacagttgtcttatatattgcatctacataggttggaa

SEQ ID NO: 567 - DNA, 1218 bp, Homo sapiens
gcaggtgtacagagagaagccaagatgagagatgatgtggcttgagaaacggttgccattcattctctggttccctggagacccagctgcacttcctacagctgggttctgttacatcgctctgtgtcttgtacaataaaccttttgcttgagctggcttgcgtgggtttctgatccttcaacaaaaacttcctgtgattctagcagtcccaaatcgatttctccccagatctttcagctgacatgatttcttccccttttgttacctagtctatgagaatgaaggagattctgtcggcatcagtgattttctttttccagctattgcaaaggtattttacatttgctaggggttagaggcaatgactcggtactttctccaacacagggggagcagattcatcggtgaagtcaatgatggccacttacaagcagttccacataagcagtgtattgtaacacagaagtattgaataattgaaagcataaccatactaataggatctttgcctggctacatgatagccatgagaaatatcagaccacgagccagggagacaaggtgcatagttccaaccttgcctctaattggctgcgtgattaaaggcatcaggggcgttcagtgcaccttggggtttcagcggcctcctccccttgctcacaggctcaaatgagacaaggtatatgaaagcagtttgaaaaggtacagagtgccttaccctgagatatgtgaaggactatatttagttactgggagctggaagggcctaatgtctttcccacatgtcctatcaaagacacatgtgcaggacagctggtgaatacagatcggtgaagtgctgaccctggctgtgctttggaatcacagtggtgctttacagacccagaggggccgccttacccagtctctctgaatctgaagcttcttgagcaatgcttggcagccagggctgagaatctcttctgctgccctgtctccaagttaggcgccgaactctgggagtcagcaggcctatgttggcttctgacgcttggatgtcccgcccagcccctggaggtcagagcccagtgaagagacagcaggagccagagccccaagctgagcacagacacttactcatcctccccctcgctggccacactaatgggaatagttgggagagaaactcttcagtgctaacaggctgcagctgctgttgtggcagcagccaggtggtg

SEQ ID NO: 568 - DNA, 1203 bp, Homo sapiens
tgtatgttatgggtcatttcctctggctgctttttgtctctatatctgttttttttttttaacaatttgattatgatgtgcctagatttagttttctttatatttatcctgcttcaagtttgctgatgtaaattgaatatgtaagatgatgttttccaccaagtttgggaaatgactggccttttatttcttcatgtatttttttctgactcattcttgaacttcagttgcacatatgttataccacttgttattgtcctatagatgactagacttttcccccttaattttttctctgtccaccagatggatctatttctgttgttccatcttcaagttcactagtcattctgccatctccattttgctactaagaccagtcagtggatttttcatttcagataatttcatttttaagttctggaatacccatttgattcttttttatagtttttatttctctgctcagattccccacccattcactcattaaaattgttgcctttgagttattaaacatatttataatagctgcttttaaatcctcccctgctaattccaacctctgggtcatctcagggtgaacttctgatgactttttttctctttgatgtggtctccattttcctgtttcttctcatgtgtagtggttttttattttataattgacattgtggatgatatgttgtagaaacactggattatgttatctttctctaaagagtattcatctttgttatattgggcagttaaattaccagatgatgatgctgaacttctgtaggctctttttgtactttgctaggatgagtatggtttttttttttcgtttgtttgtttgtttgtttgtgacagcgtttctctcttgttgctcaggctggagtgcagtggtgtgatctcagcccactgcaacctctgcctcctgggttcaagcaattctcctacctcagcctgccgagtagctgggattacaggcgcacgccaccacgcctggctaattttttgtatttttaatagaaacgggtttcaccatgttagctaggctggtcttgaactcctgacctcaggtgatctgcccacctcagcctcccaaagtgctgggattacaggcgtgagccaccacgcccggccatgagtttgtttttatgagtcccttattcttgatacatagtctatattcctatgtgtggtctttctgaagtt

SEQ ID NO: 569 - DNA, 1206 bp, Homo sapiens
aatcctctttcttgctggttttaaacttctgtagagtaggaaattataaaattcggtagaaataacctgtctaataaggatggaataggctggacatggtggcttatgcctgtaatcccaaaattttgggaggccaacacaggaggattgctcaaggccaagagttcaagaccagcctggtcaatgtagtgagacccctacctctgcaaaaaattttaaaaaataaattagcagggcatgatggcacaaccctgtagcctaaactactcaagaggctgaggtaggaggattgcatgagcccaggagtccgaggttacagtgagctatgattgtgccactacattccagcttgggtgacagagtgagaccctgtctctaaaacaacaacaaaataaaccctaatttaaggacgttcattcaggataaagtgcttgggcttaattgcatgaacactgatacccattttggattttcttatgtctttttggtttacttttgcattctgaactgtcttctatattttcatgttgcctgaatacaactgattgctggctcaaaagagcttttccaaacaggcttgcagatatttttcctcctactctgcagatcatgactcatgagttaaaagttgttacacaaaagggcttaaagagcatctggaatcttagaagttgtcattcagctcttcttaccatagaggacagagctaaagaccatggaagactctaatctgtgtccgataatttgtctattttaatggttcaaagttatctttcaggttaattttgacatctttgtgtatagatgccaaattttgatttaaaagataaaatcaagaaaaaaaatcacattgcaggaaaagcaacatctgatacaacccagaatgtgaaatagtgacaaggcagttgctgcagtcatagttcatcagcctcctgcttgactggacaaagattagtggcacctcagctggttgactttgaaccccaccgcataatatagggggtcaaggattgcagcctgctgagagtaatttttgagtggagtatggtgaggtggaattgaagagtcaaaaacattgggattttagggttggtcattggtattcttcctgattacatgtttgggatttctagattctgtcccctctgggacgaattaatgaagcagtgaatgacctcactaaagctatccaactgcagccctcag

SEQ ID NO: 570 - DNA, 1180 bp, Homo sapiens
ctttagtgtatattttgagtagcgttttgactatattttgaatggaagaagtaggaaaaagactgtcattgcgttatagtggtttgtattatccacagttaagcattatgttaatacatttgagtccctgtttttgttcttattaggtaattggcagtaaattcagcactcccaggaattgagatttgtgatgctatttgggtatttctcataacattcacagtaaaaaatcacattgccatgttatgtggacattatttaggcttattactagcttttgtgatagctaggagacatcacaaagattatttgggatttgaaaatgaatgatggccttagaaaaagatcagtatctcttgtaggcagatattttatagatgactttaacaatttaaatctagatggaactggaaggctgattagcaagtgtggagtggtgaaagtagaagaattcagtgacaccttattaacttctaggttttctttaactgcttccagtgcttggagctgcctttggagatttaccaaagcatttagttattgattctagttagaactactttattctttcctttaatatttttgtattttgtttcatagctattgcttatgtcttgattggcagtggtctgtatgatgaagcaatacggcatttttcaacaatgcttcaggtaaattttcttcttatttatgtaattttgagtttatggtcatgacaaaaatatggactaatgaacagctgaagtgctgtaatacgacatgtttttaaattatacaagaaagtgaaagaaattggtatggactgagcactttcttgctgccaggccttgtgacatgctttcatttaatcttttaaatgaaagattttaaagaaaacttcattttaaatgagaaaagggaatctaatcaggtcaagcaatttactcatagtctcccgaccatcaaattgcagagatgggattcaaatgcaagctttaaaaaaacattagcttcagttcactttcctctctaccacaatatctcccatgagatacagacactggaaattcttgaaattccagcttaatttcacacaggagttgatcttcatgattaacttaatttctactcataggtatgtttctcaccttaaagtataattatgagactcctcagtgaagtattgggtctttactgattg

SEQ ID NO: 571 - DNA, 1196 bp, Homo sapiens
ggtcctgtccgccgggctgcggccaggcgccctggccaccgagcactactcgccgctctccctgctcaagcaggagctgcagcaccggcagcagcaggaggccccggcgggcggcggcggctgcagcccgcagtccggggactggggggaccagtactctgccgagtgcggcggtgagtgggcggcggcgggcgtccgagtcggccggggcggcggggcagcggggctggggtcccgggccggggtacgggtcgcccgggcctcacgcctccggctgcggcgcgcgatccgcgggagccggctcggccaggggtcctggcgggcagcttcccgccgctgccacccacgccgccgcgcgccctcctgcagccgcctttgggcagggcggcgagtcgagaaatgagctgacagcatgctcctggggccagggcggcctctctcctgagtctgaagcaactgttggaagggtggcggaggagatggcaggtggcccggggcagccctgttcccgccgccggcctcccgaggatgccgaaggggcgagggaggggcgggcggacgagcaaccagcccggcggcttgcggagcccgcccccggagggagacgcctggcacatcttaggcctggaaatcaggcttcctgacctcccgggttaatgtctcgtatacaacagttcctaaaaattggatccctggaatggaaaaaaagagcaagcccatcttatctgctcgttgacatcttgcttccagttgtttaagatcaacctgcgatctgtcaggtgtctcccagagggaaaaaaggcccctgcaggccttgagcctgtgtgtcagtgccgtgtgtgtattggagctacgccagctcattcattaagaatgggcgctattggcttcagtttaataaatcatagcagatgcctctgggacaaaatacgtgtgtacatttttttgttttgaagttctgtcgtgggtctttttacccatcaatctcctccctttctctttcccccttctctatgtgagttcccttatggcttgctttgggaaggaccggggtctaccgaacccactgggagatggttgcttttaagacttggcagtggttttcttcggcattgtgtacctgggaaaacaataccttttttttttagttgagatgagacgtcaagattagcacaatctgatttccttttagtaca

SEQ ID NO: 572 - DNA, 1433 bp, Homo sapiens
ctgtccagagcatgaagggcacatattggtctgttgtcaggctcagcagcatggctgactaaagacattgacatcatgacattgtcatgttgctctgctgttgcccctggctctagctggcctacttgtaaagggagtggtgcatggagaagcacaaggtaacctcccagtgagcacctggcccacagaatcccttcttttctataattctattaggtatctcttatgtattttaatgtcaaagtataataatatcataggggtgtcttacatttatgaaatctttcttaataatgtttgagtttaggccaggcacagtggcttatgcctgtaatcccagtactttgggaggccgaggcaggaggactgcttgaggccaggaagtttgtgaccaacctagccaacatagcgagaccctgtctcataaaataaaataataaaatataaatgaaaaataagcatgtttaagtttagatctttatagaagatttcaagatctgcaaataaatattatcccctcttttttagacttcctgggaatgaaaatggttggtgagctgctacgaatgtcgggtgcctttttcatgcggcgtacctttggtggcaataaactctactgggctgtattctctgaatatgtaaaaactatgttacgggtaaatgcaaataattcccaactactcttaagccatattttcttcactgatgtttgctcatttaaactcttaacttctgaatagaacacttagctattttgctttccctcaagaactgcttataacctcagcaattggtttaatctgtgtgactctcttgtttaattttcactgtaagctgtgtttgttcaggaagcttgggagggagcttgggaaaaggaatcaaaagaagcatttatcattttgagagtaggcaatgggttttgtgttttgtttgttttctctttaaagaatggttatgctcctgttgaatttttcctcgaagggacaagaagccgctctgccaagacattgactcctaaatttggtaggtcactacagattaaaaggaaaaatacaaacccaaagacatcagctgctacataaaacttgacgctttatttaacaagatattcttttcaagtgtaaatgtataactgttgatatttacgggattagtgtataatgtatgcttttagtattttccgtttatgtgctcatgtttgctctgctcttcaatatgttgatgaagcatttctccctgtgttttgcaggtcttctgaatattgtgatggagccattttttaaaagagaagtttttgatacctaccttgtcccaattagtatcagttatgataagatcttggaagaaactctttatgtgtatgagcttctaggggttcctaaaccaaaagagtctacaactgtacgtgagcttgattttagcttaattgagag

SEQ ID NO: 573 - DNA, 1238 bp, Homo sapiens
cagaagtgtagtggcaggtgggggagacttgtgagtagcaggactctgtcataaaaaatgttagagaacttaaatatcctcttaagttctgagttttctttgcataatcagaaatgtattctcttgctatttttacaacaaacctttaaaaagtttcttaaactaacaataataattaagaaatgctttttccctgtatcacctttcagattaagacatcaaataatattgaaaattgtggctatagaatatagtttgttgttgttgttgttgttgttgtttttgagatggaatcttgctctgttgcccaggctggagtgcagtggcacaatctcggctcattacaagccccacctcccgggttcacgccattctcctgcctcagcctccaaagtagctgggactacaggcacccgccaccatgcccagctaattttttgtgtttttagtagagacggggtttcaccatgttagccaggatggtctcgatctcctgacctcgtgacccgctggccttggcctcccaaagtgctgggattacaggtgtgagccaccggcgcccggccagaaagtagttgttttaaaacacttggaaaagtatagtactgtagacatgtaacaaaattgcacttgtgccctttacatttatataaacatttttaaaagtatttaagttacattttgatctttaccaaaatttactcttcaattcaagggttgtttctgtcttgtacaaaattgtattgcatagctctcttttttttttcttaaactaccaaagcagaaaggagttatctagtcttagatccattttgaactatgaaaagataaacggtattttgacacttacctacattagttaaaagtgattttgcctattaaaactttaagaaagatccaaattattattattattattattatttttttttttttgcgacgagtctcgctctgccgcctaggccgcagtgcagtggcatgatcttggctcactgcaagctctgcttcccgggttcacgccattctcctgcctcagcctcctgtgtagctgggactacaggcgcccgccaccacgcccggctaagtttttttatttttagtagaaatgtggtttcaccatgttagccaggatggtctggatctcctgacctcgtgatccacccgcctgggcctcccaaagtgctgggattacaggcgtgagccatcgtgaacggcccaaatgattcttaattttatgt

SEQ ID NO: 574 - DNA, 1238 bp, Homo sapiens; identical to SEQ ID NO: 573

SEQ ID NO: 575 - DNA, 1166 bp, Homo sapiens
cctgttaaattgttaaatatgtgtaatatgtgaaaaactcctggcaaatatacctactaatatccatttccatatagttcttttatataaaaggtagagcagtatatgtaaaccttctaataaaacacttagctataactatgaattctcatgtgctcttcctgctgtcagcctctcctcctgctgttaaatctttgcaaggcctcctctagttgttatgttctgaaaagattcaagtttgtatcctagacttcaaagttatgtctctcctatgtggtgtgtagtgtatcaccctgtacttggaggtatgtgatacaagaaactaaggaactaaaataattctttttttttttttttttgagatggagtctcactctgtcgcccagtctggagtgcagtggtacgatcttgctcactgcaacctctgcctcccgagttcaagcaattctcctgcctcagcctccggagtagctgggattacaggtgcccgccaccatgcctggctaattttgtattcttagtagagatggggttttaccatgttgaccagactggtctaaaactcctgacctcaagtgatccaccttcctcagcctcccaaagtgctgggattacagacatgagccactgtgcctggcccctacaataattctttaatgtgaggaaatatcaaatgaaaaataagaaattctaggtaaggaaagaaatttatttagtggaagtataaaagaagtttaaaaagttgaagaaaattttggttttcaatgttgatgcagcgtcctttgtgaatctttaaatttgtgaatgacacttttgaaaacttacaccttattctaagtgtctttgttcactttacactgtactgtaaagaatcacaagagtgtctcataaataactttctatataacatatgtatatttcaaaataacatgttatatatataatacatacaatttttgtcaattaaacagtacattaaaaagacaaaaataactttccataaatgagctcaagttatttcatccacagtgatagaatgttccccatttgatgcaagcagttaaacttaatttccattaagacaaacacacaaataacaatcctccttcccaaacttgaaatcccacttctctttttgaactctcttcatgaagtagtcccttttc

SEQ ID NO: 576 - DNA, 1239 bp, Homo sapiens
agagcacatttggtgacatatttagtgattttgtgcctatggttgtgcgtttttgtgttttgatgactgtttctacaatagtgtctattattgaagctgatgaagaacagcttcccgaagcataggaaacagcagatggctagcttgctggttcatctgcagggaacctgaagttgtagggccctagactcttgctccatggagccctcctggatgaatcatttgcagaaatgaaaagggctgcatgtgttttgatttaaaatatgtatttattatattttagctttattttacaatcttgtttaaatgacttttgctgtaaaatgatactacagtgtatgtacttatacctttatttagggtcctgtgaagagccaaaactttcccctgatggattagaacacagaaaaccaaaacaaataaaattgcctagtcaggcctacattgatctacctcttgggaaagatgctcagagagagaatcctgcagaagctgaaagctgggaggaggcagcctctgcgaatgctgccacagtctccattgagatgactcctacgaatagtctgagtagatccccccagagaaagaaaacggagtcagctctgtatgggtgcaccgtccttctggcatcggtggctctgggactggacctcagagagcttcataaagcacaggctgctgaagaaccgttgcccaaggaagagaagaagaaacgagagggaatcttccagcgggcttccaagtcccgcagaagcgccagtcctcccacaagcctgccatccacctgtggggaggccagcagcccaccctccctgccactgtcaagtgccctgggcatcctctccacaccttctttctccacaaagtgcctgctgcagatggacagtgaagatccactggtggacagtgcacctgtcacttgtgactctgagatgctcactccggatttttgtcccactgccccaggaagtggtcgtgagccagccctcatgccaagacttgacactgattgtagtgtatcaagaaacttgccgtcttccttcctacagcagacatgtgggaatgtaccttactgtgcttcttcaaaacatagaccgtcacatcacagacggaccatgtctgatggaaatccgaccccaagtaggttgcattaattaggtaaaagcataaaacactgctgtagagattagtatgtgaaacagtatggatttatgattttatcttttcctggtgatgaca

SEQ ID NO: 577 - DNA, 1214 bp, Homo sapiens
tgtgtagtgggtcgcccaggaccacatcccacccaattcctcgctgccaaggagagaactaaatcccatgtgccttcattactggatgctgacgtggaaggtcagagcagggactacactgtgccactgtgcagaatgaggagcaaaaccagccggccatctatatatgaactggagaaagaattcctgtcttaaactaagtgccttactgttgtttaagcatttttttaaggtgaacaaatgaacacaatgtatctacctttgaactgtttcatgctgctgtgttttcaaaagctgtggccatgttcctaaattagtaagatatatccagcttctcaaaaaatgtatatgattgctgttagccatgtctattgtttttcctctggattcttttcttataacttggaatacacaaaagtgtaaaacaagagatgtgcaccaatgaaaactatgctgggtcgaattaccttcagcacaatgttaatgtttttgttctcatttatgcctttgtccatttgcacacaacagaaattgtaatgagcttcactatttttgtttctttccttccttttttttcttttttcctttctttcctttttcttgtcttgtttcttgtttttttttcttgtagtttcttttcttaattgtcatttttgcaacaaaaagccaagaaagagctttagtttcttggcaagaataatgtgatattagtaagtaaaggtcttaaaagtctgacgactggaatagatataaagtcctgtttaaactacctaaccttggctgtgggccgataatgcatatgtccagttctcacttaaattatgcaatgatatttctctctgaggaaattatacggaatgtaacttataaaagctttactgaatataagttataagcattttattcattagaactccaaaatagatgttcaaagttcagtccttgccatttgactgagaccacatggtgtgccccttgagtgaggctaatctttaggtttttcctatagaaaacattcttcctccatcagtagccctttatttgatattcagaagtggaaagctttttcattctccagtagaacttttaaaaattgttacagatacctagctcttcacagatatcatgtactgtaaacagtcatgtgtcttaattttattttctctatttgagtgcataattatcctaataatcccaaagacactgacaactca

SEQ ID NO: 578 - DNA, 1249 bp, Homo sapiens
aggattgtattaacatggtaagttttgccctaaggaaaacgatcttgcattctggattcttgcagcaaagtctcagatacttaatacgttttcttgttttatcatctgttctatgattcggcttcactttgtgtggttattgaattatgtaacagagatttggttttcccaaaatgttatcacatttgaaactatgattgctttgtgttcagtccttttggaacacgtagcttccagcttaagggtagagaaatatatacctaaaatcatcaatacatgaaagaaaaaggatggaaactatgtcctcagttttacttctaccaaaacatccctgtatgtgtgtgcatgtatgttggcgtgtgtgtgtgtgcatgcatattagtaaatgtgtgtttgcatgtgtgtgttggggagtgtatgtgatctgggtgtttgtttatctctgttattattcccctttagctttattttagtcaactctacattatgatgaatttcaaaatgaagctgtattaaaataattgtaatataacaattcaatctcacatgttactgcagatagttaacttttgctgcaatctattgtacatttgcaattttctgtgttagtaaacttagcagaatctggttatttatttttgtgtaggcttaatgttcactgaaagataagtcaattactgttagtaaaaaattaaggtactctcactgcagagatttaaggcctgggcctaatgtgctgtattatgaagccttgtgactgaaaaatatgtttacatatgttgtctatttttttaataaacttttatagctggtctatttgctcagtagctttgatcctctcttgattattgtgactatagtttgcaatggtttattttgtattcaataagaaaaattgtgttaataaagattattgtttaataagccaggtattaacctgctaaatatattaaactgaaaatcactaaatgagtcattcaattaaatacatcaaaaaaggtagaatgaaatgttttatttcaaatttttttggtttacatatgcattgaaaagttatatttcatggtgagcgttttgcaagtccagcttttcagaagacacacttttgcagagtgaaatgagtatgagaaaaaaatctcagtgattaaggagacatgttgattttattgtttaattttatgtttaaatcagaggaatttcaaacaccacttaacatgtagaaattcttactaagtgataaaagcttgag

SEQ ID NO: 579 - DNA, 1220 bp, Homo sapiens
ttgattgaaaactaaatacattatgaattttatcaaataaatccttcataaaaccttcaggtatttgtaccccctttaatatccacttggttagtaggaagagttgtagaattcacaagctcaattagagacttcattttttgcttgtgttttttgaggttatatgaaacgttttaaatgtgacctgggagaagagtgaaatagagttttaacttaaccaggatgcatgattttaaaaatcgaagtaggcctgaatttcctgaaaattttaaaataatctagtagtgccagcatgaaccttagtcacttaggcaatagagaaggttttcatggaaatccattggtctgttttaaataaataccttgaatattaatagtataaaagagcattatctaagtaatactgaagcttattatcagctgaaactttcttgatcatgatggttagccatttacgctcacatctgttaacaatggtgattgctttcatcaggaaaacaacctttagatatgcaaatagctctttctgaggatccggcaagatggcagaagtagagcagaagaagaagcggaccttccgcaagttcacctaccgcggcgtggacctggaccagctgctggacatgtcctacgaacagctgatgcagctgtacagtgcgcgccagcggcggcggctgaaccggggcctgcggcggaagcggcactacctgctgaagcgcctgcgcaaggccaagaaggaggcgccgcccatggagaagccggaagtggtgaagacgcacctgagggacgtgatcatcctgcccgaggtggtgggcagcatggtgggcgtccacaacggcaagaccttcaaccaggtggaggtcaagcccgagatgattggccactacctgggcgagttctccatcacctacaagcccgtaaagcaatgccggtccggcatcggcgccacccactccttctgcttcatccctctcaagtagtggctcagctaataaaggcgcacatggttccaaaaaaaaaaaaaaaaagatatgcaaataagtgtggtagctaatattctgtctcctttccttcacacctcatagattttcaatccccagatgtattttcatctttagagaaatcaaaggtgtgtttcctaattatgttatacttttgcattaagtttaatgagttaaattataaaactttttccatttataccagtggggttagtaaat

SEQ ID NO: 580 - DNA, 1423 bp, Homo sapiens
taaaacataatttagcaatcacaagcatgaacagatagaccacaaaatttaccgagcatttaagcaagatcaacactatgaatgaagacattaaaccaaaaagtcagaggcactaccatctaaggaaaaggaataaattataaattaaaagaacataagagaactaaaataaggtgtaattaatgttttcaaaagatagcataaaacaagagcaagaacaaattgctttatcatatgggatctagccttcagctctgaatgggagatcctattactgacaaagtctgtctttccaaaatggggtctttctctgttcagttcagaagccaatacacaaaaacaaaagtgagcatcaagcagttcaggtttcgttcgatggccatagaattgagaagtgggagcttggctcacaaatcaatttcatagctcttgcaagtgagtatatcacaaatatagggcatctttaatgaaggggttaagcattaagagcaagaggaggaatattcatgtcttttctgggaatgggcagagaaccgctcaaaaccagagtgcgctttcctttttgtcctttcatggtttcctctggctgttgtcagggtgattgtcaactgtcatggcactggtgggagagtcgtttagcatggacattagactataatgaagttagaggttcttcagaggtcaagtgagctgccatcttggatccagtcttagtaagttagatcacaagggggaaattcagacctcaggcatcctgtttcctaaagataagcagggttaagacaggatagaaattcacctaggtcatgtaggcattacaatgtgtaacaatcctaaatatcaactctcatgactggcctaggaccttgaaacaacaggaactatgtccaaataccatgaaactttcatgtagtatcagtgttaatgtcagtatgtagattctttggcttgcagggaggacttgcgtggcagaagtgctttggtaacagaaaagaaaatttaacttgtgagctctttcttctcaggtagcacgaatgtaacagactcctgtatgacaaaatatattttcccaggaatggcaagcacccatttttgtccaattcatggttctggaggtacttacaaattagtgtgatgttcataatagttgctctcagaaattgcagaacagtttgcaattttttttttttaaaaggggtctcgctctcttgcccagggtggagtgcagtggcgtgatctcggctcactgcaacctccgcctcccaggttcaagagattctcccacttcagcctcctgatttgctgggacaacagacatgcacgaccatgcccagctaatttttgtattcttttggtagagacagggcttcaccatgttggtcaggctggtctcgaactcctgacctcaagtgacctgcccgcc

SEQ ID NO: 581 - DNA, 2512 bp, Homo sapiens
cctttcctctcttcagctcaatcagacgctgcagaagccccacgcagaggagcagagcagttatgctcaccccttggagtgcagcaggtacagggaaggttaaggcttaaaaatccatttctgttgttgtcaccgtgagttcatgattgcccaacattgcttataaagttatagaattttggggctgaagctccattcaggatgaaagtgtggtataacattattcatctctgttactggagacttgctgacttttctgcatctagttttcactgaatcatttcagatgagcaaaagtacctactttcagagaagttagaaaattaaggtttatgtggtttccttagtttttggtagataggctgtttgataatgaccatttatatctgtacactgcccccccccccccacctttagaaaggatagtgtgctacgtgcaaaagacgtggaggcaaattggggaagtatggcctagtaactttattttttatttcagtgttttggaagaatcgtcatcttcccaaggatggggaaaaatagttgcacaatatattcatgatcaatgggtgtgcctctctttcctgttgaaaaaatatcacacccttataccaaccacagggagtgaaattctggaaccgtttctacctgccgttcagatgccaataaggactttgcagtctgcactagaagccctcacagttctttcttctgatcaagttttaccagtgttccattgcttgaaagtgttggttcccaaggtaagatagagtgaaacatgaattgaacagtaactataggagtggcgatcaagtttttgaaataagtatgtatttttttttttcctaccagcttctgacttcctctgaatcactctgcatagagtcttttgacatggcgtggaaaattatatcttctttaagcaacactcagctgatattctgggctaatttaaaagcttttgttcagtttgtttttgataacaaagttcttaccattgctgccaaaatcaagggccaggcatatttcaaaataaaagaggtaactaactttcttttctttttgcttttcttttcatgtgtgtgagcttcagcacatgaggaacatgagagttgtattcacaattagatttttggctctttattccttcagtcaaaaatatttttgaaccttcttaaatatcaagagtaagaatgagaaaatctgacagatgtagaagagaaggtacaaaacggtagcctggagccacatctgcctcagaaacggtttgtttggttcatacagtgtttaaaattttgattacctggcaacttttaattgttgggaaatctggccaggcggggtggctcatgcctgtgatcccaccactttgagaggctgaggcgggcggatcacgtgaggtcaggagctcgagacaagcctggccaacgtggcaaaaccccgtctttactaaaaatacaaaaattagccaggtgtggtggcgcacgcctgtaatcccagctactcaggaggctgaggcaggagaattgcttgaacccaggaggcggtggttgcagtgagctgacatcacgccactgcactccagcctgggcaacagagcaagactccatctcaaaaaaaaaaaaagttgggaaatctgtatgaaaaactggatttcttggaaatgaggtaatctagcaacactggtcattcttccatgacaatgtaattgatcgctcggttgagtaggagttggcatgctctttccacaatcagtctcatttcacccggatacttgaaggcaaatgtcaggcgccatttgtcattgcactttggctgaggtttttttttgtgtgtgtagagaaatatttttctgactgtaacccttatcaaaaggtcttgctggtttctggaggtattttcatttgcagctactgagataggaacataccaaggtggagttccagtgtacctcctgatccccaggggaacagggagagtcagattccgttatttctctgcagccctgtgctgcctttcttggtccttttctgccccacagtacatagttagagacgctggtctttgctgcctcagccaaaggaaggccactggcaaaatgcaaacaaaggaagctgaatgtgtgtggggtgaggtgtttttcccctttgattctactgctttggcagttgtttctcttgaagagtcctggatgaatatcactatcagtaaaattttatttatttttattatcaagagatgaaatagcattctctgattattgatcatctcgcaaagttattctaacagtaatgaatttaacagtttttagactgttcatgattatgttgaaactaagtaacagtttttagcagcactgattttttaaaaactaaatcaaggataaaatgacggttgtattttattccagattatgtacaagataattgaaatgtctgctataaagactggagtcttcaatacactgataagttactgctgtcagtcttggatagtgtctgcttcaaatgtgtcc

SEQ ID NO: 582 - DNA, 1183 bp, Homo sapiens
ctcggacagtgtttctcttttaaattaatatgcagtattttaatatgcacgtatgatagaaaataaacttgtgaggagggtaggaactttgattataacttaaatttcaaattctacattctctcaaagataaaacttcttgttttagcatgtgaagctggaagaagttttagttgaaggttgtaagttgttttatgtaatgcgttattttttatagagatctttacctcattaaagtgtacattttatataaggtacattagaaattcttgcctgttaatgaagtttatacattctttgaaggagattagaaaacacacacacacacatatgtgtatatatatatatatctcacatatatatatcacacatacatatacgcatacataaatatatatacacatagtttttttgtttttactgtctgtggaactcaagtatgatagtaaatggtttattactttgtattcgattatttaaatttggtttatcgtgaaagaaagaaacgtggcttaaggagattagaaatcctttgtttggttaggtttttaaaataaagtaataactgttttcttttccagctgtgtgactggctacgtgttaatgaaagctattttaagccatcccctacgtgtagctccattggacttcacaagacatctttaaatgcttatgtaaagagcattgttcaagagtatgttaagtcatctgcttgggaaagtaagtctgcaatcatttttatggattgatataaccaaaatattttcaaagaacttttaactagtttttcagactgagagttaggctttacgaaatatatgatgatttattgatgccaaacttgtatttcagtaaaataatgtgaaaaaaaagtaaagatactgtctcctaacttgtattaatactttatctgttctgagacttgagattctaaattattttatgtttaaggaaactaataagttgccagagttaagaagtggatgcaaagtcatttatttattctgcaattactgggtccttgtgaactagatactgcagatatggttttggagcctctgtagtggaaatatatgcattggaaatacgtgtttatctttttcatttttaaagcacgtttagtatgaactgattatgaaaaacaattttaaacaaaggctgtgtttaaaaggatagttttgtt

SEQ ID NO: 583 - DNA, 1225 bp, Homo sapiens
ctgaggtcaggagttcaagaccagcctggccaacatagtgaaactccgtctctactaaaaatacaaaaattagccaggcatggtggtgtgtgcctgtagtcccagctactcgagaggctgaggcaagagaatcactcgaatccaggaggcggaggttgcagtgagccaagatcacactgctgcactccaggctggtgacagagcaagactccgtctcaaaaaaaaaaaaaagaacacaatttaaaatagccacagaattttctacaattaagagataaggttaattttttaaaccgttgatgatggagaatttcaaacatttatagaatgagaagagtgtgtgtgacgcacctaccaccctctttaataacgatcgtctcacggccagccttgcttagtgtatcctatgtagccttccctgttcccttcttgctaaatggttttgaagcacatccctagatatcctatcattttatctgtgaatatttcagcacatttctttaaaagataaggactcgtcgatagggtttcaatgatgacatagtctgtggttttaataattgctctttttttttgtttttgagatgtggagtcttgcaatctgttgcccaggctggagtgcagtgggatgatctcggctcactgcaacctctgcttcccgggttcaggcaatttttttgcctcggcctcccaagcagctgagattacaggcatgcgccaccacacctggctaatttttgtatttttagtagagacggggttttgccacgttggccaggctggtctcaaactcctaacctcaggtgatccacctgcctcagcctcccaaagtgctgggattacaggtgtgagccaccgtgcctggccaataatcactctttggtatgaatatatctttttaactggtttccattcttattctcttagtatatcttttccagtgtttcttaagttttcagttattgttctgtatcttgtacttcttaggaagagaaaattccgggatataatttcaaatgtgtttataagcccttgatcactatattatgagagctttttaggagatacacaatgaagctggagcttcctaaatgtattttataaaattaagtttaatgaaatagctaaatgcagcccaatagtgttttggcctgtgttcatatgaatgataaaatgccacattattgtgtttacacatgagaattaacctaggtaaatggttttt

SEQ ID NO: 584 - DNA, 1170 bp, Homo sapiens
tgttccctggtgcaagagatgaggcaggggcttttcatttcttccactgcagccttgtatttaggccccatgtgtctgagcgtcagcattcctgctctttcgctgtctgtgctccctctccagtggcaataatcgttgcctccaacttaggggtgcgtttaggttcctggccctaacctgtggcagctgcattctgcgtgagtgtctgtggtaggtcttgggtgtagcgtcctgccctcctccagcacctgcagaccagctttgtatcagtgcaggatatctggcagtagggggtttgcttccccttccacagaataagatgcattcgcctagtgtcagtgccgagtgaagggagcaggttctatccctgccctagaggcaggcaacttttgcttgtatcaaggcagggacaagggtgagagtgtgggaggggcagacagctttggcttcctgtcggagaagggtccagggggacaggcacgttttggcagttgatcaccatcttgtactcctgcagggcatggctgggcctctctagttagtcctgctgccctgggtgcctgcgcctctgaagatctcctgccctggccacagtctctctcgagagcaccggggcaggcttgaagaaaagagctggtgaatggatgtggactccctcagcaagctgtgaggctagcccaccttggtctttaaaaacttgtcaaaatgccatttttaaaactgctttttgggtgaccatgtcttgctcctgtgccagaagtagaacagataagtggcctttccattcttggagcgccttccttccttttagaattcaggttgcattgtgacctcagttctgatgctccccccacccaccgcacaacagtttaggattttgtagatttttcagcctttcctctttgtatgacaataacgatctcctatggttttctatgtcctaatgagcaactgaaacgatacatatctaaatgcctttattttgtcctcatatttcattgatggtttgactgagggtagaattcgagcctggaagatatttccattcaaaattttaaaggtatctatctattgtcccagaagctagagcttccagtattgctgttgagaaatctgaaaccattctgaatcctgtttatttatacaggaactgtttctctctatggaagt

SEQ ID NO: 585 - DNA, 1176 bp, Homo sapiens
ccgggcgtccgcagctggcggccgcgctggctgaggaggcgctgcgcgatctgctcgccgggtggcgcgcgcctggcgccgaggctgccgtggaagtgctagcagccgtcgggccatgtttgcggccccgcgaggacgggccgctactggagcgcgtggcggggaccgccgtcgccctggcgctgggcgggggcggggacggggatgaggccgggcctgccgaggacgcggcggcgctggtggccgggcgactgctgccagtgctggtccaatgtggcggggcggcgctgcgggccgtgtggggcgggctggccgcgcctggggcgtccctggggtccggccgcgtagaggagaagctgctggtcctgagcgccctggccgagaagctgttgcccgagcccggcggcgaccgcgcccgcggcgcgcgcgaggcgggcccggacgcccggcgctgctggcgcttctggaggacggtgcaggcggggctgggccaggcggacgccctgacgcgcaagcgagcgcgctacctgctgcagagggcggtggaggtgtcggcggagctgggggccgactgcacctgcgggccccaggaaggaaacggtacctgcctctttgccccccagcctagtgctacctacttggctgccccagaggggagtcttcctgcttctaaaaactagcttatcggggtcgtcactccgatccatgcagaatttggttattccgcgttgctcccctaaagcctgaaaacctttggaaccccttctcgagggtgttctttgaagtcacaaatcactgcggttgggaacgttctaacccagagccggtggaatacagcacccctggaatagtttaggaagataatggagcccgtgcaagattttacagacccaaatctgcactatatcatggtagattcaacccaatagaaacggttgatatctatcaagttgaaagaaaaattatttgttatttatctgtactgaccagtgaattagtgaattgagtgttgagtgttagaattaagcgtcatagaggccatcacactcttctgaaatttcccctggtaattaggaacaggatttactaatatttgttaaacatgtttcttaagtcgaccttttgagtgtatttttgccattgatttaatagaatgaatcagattttattttttaa

SEQ ID NO: 586 - DNA, 2075 bp, Homo sapiens
aatggccagtcccccatggcagccctgatcttagtagcagacaatgcagggggcagtcatgcctcaaaagatgccaaccaggttcactccactaccaggaggaatagcaacagtccgccctctccgtcctctatgaaccaaagaaggctgggccccagagaggtggggggccagggagcaggcaacacaggaggactggagccagtgcaccctgccagcctcccggactcctctctggcaaccagtgccccgctgtgctgcaccctctgccacgagcggctggaggacacccattttgtgcagtgcccgtccgtcccttcgcacaagttctgcttcccttgctccagacaaagcatcaaacagcagggagctagtggagaggtctattgtcccagtggggaaaaatgccctcttgtgggctccaatgtcccctgggcctttatgcaaggggaaattgcaaccatccttgctggagatgtgaaagtgaaaaaagagagagactcgtgacttttccggtttcagaaaaacccaatgattacccttaattaaaactgcttgaattgtatatatatctccatatatatatatatccaagacaagggaaatgtagacttcataaacatggctgtataattttgattttttttgaatacattgtgtttctatattttttttgacgacaaaaggtatgtacttataaagacatttttttcttttgttaacgttattagcatatctttgtgctttattatcctggtgacagttaccgttctatgtaggctgtgacttgcgctgcttttttagagcacttggcaaatcagaaatgcttctagctgtatttgtatgcacttattttaaaaagaaaaaaaaagccaaatacattttctgacattgtaagattgccttactgtctgtcattccttattgctggcccctttctcaggccggaggccaagtggtggagaaggaaaggaaatgatcgaacgggcatgttgtcaagtgggcatgccactgggaaataccaccagtttaccctgaaacattgtcctcagaggagtaggaaagtggattttgaatctctattttgctcaaaagttcagttcctgagatactgatgactgagagtgctgctgggaaattttcaggattgtgtggtcttttggggttttttgtttttttttttttaagacaaagttgaccgctgttcactgtccacgtgatcagttgtaagattacaatgctgcatgctagttggttacataagatacaattccagtgatggaaggcggttataatggatggtggtgtgtacaagatggcactgccatctttgagcagagcccagctctgcagcgccacttcatctttttaaacaccctagaggtctgtttgttgttgctgttgtcctttattttgaaagagttgcaagagaagttacagtccaggtgaacttggagattgtgggattggttttgtttctgttttgttttgtttatcatttacctgtagtgctattgctgttgatactatcacctataccctgtttctagtgagtgctgaatacagtatggtacaatgacagtaacagccgcgtggtgctgccaggactgcccttgggcatatcagtgacagcccaaatgtgggtggaggaaacctgtaatttccttcttaacatgtgtttgaaataccaagtgaataatactgttctggaaaaaaatgataaactagtggaaattaaagaaattaagggttttatataatagacaggccccacctctcaaaatatttttagaagtctttttgtaaactaatttcttttgatcactattttgcatcagtaaaatgatttttttaaaaccaataaatcatcaattattagaaatagttgtctcacagtgatactggtttttcttttgtgctgttatgatttaacattgacaggaacactattttaaatccttacgttcaggtgtttgtaacttggccttataattaggctgaattatggcttcaaggtctacaatttatgtgtatggttcacagcctagcttctatttacatttgaaaatacagat

SEQ ID NO: 587 - DNA, 1099 bp, Homo sapiens
gacaaatgcaaagcaccagtgacggatttcatgctatgtgtccgacattgagctttcaagtataactcctaaaaaaccagaactgtgaaccacgctagacctaaattccccattctcaggagactgacggaaaccaagtgacaaagtgtccttgcataaaagaaaaaaaatgatttttagcacgatttggcccagaggcacaccagaggaaaacatcctgagggtggtcgggacagccgggtggggcgcgaagtgagggaaagtggaggaaaagcactcgatcactttgcgcggtgttccgaagggaacaccggcgctgcgctgctgcgctgccccgcgggcgggcgggcgccgcgtagccggctctcccggcagcgctccttcggcgcgcggggggagggggagcgcgcgcgcgggagggcgggcacgcgcacgaggggagggggcccgcgcaggcgccgtgcgagactgtcgaagaatcaagtctgtagaagtggagcggtcgcggcggcagcagcagcagcgacggtggcggcggcggagctgaggcgggctggccgctgacgctggcgctggagagcggcgacgccaggagctgtgagagagcggcggagcgacccggggcccgcgccgcgcccgagctccacgccgcccggccgccgccaccccggcgcggcatgccccgccgctcgggctgagcctgccccggcggccgccccccgccccctgcccccccggcctccccgccccccgccccgcactccgtgccggccgccgccgcgacctgctgcgctcccccgcgcccgcgcggcccgtcttcgccccggtctggaggcccgccgcggctccggccgagcccccaccgccgcgcccgccgccccgccgcgccgcgccgcccgcccgtgcccgggccggccggggggaactgctgccgcggctgcagcccctcacctcgcgcccgccgcccctcgtgcaccgggggcgctgcgcgggcgccgagccttcgcgggctttgccgccgccgccgccgcctttgcggccgccgccgccgctggtgggggagacgcggggttggggggggaggagggcgcgcgtggtg

SEQ ID NO: 588 - DNA, 1182 bp, Homo sapiens
aagtttggggagggtagaaacgccgtttccttgggaactggagtgcagtatgagctgggtgtcacttggctctgaacatactggctttgctgtaatgcttgaaaaggcgttggtatcttcattttacagttcattaacccaagtacgttttcttatttaaatgacaactttggtgctttaaaatgaggtaccactttttaaagctagctgtgtcgagttaaagaaaaaatcagcagttttttctcccagaaatgtaattgccaaacactattcatccccatcttaagttttacaaggtgatgtaatcagcttgttgtagtgatgctggccaaatggtgctcagcaggtgagaacaaaaaaaccccagatctcagtgaactaatacacagcttgagcgtttccatgtgctaatgttgcacacttactaaaaaactttggaaatggaaaataatgtattagtgcaacagttgatgtgcttctttgggcaaagatatagttttgttccacaatttgtacttaaaagcgaaagaacattgaaaacatagacttactggctgtagcaatgctggcctgttaactgataactagaacttaggttcacgtttatgtaaagtgtgtaaaacctagtagagcttgcatagtcggcactcagtaaatgtttggttccttttgccccttggtaagtttattttaccatcctcccacctgccattctgactttattaaatcaacatgtggaccagagtgttaatgagatgttattgcagaagagattgagaaaattggtatatcatgcagataacatacaaaatctttttgtaacgtaaaaaatgcagttttattattgcttgtgcctcaactgtttaagtgaatattaaagggcttggagaaaactttggcttggcgtatgtttggagaagtgaactctgctgaatttattgagtctaaagctgtgggttttttgttgttaacgtctttgaggatgtctagggccgcaggcttccctgccagaagaatgcacatttgcttcagattccaggtgaagaaaatccctgtggtagtgtcagcgcctgagggcttccaggtggtggtgggcccagcgtcaggagatagcagtcacctgggaggcccgttacaacaggttcgtgagaggagcccagtggtggtggtgctgacgtgcga

SEQ ID NO: 589 - DNA, 1615 bp, Homo sapiens
ctaagattcaattctttgaatacaaagagcattttattttgaagttagaatcctaattaaatgcttatgacactttaaaaaattattttttttttctttcagagaattgtaagtgctcagagcttggctgaagatgatgtggaatgagaaacaaatgtcaacataataaaatctcagttaaaaatattttaaaaattcttggtagttgagcagctctgggggaataagggcaaatatgcttgttatgaactacactgaaatctaccaaagttaatgtttactttgtgtagatccatttgtctattttatttatttttcccagtgaaaagtgtattttgatagagaacttttcattctataaatacactatgagttactaaaatatcatggattttgtttattcctgaaacatagttacatagttaaactgtacatatgacatggcttatgttaaaaatacccagtgctcagttttgaaagataggcaaaaaaaaaaaagtataggagaaactgaagaatgtacacttttttagagggcacattttgctgtaaatctggaaatttgatagacttgactgtgtttgtgaaaactgagcattaaaggttttgattgatcctttctttccatttaatctctgagacgtaaatatgtgaggtgtgctgctgtgctgggttaacagcttccttccctttctgtgtagcagtcttgaaatgttctgtttaaatcagtaggcttaatgtgttctgggtatttatctccttgtattttaaatatatgtagttgcaaatagcaccaggaattagatttctgtacacccctaatctagccttgtgagcttcgctagttaatgtgtgctcactttccctccatttgttacgtgagagaatgcgtctgctgatcactgaagtgtcccttttagcttctgattcattgggttctgttgggcatctttaaatccaccttaacctgaggaatgtatgtgggcaaccaggccctgcatttttttatattctgaattttgcatgcttgcctgacttagtatttctgaattgatgttttttttaatggtataactatcttgattttcactgaaattatatggttctgtcactactctgtaaattaatccgaaacttttaaggtaactgggatgatctgcttgtaaaaatgcttgttgccttttgctttatcttcagtgtacctccttaatcctgcttcaacttgattatcttgtgaaacgatgagagtaagttgcaaccttgtgactgaaaacttgaaaagagtggagcaggtgggacctcttattctcaaatagtgacatattctccgtagtcacagtttcagaactgagtaaggatccttggtacttggtggcatctgttgaactgaggagcatttctcattgtaaagattgcctttgttctgtctaaaagtctggagaaatcccaaagacttttcctatgtactaggcattttattttgattgacttacaaactcttcttaatcattatcaatctcggtttttttgtggtgcagtggaaggagaaataggtctagtttctgcctctgattagccgcacagccttgaacaaatcacatttcatctttgaact

SEQ ID NO: 590 - DNA, 1123 bp, Homo sapiens
atttttcccgttttgttttccccagacactttagccgtgcaaatgcactcttgatttctgttgcaatctcgggtgtgtgtggcctggggaggaggttgtctctttttttgtcgttcatctttttaaacctctactcttaactaaaaagtcgtgcatttttgtcgcaaattttagtctgaggctaaatccgcatgctcagtgcagtatcattgttgcattcttttttttgagacggaatctcgctctgtcgcccaggctgtagtgcagtggcgcgatctcggctcactgcaacctccgcctcccgagttcaagcgcttctcctgcctcagtctccccagtagctgggattacagtcgggcgtcaccacgcccggtgattttttgtgtttagtagagacggggtttcaccgtgttggtcaggctagtctcgaactcctgacctcagatgatccgcctggctcattgctgcattcttaaaccctcttggtagcttcgttctaagtgcttccaagatatgagtgaatgctatagaaattgcaggggagtccaaagggctgcgcttctcccgtggctcagtcttatttcatacctgcgacatcttttaagagaggtctaccagaggggaatcgtgtcatgaaaaccgttgtgatccaccttgaattttcggagaatcttcattcgcatcattgaagagcaaatttgttgcaataagaaatattttttggcttatcttggttgttcagccaaattagtttttggaattaaaattgatacgtaagttactaaagcccaaggggtacaaagaagggattattgtttacttaagtaacagtggttacggtttaattcagctatactaagtcatttcaagtgttcagtagccctgtgtgagcagtgactgcagcgctgatcttactagcactaagaatcagacatctagttccagctttcttatgttttaggagggaagggatatagacataatttgatttatgactaggcagactaatagaatactgttttacattcagaccttgaatttctagggccaggttagcggcataatttggggtttctgaatcctaatttctgtagttgtaaaatcaggtaatgccacctacctc

SEQ ID NO: 591 - DNA, 1180 bp, Homo sapiens
agtagaatgaaacgctatatgtaaatacaattctgctaaacaaatatttaactgtggataggcacagtgactttataatgcagatagtcattttcatatatatggatatatataaatatacattatattcatatatatggatatatataaatatacattgtattcatatatatggatatatataaatatacgttatattcatatatatggatatatataaatatacgttatattcatatatatggatatatataatgtaatacggtaattgatttttagactaaatatataagttgaaacataacattttctaatttttggaaaattagtggtgttaattctggagactagtaaaaataaatgattagagacgaatacacttcatggtaacaaacatgctggtgatacagctttaaaactttatggaaatttacaacatacaaaaataaagttcactgatgttttacatattcatggcctagcatcaccagttgccaatattttgccatcttggtattatctgtttcactctgctgcccctcttctctcctttctccctcaccatgtagcattttaaagcaaattccagatatcatttcacccatatgtatttcggtatgtatctctgacacacttgaactttcctttcatagtacaactgtcataccattgtcacaatgaataacattaacattaattccttaatggcatctggtagcaagaacatgttcagattagcctgtctctaaaatgtctttgcaatttgttcgtttacattaggacccaaataaagtcttcatattgcagttggaagatacggttctaaatggtctcttaaatctccacccttttcatgccctttatttgatgaagaaactgttatttaacctgtagaatttcccacattctgtttggctgattacatctttgtggtttggtttaacccctgtaatttcctgtaaactgaacattcgttctagagggtatttttttttggtgagcattgtttataagaggtgctgtattctttctattagttaccatcatgaggttggttcactttcagtattgctgggattggtcagtggttttagattatgttggcttgatctatcctttataaagttcttatcaactttcacacaaaggttttcgcagcatctgaggattgttgactaga

SEQ ID NO: 592 - DNA, 1226 bp, Homo sapiens
ctgggagtcagtcagctccaccagagcaggcgcctccaggcagacctgggggaggcgacccagggtacctggtgtagtcctgaaactggcctatgcgcaagtactcgcatgaattaaaagtgtaggccaggcacggtggctgacacctgtaatcccagcactttgggaggccgaggttggcagatcatgaggtcaggagatcgagaccatcctggctaacacggcgaaaccccgtctctactaaaaatacaaaaaaattagccaggcattgtggcatgcacctgtaatcccagctattccagaggctgaggcaggagaatcacttgaatctgggaggtggaggttgcagtgagctgagatcatgccactgcactctagcctgggcgacacagcgagactccatctcaaattaaaaaaaaaaagagtgtaaaactgaaattcttttttcttttctaataaacccctgagttctgtcaatgttaaaaagaagggtgaaaactagatcttgtccctctcaatttgattattttctgcatgtgctatggaggaaggacaaggtgcaaaacgcaaaggacatgttagaaaaaagctttgtaataggcttgtttttatgtcacatgaacatagattctccccgaggagaggcggagagctgagcttgactaccgaaaagcttttggaaatgagtggaaacaggctggtggacataaggatccggaaaaaaacagactcagcgaagaattcctcacagcccatcccagataccagttcctctgcctgagtacgtgcgtatacactggtggccttcaggtggtggatttccagctggaacaaagttttttcttgggtatcaaaagaggttctcagtgttgcttttgcccttcttcctttcctgggcttcttgtattcatctgaatggactataggcactttcctggggcgagggcggcagggcaagagcagtatctttcagcaggaggaacctgggagactgtttatgttcttgaaatggagaggtttgcatttggggaagggaaagcaattcttttatttttaagagatggagttggccgggcgcggtggctcaggcctgtaatcccagcattttgggaggctgaggcgggtggatcacgaggtcaggagatcgagaccatcctagctaacacggtgaaaccccgtccctactaaaaatacaaaaaaaaaaatgagccgggcgtggtggcggg

SEQ ID NO: 593 - DNA, 1523 bp, Homo sapiens
gtggggtcctaattaggaacaaggagccaggctggtgggagcaagggaaagcagaaagaaaatacagataagctataaatctgcgtttcttcatagtctaggacacatagcccatctgcgcaaatgactcacgatcttcctgcacccagatatcaccagaccctcggttgatagaaaaatgcaagttagttcacagccaccttgacattatcaatactgcacttagccctctccagcacacagaacaagctccatcctataaaatccccaggaagcctttgtctcctccagtcagctcctctcttgctaactggcctattgctttcttgcaacatatttccatgcttttgctaataaatctgcatttctgtacctatgactgtcttggcaaattctttttactgcccgtgccactggccccagacagtaaccactcgtgacacaagggcattgactgggaagctttacagagagtgagtcttcctggtgcaggggtggagggtaattttgagactagctgatccctcaccctccctggaggagtggggactagttagtgaccagtggaactaactgtgccatcctgtaggaccccaatctgagctctctctgatttcgaatcctcccatttcccaccatgaacctttcctaggaccagagctttatttttctgcttctcacatttggattctcgtctttttatccttccctatttgcttataaagactgtccatgagctgggccatgtgtacatttttcttgctttttatggccttatcctggttggacttctcccatccagctgcttcttcacccaccaccaggtgactcctggttgagaggagaaataggctgagcacagtggcttatgcctataatcccagcactttgggaggctgaggtgggaggattgcaagaggccaagggtttgaggccagcctgggcaacaaagtgaacttctgtctctacaaaaaattttaaaaattagctgggcacagtggcatgcacctgtagtcccagcagcttgagaggctgaggcaagaggatcacttgagcccaggagttcaaggctgcagtgagctatgattgcaccactgcactccagcgtgggcaacagaatgagaccctgtctcaaaaataaaaattttttaaattttaaaataaagtggaaagagaaataaccagagccagcctccctggcagactgtcttgctcggaggcttcccagcactgtcccgccatatggtacatgagaagttctgtcatttcaggtgaaggggtgctggcacagagggcagatcttgtcatctgtggcttttttggctcctgggaagaagtggaacttatccctgcttgtctccatccccagcctgccattcataccaccagctctgctgctcagggacaagtctccatgaacaaccatatcgcagggaccagcagcaggctgtcactcattaaaacaacaacaactgcgtcagactctacatcgtttttcctggaaagtatccagattatttcca

SEQ ID NO: 594 - DNA, 1128 bp, Homo sapiens
aattttgtgtttaatttcatatgttttcatgtaatgaaaattctattttttttagaattggttttgtttttattctattatcctttatttccagttgtcaaactttaaatggctatgtctgcattctaataacactgttcagtctgttatggaaaaggagaactagggaacaaatgttgctcagggctggtgtcagtgagaaaaatttatcaatgctttttaatgtgtttttacccttgcctcactgtgtgtgtgtcactttctataatataaagaaatactataatatttctagaatctggaactgtcaccatgatgaatggccctttcaatgcatagttacagaaattcctgaagattccccaggacttcaatttcattggtttttatttgcagtttttagttgctgtaattgttgctgtttccagtctaaaggacctcctttggtaaaggtgaacaagacctctcccctatgctacccagccagattttgtgtgtgtaatgggctggcccaagagtgttcttttacttagaactccttttgattttgcttttctctgcccctagaaattttagggacaaagacattttggaaattgtcagttacttttagaaagaaaacactgcagaaatatttaacagattacttcttgataaaatttaaatgggattatatgaatttataatgccaattgaaaatattatatacacaaaatttgctattttcacttaaagtaagcatttttaaaggatttattttagaatacaatctatgcaatcctcgaactcagtgtgcttttccctgacaggatatataaaaaggtagattaggtcaaccctcctttaagcttactctcccctcaccttttcttttcactgtatataaacggtactttctgtgattcataccaacagaggactttctgtgattcataccaacagtcctaaactgtcattttctaaatctgggatttaaaatctttagacaatatttaaaatcttgattttttttaaatgtcagcagatacaatttggaagattgcatctgtgtagaagtaatgcaggtacaagatctagagtttttccttagactctttagtcttttctgaattaaagaataagtgctct

SEQ ID NO: 595 - DNA, 1253 bp, Homo sapiens
cagcttgtctttcaattttgttagctacttcatatcttttcttaataaaacttctgttttgtttgttagccaacaaaaataccctacctggaatacctaaactattactttttcatttgaaaaatgtgactaatattgagaaaattttggtgtgaagattaaacgagatattcattcaaacattcaaatatttgagtacttctactgaccaagcctgctagggatagagaaacacaagatacaaacccaaagtgaaggagtgaaagagtgagggacataacattatgtagagatgtgaactggaccacttgtgaagagatggtttttgatacaagaaacacttcccccactgtattacattgagcaatatgaaactggcatgttcaaccatttttgaaatataaaagtaaaaatttcatatagttcaatgttatggtagaaaagaaacaagagaaagcagctacaaatgcacttagatttatagatttagtggtggaaatttaaagaagcacctgtctctccaatggcttctcggccttttggctaagatcaagtgaagtatctgttaatacctgatatgtcctctacccgagaacaatatattacatggatttttggagtagggagatggaataggagcttgctccatccactcctcgcatcgacctggtattgcagtacttcaggaacggtgcacccctccgggggaaaaaaaaaaaaatgaaagaagcacatgtcttattcatatgtaaaatgcctagagtaacagacactcaatagtctatttaggtatagattactctttgaaataaattcatgaaatatgctttcctaaaggattttgtacagaggagaaacatacatcaccttttttggatgttcctggtgctgataagagagatgtgttcccaaatctttaattctcttatttgttatatttctgcacaagatactagtttttaatcatcaaaaatatttaatttgaccagcctagccaacatggtgaaacctcgtctctactaaaaatacaaaaattagccaggcgtggtggtgggcgcctgtaatcccagctactcgggaggctgaggcagaagaatcgcttgaagccaggaggcggaggttgcagtgaactgagatggagccactgcactccagtctgggcgacagagcgagaccctgtctaaaaaaaaacaaaaaaaaattaatttagctgacgtaagcctagaaaacaaaaagacacatggatagataga

SEQ ID NO: 596 - DNA, 1177 bp, Homo sapiens
tcagaaggtctcttcagagctgctgtgcccagtggtgcttcaactggtatctatgaggtcctagagctccaggacaatgataagactcgctatatggggaagggtgtctcaaagcctgttgagcccatcaataaaactattgcacctgtcctggttagcaagaaactgaacgtcacagaacaagagaagattgacaaacttatgatagagatggatggaacagaaaataaatctaaatttggtgcaaatgccattctgggagtgtccctcgctgcctgcaaagctagtgctgttgagaagggggttcccctgtaccaccacatcgccgacttgtctggcaactccaaagtcatcttgccagtcccggtgttcaatgtcatcaatggcagttctcatgctgtcaccaagctggccatgcaggagttcatggtcctcccagtcggtgcagcaaacttcagggaagccatgcccattggagcggaggtttaccacagcctgaagaatgtcatcaaggagaaatatgggaaagatgccaccggtgtgggggatggaggcgcgtttgctcccaacatcctggagaataaagaaggcctggagctgctgaagactgcgattgggaaagctggctacactgataaggtgatcgtcagcatggacgtagaggcctccgagttcttcaggtctggaaagtatgacctggaattcaagtttctcgacgaccccaccaggtacatctcacctgactgtctggctgacctgtacaagtccttcatcaaaaactacccagtggtgtctactgaagatccctttgaccaggatgactggggagcttggcagaagttcacggccagtgcaggaatccaggtagtggaggatgatctcagagtgaccaacccaaagaggacagcctcggccgtgaatgagaagaagtgcaactgcctcctgctcaaagtgaaccagattcgctctgtgactgagtcccttcaggcgtgcaagctggcccaggccaatggttggtgtgtcatggtgcctcatcattctggggagactgaaaataccttcatcactgacctggtggtggggctgtgacctgggcagctcaagactggtgccccttgctgatctgagcgcttggccaagtacaaccagctcctcagaattgaagaggagctgggca

SEQ ID NO: 597 - DNA, 1257 bp, Homo sapiens
caaagtacatcccaggactaaatgggaaagaggtaatatttctctcttcttctccccaggactcctgaagaaaagaatttcttacaaatgctttaatattcaggcgtgggttcaagtgtagagcaatatcctttgattttcctgctagtaggtcaacattaaagcttttgagaaagaaagaaaaaaaaaaaccttaattaaccaagtaggacagagtagtggcaatttcagcaatgttagtgaccagacttgaactatgattctaactctatgaaacacacgtatccacatggacatgggaatgcaggtgaagttgaaattttaaacccagtcagcattccactaattcgttacttgcaaaataaaaatacgaaaaaaaaaaccctttaaaatcagcgttgaggctgagatgtggttggacagaaatggaaggtttaacgctaaactgaatgactacttcaggctgcaggagcctgggatcctctcaagcaggtattctcttttcatcatctacccgtgttccttccttcttgaaagtatgccactttctaggaaatagctctaatttcaagctttcagaaggctggacgtctgtggaaaaagttgttaaagcagaaattttctaaatcacatgacaagaggggccctaaaaaatgttgcctgggctgggcgtggtgactcacacctgtaatcccagcactgggagggcgaagtgggcggatcacttgaggtcaggagttccagaccagcctggccaacatggtgaacccctgtctctactaaaaatacaaaaattcaaaaagtagctgggcgtggtggtgcgcctgtaatcccagctactccagaggctgaggtaggagaatggcttgaacacccaggaagcggaggttgtggtgtgctgggattgtgacactgcactccagcctgggtgacacagtgaggctccatctcaaaaaaaaaaaagaaaagatgttgcctgatcttacggggctgctctggagttctacaaggcaaggataggcctcgtggacaaaaatgctactctcttgtctggccagaaaaagccgaggtcagaacacggccttagtcggctctgctgcccactggctgttcacaatctaaccacctcctgcttgaatcatctcactttggaaatgaagattctgacgctagcccttcttccagctcacaggaccgttcacgggtggaaggcggtaacaggcacggaagtatctgcactgtgactggtaccgaagg

SEQ ID NO: 598 - DNA, 1240 bp, Homo sapiens
tccatcctgggtgagagagtgagacttagtctccaaaaaaaaacaaaacaaaacaaaacaaaaccaaaaaaacaaagtgtagcaagtctgtgcaaactagaaattagagatccaaaaatgaaagagagaagtatcttgcaagtgacttgtagggcagtagtaagattgtttttaataaagcaaagaaagaacagtgctgagaaagccttgggatcatttgattataatgcagaaaataaaaatgtgcttttgctgtatgtgttccccatttagcacagtggaaagaggggtcctaagtaagtcagatctatttggggtcattttaccttcagagcagatgtgttcttgacactgcaatttataacttacatgcacatattaggaatttatttgtttaggccttcatcttgtcattctttaggctagttcttaaaggtggtactagctggtctacccccctccaaatctgactagggctttaaccacttatacctatgtttattctttggaacacttgctgtgaatcagaatattgttagctagaaaataagatgttaagggcacggaaaaaaaccccacaaaatatattggctaaatccactcaaaactggagaaaatactgtgtgatctcttaggctcactagccaaggatgttccttgggactctcctctgcactgcggttatttacatatatacattaaacataaaaatatttctgaaatagtgttataactagtcagctaagtaaaggaactgcaaaactatattcttatatttactgtgaaagataatcagaaagaatctgctttatttagaacttgactagtcagtagttaagtatacagaatgttctagacctaatgaactgaatacagataaatacaattttgttgttcttcatggaagagtgacatttcagtagatccccactctgccaggggaaggaattgtcaaggtgacttattcttttgagcaagttctgatagtaattggaaactggtgaattagaatggtaattaaagcccagtgaaaaatgacctcctactggaaaaactggaggaatacagaaggctaaaaatagtgaacacttaataccaacagattttctgaaggaagacttcttagtttctctaaatgggaaatcttacattatcctctaaaggaaaaataagcaagtagttgaggaaactatgtttttttttttccccctttttcttgagacagtctcactctgttgcc

SEQ ID NO: 599 - DNA, 1197 bp, Homo sapiens
actgcactgggccaacccaagacatttctaacaaaaattttacctaggagtgattgaacactttttgtttgagactgaaattgctcaccagacaggtttcttctctgacagagttggtgtaagagcagagacaaaatctgcgggcttgcagccctttatcacagagagtgacttctactcaacctgtgacctctctgcatcagtgtggcatgtttctcacagccatctcttaaccggttgattgaaatgagctatggaaagaatgatatgtttcagagatgttgaatggggggtacatgttcaagaaattcatacgccttccctctcactcctcagctcatacatgggaagtggaagttacgtggcaggtgtttaggaacagctgccttcagcttacttgtttaccttctgtccctgccacctttctttatttggtttcttacaaaagatcatgttcttaaactatgcattgtaaaccagcaatagttcacaggtgccagacctacactcgagataccctagggccattcagaggatattgatgactgatgtgctgggtgtgatttattttttgcagcatttgatgagcttgttgaagcataccaagagcaggccaaaggacttctggatggcggggttgatatcttactcattgaaactatttttgatactgccaatgccaaggtgagttaagggagaaaaaacagacaaggctggggtaagggctgtgggtgagtcccctaatgtagggagaagataatattagccattatcaaagttaaataaattacctgtatttgctccattttattcttgagtatttttaactgaggccagtacaataagaaaaactttaaacctgcttttgaagcttttaaaataacttttttctaattatgaaaataaatattttcatatatagctagtataaatgcatatatcctgaggtaatacatgctgctggttctaaatttgaaagatacataaatatatggagtgaaaagtgaatatcctttcctttcctagtctctagttatccagctccctttcctgatacaaccactattaccagtttgggggtcctgacagatgcgatacagatataggcatgtgtgtatgtgtgtgtttgtgttccttacatacatgcaaaggcacataagtgtatatggagagagaagcaaatatccttatacatac

SEQ ID NO: 600 - DNA, 1287 bp, Homo sapiens
tggatttcatgggcaaagtctggcttgaagataggattcctttttttgggaattatttgtacatgctatttaaaatagtgagactggctgagctcaccaaaggaatgactgtagagaagtcctaggactaagtgagtcttagagccacagtgcttagggcactggggagaagaggaaacaccatcagaaggatatgagaaggagcagcctgtatggtaggaggggagtcagaagagagagttcccttggaagccaagtgaagaacaatcatcaaagaaaagggcatgttcagctgtttaaagagttgtagatagatcaagtgggatgagaccaagagtttaccgttggatttagaaatggggtcatttgtgatcttgctgtactgtttccaaggagatgaaaactttattggagtgggttcaagagagaataggagaagaatagaagcagcagtataggcaactttttacagttctgccataaggggagcaaaaaaatagggtggaaaccaggggggaaatacgaggttcagaaagggcgtgtgtgtgtgtgtgtgtgtgtgtgtgtgtgtgtgtgtgtgtgtgtgtgtagatgctgtgacaacatgtttttgtaagctaatgagaatgatctgggagagagagggaggaactgatgcaggagataaaggatacatttgccagagccatgaccttgtgagttgagagagatggcagtcactgtgtgagtggaggggtggctttagatcagtagctggacagtttgctcaaagtacaaaagagaaggcagagtaaagagtgcagatctgcaggcatgctggttgatgtgctggcgggagtctataattgcttctgttttctcagtgaagttggaagcaaggtcaactcagagtgagaatggaatgttgtgccttagggatctgtggtgcttaactaggagtgcaaagcagactcactctgacagggaaggcagtcactgctggagcttttgaaaaatcgtacacactcctggacttcagcccttgagttttgactcatttggtctgggatgaggcctggctttagacattttaaagccttggaggtgattctcatgtatcttttggttgaaaaccaccagcagaggttatttcgtttagtcttcagagtgaccaccgaggtggcggccattgcattttacagtggaccagtgtcatatctaggacatggtggaaccaagtttttacctttggtcttcctcatttgaagactggtgtatgtttccacatcctgtgtttactctgtgctt

SEQ ID NO: 601 - DNA, 1486 bp, Homo sapiens
tggtatgtatggaatactccagtaacataaatgaaagaacaactcagttggatgggttggatcagctaaagctcaaagaagaggtaacatttagtttgattactaactgtaaaatagaagctcttggggtacgtttattaggagaggtcattctgggcagaggatgagaagaagcaaaaatatgtaagagtgaacatgctgaaggttaaggaattcagtgtaaccgtaacaaaggatgccttccagaatgtggctggagattaagatggataaaaggtagaacaagtccaagttgaaaaggtcttgtgtgccatgtgaaaaggttagcatctattacatagacaagggaaatccattggaaatttgaagaaggggattgagcataatgaaacttgttttggaaaaatatgttgttattaatgtggaggtgggcaagaatgagaataatcagtagcaatgaggtgtcaataatttgatactgtctacatggaagacagtgattagagccatggaagtcagaatgaaaaatgataaatgtgaaaacattctagagaagaaatgaatacgcgaaggcccgtggtgggtgatgacatgatgtgatttctgcccagtgctctgaatgtcaaagtgaagaaattcaatgaaggacgggtaaacggcgggagtaactatgactctcttaaggtagccaaatgcctagtcatctaattagtgacgttcatgaatggatgaacgagattcccactgtccctacctactatccagcgaaaccacagccaagggaacgggcttggtggaatccgcggggaaagaagaccctgttgagcttgactctagtctggcacggtgaagagccatgagaagtgtagaataagtgggaggcccctggtgcccccctgtcccagcaaggggacagagtggggcaaggccagaggtgaaataccactactctgattgtttattcactgaccccgtgaggtggccccaaggggctcttgcttctggcgccaagtgcccggccacatgcacatgccaaattgtaaagaccatcgatgctaggaagaaactgcgtcaactaatgagcaaaataaccagctgacatcataatgacaggatcaaattcacacataacaatattaaccttaaatgtaaatgggctaaatgctccaattaaaaaacacagactggcaaattggataaagagtcaagacccatcagtgctgtattcaggagacccatctcatgtgcagagacacacatatgctcaaaataaagggatggaggaagatctaccaagcaaatggaaaacaaaggcagggattgcaatcctagtctctgataaaacagactttaaaccaacaaagatcaaaagagacaaacaaggccattacataatggtaaagggatcaattcaacaagaaaagctaactatcctaaatatatatgcacccaatacaggagcacccagattcataaagcaagtcct

SEQ ID NO: 602 - DNA, 1936 bp, Homo sapiens
cctctaaattggtaattgaattacctccctgtagctttatagtttgtgacatttcttgaccttgctagttctttcattagatctgcgcaagatctagtcatctggttaaggattttaagcagatgcaactataaacccaagaaactgtattactattactgttggtcatactaaacctgtctatttcctgaagtatatgacccacaaggatgtggaataactaggagaaactgtttttgtacactgtacatccttagtatttttacacgtatatgatagggatgaacatgattttccttcgtacagacagcttaaataaagcactatgtcaatctgctacttctctgtttattgttgttggatgtggttctataatccccccaaattaaatcttctttaatgaaaacatgatttttaatagccccagctggtattaacctaccttgtataaaatgtgacaggaaaatatagaaataattccttgtagctcacacacacacacataggggatcatttttacttcagtgaaatggcagtagtgcggttgtgcaaactttgatgaacggctgcttctgaggggaaacgctgacctctcagcactggatttaggatggatgtactgtgaagccagggatgaaggaggtctcagaccctggggacattcagacccgaatcatctatacaacacacggtttggacccagaatctgaaggaatgtagcttttcattaacgtcttcctgataatgtactgctctgcatatttcctttcttagagtgtatttctaacaacatgtcatggcaaattaacaaacttagacgtgggtgatgtagatgggtaggatggctggactgcagtctgacttcacgttgaatcattctggatggggcctttttctgattttacctcataaagctactattgtagaaacttggctttgctcctgtgacgaagccagacagaggaatggcttttgggaccagagtgagtcaagcatgtatgtgtatgtcacacggccaaatttgagggcattctcacatgtgctcttctctcaaaaccactggggttgacagatccaggaggctaaaaaaaagtgacctctataattctttaaaggtgctatttttagaatattgtataatttattcacagtatatctaaaacagaattaaggacaattaaaatatcttatgtgacagcctttatgtctagcacatttgatgaaataaaaaacttctgaatctgaatagaagttctactgtttcaggcttgaaccttttacatgctcaagagattcaaatggtctctgtgtgtagatcatgccaccgcctccaaagcctaatccacatcacttctgagaggcaaggctgagcatatggtgacatcagctctgtgttgagatggtgatgaggatgatggctcgctggccaggcagggcagccgaaggtcagggacctgtcctaactaactgcagccttgcctttagtgtttgtcattctcagatacaacacggtatgtccagtgtccgtttttattactttaaagcatttgagggcttaattgtgtatagtagaaatactattttagacaaataattatctgtgtacagatatttgatatactctaagtaaattttctaatttcactaagtacgtttttaggctcctctcaaatactgcgtattgaagaaaaaaatctgacaccaccgagccaaagatgcttttttgtctgttttcgttgtttaacagaatggaaagagtaatgcatagtgcttcctggtgtctcctgattgattgattgtgcacaaagtaggacgataaataaataaaatggagtctgatgggacattgattaaaggtgaaggatgattgatatatagatcatgaaaagaaaaatgaatggcaggaaaaaaagtttggtccttaatatactttggc

SEQ ID NO: 603 - DNA, 1176 bp, Homo sapiens
tgtgtattatctttgtttcaacaactgtggttttatttcccctcagtatttgattttcatcaagcagctgatggtatccaggaacaacagagacaagaacaagcaggaaaaaagtatgtgtgggtttttgtttttttggtacagtttaagcatatgcagacctttatattttagttctagaccagaagtttaagaaaaataagtattagaatatcctgttttagagaaaatcagtaggattatgaacatatacttagcaagaaataacataaacagaaaatagtcatatgtaactttattcactgcaatgatctgaccaggagacctacatctttcttgtctgacttaaagcttgtttggatttgtttttaagtttgggtacaacaaaaaagggcattggcccagtttattcgtccaaagctgctcggagtggactcaggatgtgcgaccttgtttctgactttgatggcttctctgagaggtaactaacttgtgtttcaaaatggaaggaatgaatgcattttttgattttttttaaaatctagggtgcaaaatgatacagtcggtattctagttaaatagtggtggttggcttttttaggtttgaaatattaaagttatttttattacattctaattcatccttggttacagattaacttcatgaaatataacatgacggtgatttaatagaatgtcctaagaagacaaagccagagttatatttaagaattgaaatatggaatggtttcctgagaaatagaatgattccaggggctgtggctgtccttgggtggttacattctaaggtcttgatccttgcattttcaggcctagagactccttatgtcctcccacccagaaatcattagctctcagatactggtgaattattgtataccaagctcaacttgaaatcaacagatgctacgttaacacatgctttctgtagccagatctccttgggaaacctagtagtcatcaaaaagctactcagtgactcaatgatagggagttggttgtgtataataacaagtggcatcaaagctataatgacattgtatcccctttcgatcaaccactcaacatttgtctgcactggcagtgcacctttactgaagaatattagattgctaatgtctgcctctctctcttttagaagtatcatgtaaactg

SEQ ID NO: 604 - DNA, 1253 bp, Homo sapiens
gaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgattta

SEQ ID NO: 605 - DNA, 1070 bp, Homo sapiens
ataaatgtcttgttttcaaaagtggatggaacttggctgggtgtggtggctcacgcctgtaatcctagcactttgggaggccaaggcgggaggatcacttgagctcaggagtttgagaccatcctgggcaacatagtgagacctggtctcttgaaaaaaaaaaagtggatggaacttgtagcagagaattttatctacttctcaacctgcttcagaatacccatttgagatgttcccctggaaagatgaacacaatactgcatctgaagccatttcttcccacctaacattcttaaaatgattagagtctaaactttgtcattcattcctaattctggagctctgaggttgaggtgttcagagtttggtgaataattgggtttaagttttaacattttagtaataataaaagcaaacacatacatgttaaggcctgacaataggttgcaatacccatgcattgggactcatacccagcataaatggtgagggactgaacattagtgctttgagcaagaattggttaactacctgagatctctaaaacagtaatttgaattactaatacataaaccacaagtctcttcgaattgttaattgcctaaatttaccctaaaacttagttaacgctgcagtgcctttattaaagcttttttttgggggggggtgtgggcacagctactccataactttaaattttaaagcatgaaggtgatctagctagtgttagtgcttgagttggtagttacataggctgctcttgaatcgtcctgttttctttgcctagtattagcaccacaggtacatatttgtaaaataagcattaaaagtactttgtccagctaactcatgttggagtgacctttgtcttactaacctttgttactaaacttgttaattagaataagcccttgagaatttggaagtgagctatactactaatgtagtatatatctcttgagtgtgttggagtagatgaaaaaccaggggtccccaagggtatatttttgaaattgaacagaaacaattcatcttaatatttagttttcattatgtttagcttaatatgt

SEQ ID NO: 606 - DNA, 1366 bp, Homo sapiens
tatcaccaaggatattattgaatacccaaataaaacgaactgatacatatttctccaaaaccttcacaagaagtcgactgttttctttagtaggctaactttttaaacattccacaagaggaagtgcctgcgggttccttttttagaagctttgtgggttgattttttttcttttcttttttgtacatttttaattgcagtttaaaagtgaatcgtaagagaacctcagcattgtgcacgataagagaatgtgtcagtatttcagggttctacattttatctgtaaaatgtgacttttttttttttttatcacaacagaagtaaaatgttgctttgtacctggtgtcttttattaagaatttactccccccatttctcacagagaataacagtcgggagtcattgtcacaatataatagaaatgttagcaaccagattcatgtaaggactaagtggtcctcatgaattgcattaagactctgtactgctcatattacactccatcctctctgtagtttgctgggtagtggagggggtaagctaaatcatagtttctgacaataactgggaaggttttttcttaaaataacaatggaattggtataattgggattgaaaactaaaacttggaactaagatagagaagatggagtgtatgtagaagggctgttaaaaatgtaaaacttggttgcattatttgtggaggctcaaacttgtgaaggttaataccataatttttccatttgttctgcattttgattctgaaaagaaagctggctttgcccatttcttattaaaaaaacttgttgtaaatccagttgtctaatgggatctatatgaagttagccatgtctgtatgcccttctcccacaaaatactgtataactagtgtgcttgtagtagttaactccaccatctttgtaagctaatgaaattgtgagtcacccatttatatcttaatttttaatcatgtcagttcttgaatgggtatctccttagcctgctgatttctttttctttctaaagaaagtgggtggagaaattaatttagacgtttgtttgcaataaaaagaattcattttactcttgttttgggattctcgccatcaaggttcaaaatccctttatataactcccaagaggagaaatttattaagtgtgtgctttctggacagcttattctttactctgcatagaacatttaggttttaaaaacttaaatgtatactgacaattgatacataattatgaagtaaagttgaattcttcccttcccctcccccccagacaacttttaacatatttaatgaggggaaaaggtactggctgggagaagttaacactgagtttatcatctttacagaat

SEQ ID NO: 607 - DNA, 1188 bp, Homo sapiens
gagcaacaaaatacaccagtccctggattagtgtaaagacttcattcagcagttgaattgggaaaacacaggacatttttgaggaactcactaattcattttgactgaaaacagtgaacatgaaattgacctagaaaattcagtctagcttctaggtcagtattgtttctggttctggagatacgtgcttcatggtttacaaccatcagatttcttaactgtgtagcccttaaaggccacctaatagttctttaacctgtagcttccacaggataagctttgctcctaattttaattcttagttttttagaaagtttaaggaagcagattttaactgttgaatttttttctgtgtaacagaactttgaaagtgatgaagtagaactctcgtatgctaagaatggacaagatcttggcgttgccttcaaaatcagtaaggaagttcttgctggacggccactgttcccgcatgttctctgccacaactgtgcagttgaatttaattttggtcagaaggaaaagccatattttccaatacctgaagagtatactttcatccagaacgtccccttagaggatcgagttagaggaccaaaggggcctgaagagaagaaagattgtgaagtaagggatttttttttttttaactgtggcatttgaatattgcttgcctggcacaaaatgacatttagaagaactagatgattagtctgtttcatttactttgtgctgtgcatattgctcttaagtaattgtttcccccttatgttgactgttaatctttccataaacaaatttttgtccgttagtgtaagggctatgaaaacttagatatttaaattggccttaacaatatttaaagaattattaggtggtgtctactgacagtgaaatgacatttcttttcttttcactaggttgtgatgatgattggcttgccaggagctggaaaaactacctgggttactaaacatgcagcagaaaatccagggaaatataacattcttggcacaaatactattatggataagatgatggtaagtaaaatgtttagggcctgatctcagtgtttaaaatagactgggagaggctgggcatggtggttcacgcctgtaatctcagcattttgagaggctgaggtggatggatcacctgaggtcaggagtttgagacccacctggccaacat

SEQ ID NO: 608 - DNA, 1186 bp, Homo sapiens
atcatgcagtgagtcggttgaactgaaaggcggtttccttttcctccatttgctcagtcccaattggaagcgcactgcgcggcctccaccgcgctctcggcccgggttcggcgtgggggcggggaggtaagtacggtaatgggcggggccgagcgcgggcgcgctccggctttcctcctgcgcagtgctcccgtcagcgcagggggcggggcgcctatattacgtgcgcggcgccgctcctgcgagaggacgttgcgtgctcgctcgcgccaggcgagtctccgcgtctccctcgcgaactcggtgaaaggaattggcgccgttcgacaccaggcggatccgctctgcagcacgaacccatctccagccgcagccgcagccgccgcccgggccgaggagcagccgcagcagccgccaccagtggccgagtgagcggagccgagtttgaggcagcgcctagcggtgaatcggggccctcaccatgagttcctcgcctgttaatgtaaaaaagctgaaggtgtcggagctgaaagaggagctcaagaagcgacgcctttctgacaagggtctcaaggccgagctcatggagcgactccaggctgcgctggacgacgaggaggccgggggccgccccgccatggagcccgggaacggcagcctagacctgggcggggattccgctgggcgctcgggagcaggcctcgagcaggaggccgcggccggcggcgatgaagaggaggaggaagaggaagaggaggaggaaggaatctccgctctggacggcgaccagatggagctaggagaggagaacggggccgcgggggcggccgactcgggcccgatggaggaggaggaggccgcctcggaagacgagaacggcgacgatcagggtttccaggaaggggaagatgagctcggggacgaagaggaaggcgcgggcgacgagaacgggcacggggagcagcagcctcaaccgccggcgacgcagcagcaacagccccaacagcagcgcggggccgccaaggaggccgcggggaagagcagcggccccacctcgctgttcgcggtgacggtggcgccgcccggggcgaggcagggccagcagcaggcgggaggtaagaagaaggcggaaggcggcggaggcggcggtcgccccggggctccggcggcgggtgagtgctgcgtt

SEQ ID NO: 609 - DNA, 1346 bp, Homo sapiens
ggtatagagagaaacatatggaccaatggagtagcacagagagcccagagataaattcttgcatagccaaatattcttcaacaagggggccaagaccacttgatgaggaaaggacagtttgttcaacaaatggtgctagaaaaactggatgtccacatgtaaaagaatgaagttagacccttattttataccacattacattagttaaaaattaacctcaaactctaaaataccttcaagaaaacataggataaaaacgttatggcattgaatttcccatatacaataatttctcatatacaacaccaaaagtacagttaaaaaaaatatggatgtgagggtgatctggctgtggcacctgtcaccccattgattgccagggttgatttggctgacctggctgactaggcacgtgtccccttcctccctcgcctcccgaagctgtgcgcttggtttaagaggacaaccatcccagatagaggaggactggtctccggtcaagggtataagagtagctgcactccccggctagaaccttcaaacaagctctcaaggtccatttgtaggagaatgtagggtagttaagcttccaagactccagacacatccaaatgaggtgctgcatgtggcactctgcctttcttaaaaaaggaagaaagaaagaaaaagaaagaaaaagaaagaaagaaagaaagaaagaaagaaagaaagaaagaaagaaagacaaatgagactacctcaaacttaaaaacttgtgtgcatcgaaagacacaatcaacagagtaaaaaggcaacctacaaaatggaagaaaacgtttgtaaatcatatatttggtaagaggttaacatccaaaatattcacaattatttaatatataagtaatttctacaactcaacaacaaaatatcaaataatcctatttaaaaatgggcaaaaacctaggcacagtggtgcacgcctgtagtcaaaagctactcaagaggttgaattgggaggatcacttaagtccaggaattcaaggtgagcctgaggaatattgcaagaccctgtctctgtaaaaaaaaagataaataaaataaaaataataaaaagtttaatgaaaaaaagaaaaaaaactataaaaaatgggcaagggagttatatagacatttttccaaagatgacatacacgtggccaacaggtacatgaaaagatacccaacatcactgatcattagaaaaatacaaatcaaaacctcaatgagataccacctaacacccattaggatagctactattccccccaatcccccacccaaaaaaaccccagaagatggcaaatgttggtggggatgtggaggcattg

SEQ ID NO: 610 - DNA, 1204 bp, Homo sapiens
ctttttaaaaaagggagcttggggcagaatgaaccactaaaaagttattggctcttaactcctgctttttgtagaagcttgacaggcagctgactcagccagacctgaaaccctttccccggttcttgttggcatttctgactttgccatttcagttggcactgacccttccaagactgtgtatgccaggagggagcatctgcccccatctactctctgggaagatgtcctctcccaagagtcaagagtgtcttgttctgaccgtgggttacttctctgtgtctgtctgagaggggaaagcattgtcatcacacaggaggtagcaaatacctacctctttttttttttttttttttttttttttttgagacggagtcttgctctgttgcccaggctggagtgcagtgatgcgatctcagctcactgcaagctttgcctcccgggttcacaccattctctcgcctcagcctcccgagtagctgggactacaggtgcccgccaccacgcgcagctaattttttagtttcaccgtgttagccaggatggtctccatcttctgaccttgtgatctgcctgccccggcctcccaaagtgctgggattataggcgcgagccactgcgcctagtctgctctggtttctaatagaagtaggtatttgcagctaggcgcggtagctcatgcctgtaatcccagcactttgagaggctgaggcaggcagatcgcttgagcccaggggtttcagactagcctgggcaacatggagaaactccatctctacaaaaaatacaaaaaattagccaggtgtggtggcacatgcatgtagttccagctactcaggaggctgaggcgggaggatcacctgagcctaggaggtcaaggctgctgtgagctgtgattgcaccgctgcactctagcctgcgcaacagagtgagatcctgtcccctccaccccaaaaaaaagaaaacaaagaaagaaaccagaacaccaggtgtgtcttcctgagttttcaccctgatcactgcctctcctgccagctccctgctttccagggaagagttggctgcgccaggggacagagcactgactcccacccaggccactgggacagccatatctaggcctcaaaagactatgggggttcctagcaaattccaccttatttgacttctccgaacagcccaaactctgctgggcttcttccct

SEQ ID NO: 611 - DNA, 1182 bp, Homo sapiens
ttgacatggcaaattgccaggttttgattgctgaaacaaagatatgtttactatattaattttggcatgaaaaagagttggacagtgtatggatcctttcaggccttaacttagaattgagtttaaacagggcctcctgggtgattttatctcctgaggcagtgacctggaagggtagggtcaggtgggaggctggggagacgtttgctgtgccacaggctttcctcctaattttatttttgaggccggaacactatgacgcttcatactgtctgcatatattgggggaggaaggtgtctgtgtgtctgtattttctcttataaagtatacttataaagtagccaggagcttcatacaagcgaatttgtgcggcagggatctggcagcaggggatggagaactctgggaaaggtgggattacattgcagcgtcggcaaagtactaaggattgccgcggtcctccagaaggccaaggtcgtgcgtctgccatcagttcttcacgcagtccgacagtgctgtgtggagccagcagcccccaattcccttatttgccccagccttgctcacctctcacctccctcttctgcactcatttgcccccagccatgctcacctccacctcttctgcagattttttgcactgatggtctgttctccacttgttctctgagtcttcatatatgagacttttcctgtcttaactagctgtgaactcttgagcacatgaaaccaagctttattcttttcatgttctttcttcattgtctgtaaaagagcatgccaattaatttttggccttgattcatcttttttgactgtgactcttaaccaactggatcataatcccctacaacctgctccactggtcatattttttgatggaagaaattagttggcacctgagttgtacagttttgctgtaggaatgtggatgaatgttatttagcgtgaaataatacttcctcaaagttcagattcatagggaaaaaaaggctaaatgttccaaaaagtgtgtatgttatgatcagaccctttcatggagttacgtcttcatttgatccacaaataaaaatctactaggatgcattctgtctatgtacaacttcttagaggaaagaaattaacatttaatgagcttctgttattgccaagaactgtctgtgctaggcaatttttcatat

SEQ ID NO: 612 - DNA, 1207 bp, Homo sapiens
ctgttctcttcatgtctatgtcttgtgtttctttgcctgaacacaggacataagaaccttattgttttctcagagtgcttttgggtccttatttgatatcttttccactcttcattcctatttgtttctcctttcttttcttttcttttttttttttttgagacagagtctcactctgttgcctaggctggagtgcagtggcacgatctctgctcaatgcaggctctgcctccgggttcacaccattctcctgcctcagcctcccgagtagctgggaatataggcgtgcgccaccgcaccaaagtgctgggattacaggcatgagccaccttgtttctcctttcttaaacgcagatcttttgactggagctgtggaactggggtcagagttgagctccatcagcacatcacctcgttatctagcacatcacacctactttgtatgtttgtgtagcagaccatttcttctttcgtgtttcctcattttacatttcatctcttcagtcacagcgaaaagttgttccgtgagacctcttgcataatgactctaaggggcttcagagacattctcctgcgaggtaactgtgcctgtgatgtggggagagtgtgagactgggaagcagaagaccggaatgtgatacagcctttcccacgacttggctgaggaactgctgttgtgaaccttttgccctggtgggattattgtaagtattcagagggatcattttgagagaagtgctgtggacattgacagtgccagactctcacaggtcaagttttcattgtctcttagttttggggctgatatgaaatgaacttgggtctttttctgagggctttcagaaagttagcaattaaacaagaattctaaattctgttttttgaattcacccaccgtgctgttctctggtttcagagtacttgtgcatggtaagggactgtgaggaaagactttgaaatgattaaaaaaaaaagagcatgttttgtctactcaaccatcaggtcagctctgcctttcactgtctttgagctgtactagaattgtgtgtgctgcagaaaatagacagtaaagcgcctggttcttgtccataaaatgcagttgtgtttggagaatgcaatagattattttcctatgcatattgactagttttgcacattttacatcttgctggcatttctgatgcttatgtatttgtgtcttctttga

SEQ ID NO: 613 - DNA, 1177 bp, Homo sapiens
aaccttggagttgctgacctctgcagtaattgttagagtcctattttatatatagtagagattaaaaactcaatccttatattttgtatttctatacatagaatttatttgatgttaataattgtttagtgtcagtttaaaaacaagtagtgaaacctcattactcctgcatttcttttttttttttttttttttttgagaggggagtcttgccctgttgtccaggttggagtgcagtggctcaatcttggcccactgcaacttctgcctcccgggttcaagcgattctcctgcctcagcctcctgagtagctgggactataggcacgtgccaccacgcccagctaattttttgtatttttggtagagacaggatttcaccgtgttagccaggatggtctcgatctcctgatctcatgatccacccgccttggccccgcaaagtgcttgcattaaaggcatgagccaccgcgcccggcccacttctaaatttctataagaactgtttaaaactgaatgcctgtcttatctgtgagggataagactacagacttcaaagtttaggtaaaagctgaaaacactccgatgtagaattagaacattttgaatcctgttccaattaatttatttagatgttaactattagtaagcatgttataggattagattaaaaataaattgttaataacttttggtaggtattatgtatggtgaatttaaatggcctagcagatttttttgttatcttttgaaaattacaatttcagctttattagtgatggagcatttgaaaagtggcttgggtagatggcaacaatcggctgctgcaaaatttggcaacaaagacaaacctcatttggtctcatgggaatgctggacaagtacacctgcaggctttcccctgaggggcagagcatacctctttaaaacttaagtcatggaggagtggtaccccctcgccccaaaaaacaaactctgaagggattgaggcatatgtgttccgcctcttctcttatactgtaataacagtaagtcataataataacaatatgtcataaatggcttttagatcaccagtgcatagctgggtagttgtctgtctgctatggtggtggggggcaattttagcacattaaaaagtgtttttgaaacccaacaaggcctattagaaaatcagt

SEQ ID NO: 614 - DNA, 1190 bp, Homo sapiens
gcacagaaaccctatgtatgtaacaattgtggtaaaggcttcagatgttccagttcccttcgtgaccatgaaaggactcatactggagagaaaccctatgaatgtcagaaatgtggcaaagcctttagtcgtgctagtaccctttggaagcataaaaaaactcatactggagaaaagccctataaatgtaaaaaaatgtaaaggctttaatcactacagtttttgtcaaaaacatgaacagtcacatacttgagagaaactgtgaatgtaaggtgtaggaaagtacttaattttcccagatttcctcaaatacatgaaacgaatcaaactggagataaaccctatgactataagcaataaggtaaagcattcaatttttccatttctttttgaaaacttgaaaggactcactgaagaaaatccatatgaatgtttaaaatgtggtaaggcctgcagttgttccagtggtatttgatggtataacataactcattctagagaaaaactttatgaaggtatcgaatgtgagaatgccttcatttatcctataactcactcagagacacatggtaacacatactccagattgaccttataaataaaagaatgcccaccagattgaaatcctagaaatacagaaaattctgaattttaacaattactttaaaggtcatgtgaaaactcccactggaaataaatcctgtaaatgtaaatattatggaaaaccttatggaaaataattatagtacaattctcaagaaaattcactatgtgaatgagatgttttaggagctataaataaattgaatatattggttgctcatttttgaagagagtctctagaatatagattttcacttcttttgaaaaaaaaaaaattgaggtgagacttttttttttttttttgagatggagtctcactttgtcgcccaggctggtgtgcagtggcacaatctcagttcactgtaagctctgcctcccaggttcacgccattctcctgcctcagcctcctgagtagctgggactacaggtgcctgccaccatgcccagctaattttttgtatttttagtagagatggggtttcaccgtgttagccaggatggtctcaatctcctgacctcgtgatccgcccgcttcagcctcccaaagtgctgggattacaggcgtgagccaccacgcccagctgag

SEQ ID NO: 615 - DNA, 1235 bp, Homo sapiens
tgctataaagaaaaatcataacagcaaatattactccctggacccaccaacaagaagggtgttccttctctgctgctgccttgctgaacagttcaactttagcataagaactgctggctgagcgcggtggctcacgcctgttatcccagcactttgggaggccaagacaggcagatcacgaggtcaagagatcgaggccatcctggccaacatggtgaaatcctgtctctactaaaaatacaaaaattagctgggcgtggtgacatgtgcctgtagtcccagctacttgagaggcagaggcaggagaatcacttgagcctgcgaggcgaagattgcagtgagctgagacggtgccactgcactccagcctggcaacagagtgagactccgtctcaaaaaaaaaaaaaaaaaaaaaaaaagaactgctatgtgggagaaaggaagtgtagacagagtcatagttctagtgaccaaatagtagaataaatgttcgccacagaatcagatgaacatcttataaattgactacagatttccagtgctttcagtctcatccatcctctacaaaaatgtggaatattttagaactcggttgcctttgaggatgtggctgtgaacttcacccaggaggagtgggctttgttggatccttcccagaagaatctctatagagacgtgatgcaggaaaccttcaggaatctggcttccataggtaagaatcacaatatttcttcacttagtcaatcagaaagtaagtgtttcatggttttcaatgtcattccatgatttggaatgtacaaagggaacactttgatgagtgaatgaggcatggacccagtgtgcaatgactcttgtttcttagtctattttttaattgtgataacagaatacctgatcctgggtaatttacaaaaatagttttatattggtttatgattctagtggctagaaagtccaaggttgcatctggtaaggacctgatgctacttcagctcagggcatgaagcagaagcaagtgggcatgtgcaaagggatcacagcaagaaaataagagcaattcttgggagctaaacttgcttttataacaacctgccctctggcaactaattcagtcttgcaagagtaagagaaaacatgcattcccaagcaaggacattaatctattaataaggaatctgtacccataacacaaacaatgttgccatattgatgaccaaattacagcattcattttg

SEQ ID NO: 616 - DNA, 1099 bp, Homo sapiens
tcaaggatattggcctgaagttttctttttcattgttgtatgcctgccatgtgttgtatgcctgccaggatgacgctggctgtcatagaatgagttaaggagtttctcctctttagtttcttagaatagtttcagaaggaatggtaccagctcttcttaatacatctggtagaatttagctgtgaaaccatctggtcctggcttttctgtttgataggtttattattactgattaaatttcagagctcatttttctgttcagggattccatttcttcctggttcaatcttgggaggttttttgtttccaggaatgtattcgtttttctaggttttctagcctgtatgcatagagatgtttgtaataatagcctctgagggattttttttttttttagtttctgtgagtctggtggtaataccctttttgtcacttctgattgtgtttatatggatcttctctccttttctttattagtctagctagcaatctatcttatttcaaaaaattgactcctgaagttgttgatcttttgcttttttttctctctctcttcaatttatctctgattttggtttttttgtcttctgctagctttggggttggtctgctcttgtttctttagttcctctaagtgtaatgttaggttgctaatttgagatcttttcaaagtttttgatgtgggcatttagtgctataaaatttcctcttaacactgccttagctgtgttccagagattcttgtatgtttgttcttattagtttcaaataatttcttggtttctaccttaatttcatttttttcttttgatttgttgaggattgttttatggctgaatgtgtggttgattttagagtatgtgccatgtgcagctgagaagaatgtatattctgttgttttttggtgaagagttctgtaggtgtccattaggtccatttggtgaagtgttgagttcagatctcaaatatctttgttagttttctgcctttatgatctaataccatcagtggggcattgaagcctcccactgttaactctgtggttaagtctctttgtaggtgtgtaagaatttgccgtatgaatctgagtgctcttgtg

SEQ ID NO: 617 - DNA, 1205 bp, Homo sapiens
gactttccggcataagtcatggaaacatcatttgtgcgccactaacttgggggtattcagttctcccaactccaatctccaatctgcctgttttccagagaggtctgcaagtgctctctagggagacgaagcggtgggccctgcccggattccagtctcaacactgctgcgtggctctgagcaatttcctaggagtctgtagaagtggctccagggcaccgccctggggctgcctgggcagaggtgcagctgtgcctgcaagcccttaacctgagctggggtgatggaggggtgagggctgggagtggcgagggacgctttttcttcaagattttatctgtacctcaacctgccctccctgtggtagatgatgatcaggccagcagaacaagactcaggagccttcctatgactgggaagaagagacttgcgttattcaccatttacctcccatggcacctgctgaaacgccaggccctcttggaagagcttggcacatagcagctcactgaatcttcatgatcaccctgcaaaggaggcacaatcatcatgcccattttacagatgggccatacagtgatagaagttgctgagggacacgcagcagatccaagatttcaattccggcagcctgtccagactctgggcatttcatagtgcgtggagctgctatatactaacggtaattaaaggcattgaaaggtttttgtattggttcaaaccccaagagcgcgccaacggacaacacaaggcggtgtggagcaacatgctgttttaatgagcacctgggtgccggcgggctgaggcctaaaatggtgtcagcaccaagtgaggacagggcagggattttatagttctctgcaaacaggaagtgtcccagtctgacgtgactgccacgtagtagccagacggcctctctccatcctcaggtgcgtgtcttccggccggggtgcgtgtcttccggccggggtaggtgtcttccggccggggtgcgtgtcttccggccggggtaggtgtcttccggccggggtgcgtgtcttccggccggccctcttcctgcttctgcttctcgctgacgcgcgctgctggtgcaagcggccttgcgccttgcgactgggtctgaggagggaggagttattcatccccccaagctttcggccccggggagaatctttcattcctgtctatttggttatagaaaaagg

SEQ ID NO: 618 - DNA, 1220 bp, Homo sapiens
tttttccaattgcaaattgtgctgctataaacacgcatgagcaagtatctttttcgtataatgacttattttcctctgggtagatgccccgtagtgggattgctggatcaaatggtagatctactttttgttctttaaggatccacaatgttttccatcgtggttgtactagtgtttgtactagtttacatttcatggaaaaactttctatagaagaaaatgtgaactacagagaaaaaaaaatcaaaatcacaggaagaagatagcaatctacttcattcctggaattgtctgaaaaagtcgtgtaaaatttgtggagatttaagtatatggagaaaaacacttattcattgtaagtaaaataagattgtatttcagcttcatcttgtgtatacttaggagtaatagaaaagagacaaatggggagagaataaaagaaatataggaagaggaaaagagaaaagaatcaggaaattggaagtgaaataattccacacatacttattgaagtctatttaaacaatgcttaaaaatatatggcctcttagaattatacgtttaaaatgaactttgtcgctatgggatttggggcattataacaggaagtgagatgtttgaagacagggtttttgagctctctgggtattaactccttaagtgaaagatgctctgagtgcacaatagacttgtgctgtgttctttaattgatggagatgctacatctcatgtcctcatcatccacagagcctccagatcctggccagaagtctcctcagagcccccttcatatctttatttctcagggtgtaggtgaagggattgagagtgggggtgattatggaatagaagagagaaataaatttgccctgctcttgggagtagctggaagggggctgcagatacatgtaaatcgcaggtaggtagaagagggagacgatcatcaggtgggaggaacacgtcccaaaggccttgtgtcgtcccttggaggactggatcctgagcactgcccgggcaataaagccataggagagaaggatgagagccaggggcaccaacacgaagaaggccaccagcacagccagtatggtgtcattcacagcggtgtcagcacacgacagcttgatcacggccggcacctcacagaaaaagttgttcagcacctgccgcccgcagaatggcaattgcaccgtcaggaccacctgcacgaaggagttgccgaa

SEQ ID NO: 619 - DNA, 1475 bp, Homo sapiens
aggcccctctgacctaggacctcccgatccggccgttatcgccaaccgtatctgtgtggtttcgtggaggaagcgcggtggaccttgaggggagggtacgcgcaggcacaataaagcagaaagccgctataataatgatgataatgaagaaaaacaaaagcatccattcgtcacttagtggcaagcgtttttccaactactttccgagtagtaactgcttgccagagtttccccagcttgggccggaaggtgaggcggtagctcgagctttgcctttctcaggcattgtcctgcgtttgcggggccaggcgctggcacacggtcactaacccctggtcgttagcttcgattcccggcctgggagagcgctatcggccactcctggctgcattgcagtcgcggctttctccagagctccgccgggaacgggaagcgctgaaacgtcgcgaccagtcagtagggttcccacggccgcaactcgggtgtgacgcggcaggctggcaccagcggacacaagtatgaggctaagtgagaagcgctctgcttccgagtgtcaggatggccgagtggtctaaggcgccagactcaaggtaagcaccttgcctgcgggctttctggtctccggatggaggcgtgggttcgaatcccacttctgacacattcgttttattagcattttattccccggaagaaaccccagaattttcccggagtccgttggtattttattgtcttctccaggaagaaggttacaactagactactcatctttgctgcccggttttccctgtctgccgcagcaagggggctacctaccaaggggagggaagcagtctgcatattcccaaatgttgcgagaaaaccgcatccaatcatgtttctataggagatacgtcacaggatatttatttagtatagcatattgctaaatgacgcatcatgtcttccctggtggtctagtggttaggattcggcgctctcaccgccgcggcccgggttcgattcccggtcaggaaagtaagccgttttaaaaactgttgccgcagggctaaccataggtgatgttcccagagtcagctatgacttgacttctaaacaaagggcaaaacgcacctggtgtcctcattttgcagagtagttacctgaaatggactctactgcagtttatgcgcgccgtatatgtagtcagtgtctttactcatgatatcttaagaacggagaaaaaatgccagcagcacaaaatgatccaaaaagatagctctgggtatgccaaaaatggctggtcttaaaattatgtcacagatttcaaaaagtctccctaggtgtccaaaggccattagaatggcacctgttgcctagaggggcgggtcagggccggtcctagctccttaacgacgcttgagtaattgtcgctatggaaagagatcaggtacttctccctcaccccagcatctatcttttcattttttaaataa

SEQ ID NO: 620 - DNA, 1227 bp, Homo sapiens
tttgccccatcagaggagagcagggtgaagccaggggtatttcatgacatggacatgtaaaagtgcacttgtatagttaattctttgcttattccagaatcctttctcacctccttagttctgctaaaaatagaggcaggacttggctgtttcacaacagtggcagttgaggttcctggtgagatcttgactcaccaaaacctcagggagatgagtttgcagacatcagtaaggcttccttacatacctctctaacatacctacaatggcctggcccaacaggctatgtttaggaatcatacagaaatatcctggcatgacatttgcattgtgggaaattatagactagtttgaggctactgcctgaggttcctggaagctgcaaaagctggtggcaatttatagtcctagagaaaggccaggaaagccacgtcccgctgagtcctggaagcagggataccctgaaggacgtgtccctgccacaggagaagaggcaaagctgctgtagggggcagaggccgagtcaatgtctccatctttctttgtctgatttaaattagaaaatacttatctctgtctacggccataccaccctgaacgcgcccaatctcgtctgatctcggaagctaagcagggtcgggcctggttagtacttggatgggagaaaatacttaactctgatgttattttatatgtcaatcatgcctttcaaattttccctaatatgcttactaccttataaaaatttaggacatatttccttattaaggaaagataggacctgaccacttgttgtcattgtcattattctgaggtttgcaagaaggatagaaataaatttcctggctctatgagctaaggaaatgttcatgaacaagagcaagagctatgctttcttttcccacttatacacagaattagtagcacagagaagcatgtgtgggatagagtcacagagctggtctgactgtggctgcactgtatcccgtgtgatcttgggcagacgaggcctcagccgatgggtccacggaactcagaccgctgggtgccgacttcgcccctcagttgctcccgatgaacatgcaatcaggcagttgactggatatcgaagctgagccaggaaagatcttctcccaaagcacaagtgtagagggcgcatggcggctttgcagccagcctgtggggtactggcacacgagccgagcacttgccaaggagctccgtggc

SEQ ID NO: 621 - DNA, 1165 bp, Homo sapiens
tgtttgaaaaacaaacaaaaccatttggtttgttggtttgttcttagaccttcacagtagattctaggtcacatgtttcagtttatcagcgaatgacatcctctccggaagccatgtcaacctcttgtttgatgatgtcagccgcagcagaaagaagcactccgtaggccccgtgctcagcaccttggcatgagctcctgccgtcttttgttcatgctcatcacagctctgtgcagtgggcgtcctcctgatccacgtgggaggatggaggatggaggcggaagggtgagtgatggcaggatcacacgaggggtctcccccgagatagggaggggagccggcccaagacctcagtgcccatcgcatccttcctcctcctcctcttcctctctgtgactgtttgactcaggctgcagggacagatgtatgtgcagagtgtgtgtgcacccctggggggtgtgtgctcatattggcatagactcgtgagcgcatacagagcgtgtgtgcacacctggggttgtgtgctcatattggcagactcgtgagcacatagtgtgtgcaccccgggggtggtgtgtgctcatattggcacagactcgtgagcatgtacagagcatgtgtgcacaccttgggggtgtgtgtgggtgttggcagggacagatgtgtacagagcgtgtgcacacctgggggtgtgtgctcatattggcacagatgagcatgtacagaaggtgtgtgcacacctgggggtgtgtgcttatgttgtttggtaagtggcgaatacgtggcccgttgcgtcgggcggccctgtgcctgtgttgagtccgtcagtggccccttgggtcggggtctccctctctgaagactgcactcaagtgtcttgaggtttcagattcttcctctccaggtacttgggcctcctcaggaccaaacgtcagaaccagccaactgaaaactacaagaacgttcaaatgcatcttcagtgggaaaaacaaaaacaactggaataatcttcccacatgaccccgtggttaagccgttagatactccagccgacagatttagttactataaaattcacaccaattaaaatggttttgagagttgcagagctttaccactaaacgttgaaataattgaagcgttctgctccacttgcttacaaagc

SEQ ID NO: 622 - DNA, 1227 bp, Homo sapiens
agttcttttatgcagagtgctttcattcgaagtgaagtgcccttctgtttaatggtgacctccagttattacagggattgcagccgcatttgatggatgtgaacctgctcatctctggctccccagcctcgcctctggggtgggcggcaggagctccacagccatcctgggtgctctggggcggggagtccctagtgggagtggacagtgcatggccgggacgttcctgtccgatgttccacactggcgtgtgcgcgtctctggcctgtttccttcgtccgtgggtctgtggcgttttctccatgcgtgcgtgtgtggcctgttttctccgtgcgtgcctctgtggcgcgtttcctccatccgtgcatctgtggtgtttcttccgtccctgcgtcggtggtgtttctttcgtccgtgtgtctgtggtgtttcctccgtccatgcgtctgtggcctgtttcctccgtccatgtgtctatgacgtttcctccctccgtgcgtctgtggcctgtttactccgtccgtgcgtctgtggcgtttcctccgtctgtgtgtctgtggcctgtttcctccttccgtgcgtctgtggcttttcctccgtccgtgcgtctatggcctgtttcctccttccgtgtgtctgtggcctgtttcctccttccgtgtgtctgtggcctgtttcctccttccgtgcgtctgtggcttttcctccgtccgtgtgtctatggcctgtttcctccttccgtgtgtctgtggcctgtttcctccttccgtgcgtctgtggcgtttcctccgtccgtgcgtctgtggcctgtttcctccgtccgtgcgtctgtggcgtttcctccgtccgtgcgtctgtgacgtttcctccgtccgtgcgtctgtggcgtttcctccgtccgtgcgtctgtggcgtttcctccgtcggtgcgtctgtgacgtttcctccgtccgtgcgtctgtgacgtttcctccgtccgtgcgtctgtggcgtttcctccgtcggtgcgtctgtgacgtttcctccgtccgtgcgtctgtgacgtttcctccgtccgtgcgtctgtggcctgtttcctccgtccgtgcgtctgtggcctgtttcctccgtccgtgcgtctgtggcgtttcctccgtccgtgcgcctgtggtctgtttcctccgtccgtgcgtctgtgacgtttcctccgtccgtgcgtctgtgacgtttcctccgtccgtgcgtctg

SEQ ID NO: 623 - DNA, 1173 bp, Homo sapiens
acatcttactggctagatttaggatccaaacgccgtcacggggaaggggctttcaggtcagtgaggtccatcctgggctcaggagtggggccacctcccccaaggtgcatggtgactggagagaggggtccctgaacaaaattggggccattaagaaagaaggggtaactaatacgtccactcagtacattcgagctcctcagccccagcctgctcagcctccagcccatgtctcactgtgtccttggcgtggccacctgcagtcagtccacatttcagatgggaccacccaccctccggcctggatcctcctgctcctcaccggaaccccatctccacgggcagccccgacgcagacaggcaagcccaaatcctgggccagtcttggttcttccccagatccttccgagagtccagcccggccatctcgtcgccagtctccctgccccgttctccacctagcccgagggttcttttgtggtagtgagcgcgccctgttcccttgctttaaacgctccaatggtttcctgcaggaagaaataaggtttagacgcgcgcctgcaagtcactccccaacccacctgcaacttcatccctgaccccacactctctgcccatgctgcctgggacctgctggccccttcccgtggaatttgtttctcccttcccagagatgcctggcgccctctccgacagccgcctgtccccggctgcttctgcagcactgagcaccgtttgtagtcgtctaattggtctacttctggcgtgagccccttgggcctggcacccgtgaatgctcttcccctgggtacctgcagcaccccctgggcaggggacgcttccgggtccattcctcgcccggtgtccagacgctgtggacaggtgccagaggcagctccgcagagggcgctccgcagaggccgccaggccgcgtccacagctcagccagtgcaggttcaagtcccggcttgcgcgcccctcccatccctgcgtggggcggcctcaccacgcacacctgccgccgtctgtgtcggcctctccctccatccctgcttgcgccctggatccccgtccgcctttttccgcgcagcagcccgggggtcctttgcatccccgctcaaaagcagggaggcacccacgcacctcgctcagagcagagaccagaatccaggc

SEQ ID NO: 624 - DNA, 1172 bp, Homo sapiens
gtccacacctggagcccccagagaccagaggcggccggcggggggccggccctcgccctcggccatggggaagcgtctcagccgagagcagagcactccccccaagtctcctcagtgaaaaccgtacgtctgggaggggtcgcagagcgctgtgttaaccacaaacgagacactctcccactcagtgcgagggcgagccgctggttaggagcttgcagtgtctgaggcctgtgggatcctcaagttggttttcttctgtgagttggattctccccctcttgaaaaaaaatcgatttttcaggatttaattaatacaaaccttattttaggttggtgcttaactggaggtgatgcataagtctgatttttttttccaagatagaaaaagcatttatcctaacaaattggtattttttattaagcctccatgtggctctgaatgcaagctatatatagtgagtttttctaaattaagggaactctgctttttttttttttttttaagtaactggtctgtaagtgcatatctctagaacgtccccgcagatgaatgagggccagtggccttggcagaggcaggtgtggcctcgtagaggcagtgctggccgcgccagggcatcagtgctgatgtgggagctgtgcttccacctaagccgttggtaggggactgtggcatttaagaatgtagagagcgcatcctttttgatctcctgggcggagtgaacctgcaggggccaccccagaaaccttggttctgatgcactgcaagcaagtaaccagcttctcactccagtttcaagtggctattatgtaatataaattcaaagcacattgtgaatagaacctacatgaaaacatacactttgttgcccactgacatgttaccagaagttgtaccatgatgttgttttgacccctgtgagctgatggccccggccctgctctgtgcacatttctgtccgtgttccccagcactctggttggagagagtccacatcttcagctccgtgtggacatctccctgtacctctgcatcagcacatggatttaagagttatgtaatcgtgagagaatggtgtttgtggtttttccccctctttggctggtggaggataaagttcctgctcttttacctccaagacgagggcctcattgattcacttccagaagtg

SEQ ID NO: 625 - DNA, 1207 bp, Homo sapiens
atctctgaggtatgcctgtactgttaataattcttgaaattaggtagtgatagccttccaactctgtttttcatagttactttttaaattccagttcctgtgtatttccatgcaaattagaatgaggttgttaatatctacaaagtgctgagatttttgttggggggttcactgaatctatagatcagttggagaacattgacatctgaacaatatccatgaacaagatgtatctcttacttgtttagatctttaatttctctcagaagtattttttggttttcagtgtactggtcttttacatcttttatccagtttataagtattttatattttttggtgctattgtaagtgatttttaaaatttgtatttgcagttgtttgttactagtatatcaaagcattcatttttatgtattgagtccaaacccagaaattttgttatgctcacttattagttttagacacttttttgtagattacattggattttctacatagatgattggattattttagaatgaagactgttttactttctctccaatcttgatgccttttatttctttatcctgccccgttgtactagataggccctccagtacaaaggtgaacagaagtggaaagaatgaacaaacgtttgggttgtctctggtcttacaagaggcactcagtatttcaccatgaagtataacgttagtggtggttttaggtctgtgccctttatatgttgatgaggcactcttcttttcctggtttgctgagagatttttatgaggaatgaatattgtaatttgtcatctatggagatgggcatatatttgttgttttttagtgtgttcggatgaattgtattaattgtttttcaaatgtgataccaacatttgtggtctaaacctctgtagatcatgatacagtatactttggatatactactggattccatttaccaaaactttgcttagaatttttacacctgggatcttggtttctagttttcatttcagtgtttttctttctatttaagtttttggaagaggttacgtattatttcaccctcatatgaggaagtgaaacaagtcatgtgggcaggagttttccttttttcttctttcctttcttacttactaaacttacttagtttagttgctcacagagtcttgctctgccacccaggcttgagtgcagtagcatcatcatggctcac

SEQ ID NO: 626 - DNA, 1211 bp, Homo sapiens
tgaatcaattgaagaagcttctggtatctttggtaataatacatcagggttgagtaaaccaaaactaacatgtaaagaagaggaagagagactttatttggagaaagatagtattgaccccagaattactgactgcctgggtccatgtgggacgagtgaacgtgcacaccatttcaaagaaggaaacgccaagtccactcttacacagtcgactttaaatggtgaaatgggttttatgggaaatgctaaggtgagttttgagaaaatagagtcacgtgacactcccagtggcaatttctttctggttggtgttgatcccaccctagcggacagatacacaggtgccccctgcgatgcagcgcaggggattcccgctgtccccgtggacagcaaagacacgattgtaccaagtagtggccacattttatcactcacagaaggtgtcctaaatagatgtgaacatccctcaaaagtggattggcagagtttcccagaaggagtctcccgttttttgagtgaattttcctattacccgatgggagggttaggaaacccagcattttctgaaagactggccagtggttgtggtggatatcaaatgggctatctctggactaatacagtcacaaaaggtgctctagaaggtgaaacaatatttagtgaggatctgcaccataagccacaggccttggaaattgctttgttttcagaaaacactcctcagctaccggtgtcagaggacggtgttgtttggggatggcatgatagagacggacagttcgtaagtatgttttctgtgtgtttactattgtgctgcggtatgctgggctatacattttaatttattattattattattattattattattattattattattattatttattttttgagacagagtctcacttttgtcacccaagttgcagtggcgtgatctcagctcactgcaacctccacctcccaagttcaagtgattgccgggttcaagtaattctcgtgactcagcctcccgagtaattgggattacaggcatgtgccactacacctggctaatttttgtatttttagagatgggatttcgccatgttggccaggccggttttgaactcctgacctcaggagatccacccgcctcagcctcccaaagtgctggcattgcaggcatgagccaccgggctggccaattttaattgtttttaacttaa

SEQ ID NO: 627 - DNA, 1199 bp, Homo sapiens
cccgcctcagcctcccaaagtgctgggattacaggcgtgagccaccgcgcccggccggtgtaaaatttatcttagccatgtgtttcaagatgaacaaggttgtacatgaaacgtttagtaaatttttgtaatttaaaatatgtagtactgtaagatattagtgttttaagaaggtttcagggccgggcgtggtggctcacacctgtaatcccagcactttgggaggccgaggcaggtggatcacgaggtcaggatatcaagaccatcctggctaacatggtgaaaccccatctctactaaaaatgcaaaaaattagccgggtgtggtggcacgcgcctgtagtcccagctactctggaggctgaggcaggataatggcatgaacctgggaggcggagcttgcagtgagccgagatcgtgccactgcactccagcctgggcgacagagcgagactctgtctcaaaaaaaaaaaaaaaaaggaaggtttcaaataaatggctcaaaagtagacccttttgatgtaattatgttttattttctttaattgcaggacttcatagacctcacgttgtcgaagactcaacgaaagactccaaccgttattcataaacattaccaaatacatcgcattagacatttttacatgagaaaagtcaaatttactcaacagaattaccatgatagactttcacaaattctaacagatttccccaaattggatgtaagtgacttaggggacttctgtggttatgtaaatacgggctttcagagaaccagtgtttaaccagtttggtgtactcatttgacagaaaaggaaacaaaataattgacttaggttactcagtaagttagtggcaaagaactaatttgttgaatttataaaagtgagaacagaatttgggttttttgattccctagtattctttctttcctccaaccaaaacccatctaaggaggccccaagctgtcttctcaggctttctgtgtaaaccctgggcttgcaggtgccaacccaagtgttaatgatagctgtgggttatgaacacagaagctagcagctcactggttgtctgggctttatctcttccaccttctttccaagggttttttttttcctctgggctcagcttgggtcagtggtgtaagatccaccactgtttgtgatcttgttgcttcatcagctgatgacagtcagttca

SEQ ID NO: 628 - DNA, 1169 bp, Homo sapiens
ctcctgcatgtccttgggggcgcagccctgtggtgctcaggcagagctctcaggagccggggcaccttgctgttcgctgctgtgtcgtcttctaatgtgagctcatccactgctgctgcagcgtggtgatcaggagtcacagacaagatcggggatggtgtgtgtgtgtgtgtgtgtgtgtgtgtgcacgtgtgtgtggctaaattaagtcatactgtcaaccacacgtgatctcgtctgaaacagtgtttggaagtgggaacagttttgtcctgtatgctgatgtgtccagaatttcatttaatgatagacggaaaatgtgtggttactgaaaactgtatatgatacagaatttcataagagccatgctgttgggcaaagcaactctttttcaaccactgctcatcagtttctgtagagacaaaaactctgtacatattttggaatctgaagaatcctatgtaaatcatttgttacttaagtctgtgaaaaacatatttctttggaggaaaatgtatgcatttataagtgttccatggaatcagtttttattgtatcgatataattgtctctaagtgttgactgtcttcattgcaatatgaaattcattaaaatgtccatgttccataattactattataaaagctttgtgttattgggagtcttattatttttatagtttttcatgttttgctttggtgaaacattgtgaatgactatataaacatcacgatgagctagaaattgaacaaatataatactggtcactcgaaaaatttttagacttaaaaagtcagttgtgttttgtgtctgtctcttatgctaacattaaacaatacataattatgttgcttcatccctcatcaggagcctgaaaacttccaaaagcgttaacagtttgacataatttttggtaaagttcctcagtataataaaatgctcataccgttctcattgcagtaagcttgtttgaaagttaaaaaaaaatacagttacagaaagtaggtgccattttctgtgggagaatgcaaaccagactgggagtggctcctgggggctcctggtgcatggccatgtctgacccacgcgtggaggctgaggctgtggctgaggccatggctgaagctgaggccgaggctgagaccaggactggtgctgtggctgtggct

SEQ ID NO: 629 - DNA, 1197 bp, Homo sapiens
cccctggccccaggttcctgctggttttacttgcaggtgctgtaaggggtgactggagggagaagcctggctgctggtcacaccgcttcccttgtcctggccggcatgctctggtggtcagtgggcttgtctttggttccacgtgcacctggttgagctcgttggccggtgctgaggcggctgctgtgacaccgcaggctggttcctgctccatgtatttaactgctggctgccgtgtgtctggctctgcaccctccctggctcctcctgggtgtcacgcgcctgtctttgtccatggaatgctggtctgggactaaaaacaggaaaatcacagtctttcatagctagttactaactcacaagatgaaaatgagaaaaatgtaaattctagcaccccatgtttatagtcggcctgtgtgtgccatccacctggcgctctctcagactgagaggagataaattagctggtgtctttcccagggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggtgagtggacacctgctcctctgtcctgcgggttttcgccctgtttcagagctttggaaccgacaggtttccctcttcactgtggcagaagtacctcttctcacagatcttacaggtcaccatctcaggactttttaggatctcaaaaaacaacagcaatgatcgtaagaatgctagtaatttaaccttaccatgtgccaggcacccttcgacctttcacacagatagctttatggaatcctcacgacagccatctaagccaggttttagatcatcccatttacagatgaggaatcaaacggccactcagccgtggggcgagccgggtccccagcagcctgggacactagcatccgcctttcagccctcacactgtgtccctccagctcgctggggtcctttaaaactgaagttgggccgggcgcggtggctcacgcctgtaatcccagcactttgggaggccgaggcgggcggatcacgaggtcaggagatcgagaccatcccggctaaaacggtgaaaccccgtc

SEQ ID NO: 630 - DNA, 1137 bp, Homo sapiens
tgcacgaagagtgtgaggggaaccacccctctgcgaggaaactcacagcccagaggagggcatccacagtttccagtgttactcaggtagaagttgatgaaaacgcttacagatgtggctctggcatgcagatggcagaggacagcaagagcttaaagacacaccagacacagcccggcatccgaagagcgagggacaaagccctttctggtggcaaacggaaagagactttggtgtagagaaggctctgtgtgttaactgatgggagagactgtttgtttataaatgtgtacagttttgttttctcgtaaggggagcatcatagggttactttataccagttgtaacattttcattgtttttggttgttcttttttctttttttaatggcagctaaagatatacagattactgttaaattgcagtccttttttttttaaagatattttcttgaattatttagaacatggtaagcctggtattttttaatcaaacaaaatatttatgaaatgggttttctcttaattctggattcatcatggctttctaataccaattgtaatatttacaatattcaccaaaacttagaattttgcaaatgctggaattctgccagtgtttctttgctaagccttgcatgcaaaatttgaaattttaacattggcacccaaaacctacatggaatgtatgtctggagtatttcaaactttacattgaaacataatttccttggaaaacaaaccataagcctgaggaggtttttatcaactggaatgctttatattagtttgtttttcactgtacattcctcattttacattcatttaacctgccgattatttaatttttttattgtaaagtagtttttagcatttgcttttatttttttactttgatgccttttcaaattggcatgtctttaaagtatttttcttcctgattaaaaatgtgtgtgtatgtgtgtgtgtgtgtgtatatatatatatatttttaaatcacattaattttaccaagtgaaaccaagccatactgtttttgagccaattaagaaaattgccatttttaaagtgtagcatttcagggtaaagacccatgaaatggcttgatgtattctagactactgaaagaaaaccactt

SEQ ID NO: 631 - DNA, 1394 bp, Homo sapiens
ttgaaggctgaaatcacccatgtctggcagatgctgctggctgacgacctcagttcctcctcacatgggcctctccctcggtctctccatgtgggctggtgtgagctgagagagagggagggagcgccaggcaaggccatattgcctgtcatagcctaactttatttatgtatttatttatttatttatttttttgagacagggtctcgctctgttgcccgggctagagtgcagtggcacgacctcagctcactgcaacctctgcctccctggttcaagcaattctcctgcctcaaccttccaagtagctggaactacagacacatgccaccacgcttggctaattttttttgtatttttagtagagacggagttttgccatgttgcccaggctggtctcgaactcctgacctcaggtgatctacccaccttggcctcccaaagtgctcggattacatgtgtgagccactgtgcccagcctcatggcctcatagtctagctttgaaactcagctagcctgtggttccatagtgtagtggttatcacatctgctttacacgcagaaggtcctgggttcaagccccagtggaaccatggtgtggtctgttgttttcctgcctgtaatcctagctcctcgggaggctgaggcaggagaatcacttgaacccagaggcagaggttgcagtgagctgagactgcgtgaaactcatctcaaaaaaaaaaaaaaaagtcatgcaacgtcgctttgccacatccatttgtcaaggcagtcaaagtctcgcccgggttcaaggtgagggaagtagactccacctcttgatgggagtggtaaagttctggaagaacaggtgggagtggaaatgcgggagcacctttcagacatgggctctgccatgtttcccttggctgagttactgggatggcctcatcactggccttgctacttccactttttttttttttttttttttttgagacagagttttgctcttgttacccaggctggagtacaacggcgtgatctcagctcaccgcaacctccgcctcctgggttcaagcgattctcctgcctcagcctcccgagtagctgggattccaggcatgtgccaccacacccggctaattttgtgtttttagtagagatgtggtttcttcatgttggtcagactggtctccaactcccgacctcaggtaatctgccctcctcggcctcccaaagtgctgggagtacaggcgtgagccacaacacccggccctacttttttgttttcttttgtttttgtttttgtttttgagacagagtctcactttgtcaccaggctggagtgtagggggtgtgatttcggctcactgcaacctccacctcctgagtttaagcgactcttctgcctcag

SEQ ID NO: 632 - DNA, 1255 bp, Homo sapiens
ttgatagcttaaacatggcattgggggttgttgtagtccatgaggcttagtgtgaacgatttcctctcgggctggagggtggggtgttctgagggaaaaggtgcaggaggaggctagaaagctccaagccagatcttggagattcttgagtgatctggtgtaaagagtttggtgctggctgtggacactgagaaacggtttcacttttcagttcctgtcttggctgtcatctaagctggggtttgtctgtctgacttcctccattcatttttcttcaagctatagccattggttgacttctctaagtctttgattttgttcattctcactcttccagataacctagttatttatcttttcattaataggaccacagcagtcaattctaactttttatcagctgaattaatttagtaatggacattgaaaatgccagtttgtattcaaatcattttgatgaactatattaattgcctttggaagctctgccactattttatactagcattatatgtaactctaaagaattaacctttggctcccccattttttttcttttaggtttttaacaatcacttttttcaagtgactattgatgacctaagacctgaaccaagtaaactgtcaatgctgtgccatgcagattctttggggattttgccagtacagtggtgccttaaaaatggagtcagcctcactcctcccaaaggtttgtattctgtgaaggtatgcagggtctggagattcaggagggtgtcttactgtcattgaagtaacacctgcattaatctggggaggctggttgtgtaaagggtttagatgtagtagaaatagggcgttcttcatcagcttgacataggtgtcagttacagctccatcccctggcgaggcgagtggccttgggcttctcacttctgtccacaggagtttccccatccgttaccgcattattggcagatgtgctgctattgtgtagacttagagggtgcagcattgctaagtgattgagctcaaagacttgaaagtgtctgagaagtggctttacaaatgtaacacaatgttggtgaagcatttctttagagtgtttatttccagcgagctaagctttctccagagtcaatttgctttcagatatccgacaattagatgctataatactttaaaataattacactgggagccaggatgcattaaaataattttaaattgggattcaagaaccacattgttagtgaatgccagtcttagagtttac

SEQ ID NO: 633 - DNA, 1211 bp, Homo sapiens
gcctggggaaaaatatgggcaacatgtggtgtgttaagcaacatttcaagtgtaaatattaaacttggtaaattttaatttaccttttaataattttctgacttacagggactatttttagcagatgagagcttagagatttagtgaaaatatgttgtcataactgcaaatgccagactagagtcgtttgtagtttagaaatgtatcagataataagttcctcatcagtgggcattgctttcctaggtgataggtggaattttggcccatggatgactgaaggtttttgctaatgtgattaataccattaaattacttacagaatgccaactaaatgcatacaaatgttccctgaagaagagctctattaagtttattcttcatttctgacagcagaatcccaagttgctatttaatttcagaaagtcctttcagcaggtggctgctcatggtgggtatggggtgtgaacactcacggtcactgaccgtgctgaggtatcaggaaagcctgggaattagcatgcaggaaagagtcacccggcagaacgtgttagtccttcaactcttctgtgatttgctgttgatacagaaatctatcctttgaagatggcctctgaatggaaatgtactctggaaaaatcccttattgatgctgccaaatttcctcttccaatggaagtgtttaaggtaagatgttgattcttagcaatgtatctaccctttttgagaataaaatcatctacaaagttttccggccgggcgcagtggctcatgcctgtaatcccagcactttgagaggctgaggtgggcggatcacgacatcaggagatcgagaccatcctggctaacatggtgaaaccctatttctactaaaaatacaaaaattagccaggcgtgtggtgtgtgcctgtaatcccagctacttgggagtgtgaggtaggagaattgcttgaactggggaggcagaagttacagtgagctgagatcgcaccattgcactccagcctggcaacagagtgagacttaatctccaataaaataaaaagttttccataccaaatccttttccacttgaaaaggcaccttcttaaccagtttccattttaaatgcttaaggttttatctgtttcatgttgctttttaaaaaaataatcttcataatgacccatattacaagatgctgattaaaattgtttaggtttactgacttt

SEQ ID NO: 634 - DNA, 1193 bp, Homo sapiens
gggatggggaacccatggatatggaggggactacttattctccccatttctctatttctccatttcaccttcagtccacccctcttgttattttgtgcccatttctctgcaaattccttcttcttctgaaactgtataaactgttcatgtaattcggggcctggtttgattttcccacctggaaagcctttctctgatttccctagcctcactggtttctctctccttggaacctcctgaattgtacactttataatttctttgtggtttgtgaaaagtttctaaataggctgtaagacttcggattctttcatctccttggtgcccaagcatgtggtatgtgtcaagttgctacttagagacacattttcagtctcagttttagtatttacttaagcatggtgatgaaagttaagaaaaacattgaaatcaaacctacatggagaaaactgctgtgattttaagttgattggatactttgctgctgtgttgaagtgttttttttgttttgttttgtttttctttctcctttgtcttgccagcaatcaaagagaagtacacagactggacagaatttctcatacgtgacttgactggttcgaggacagcacccgccaacctcctggaaggtgtatgtattgttgttatacatctaatgtatctctgaagcaccccagttacgtgagctcagacctgacagcacctttgcatatatccttcagcagatgcgtgctttctgcagacactgccatccaaatagcctcccttcctcttttgtcctgaattacttaggtgactgatttgaatggcattgatgaaacttcccctgtgatgcaatcagcaaatggaaaatttgctctatgtgaatccaatttttaaatcacaatatgctaggatgtcttcctactgtcctatatctttaagcctctttcctatgtgagtgaatataaatcaaatcctgtagaatcactgttttgaacaggtgacaagatcatgtatgtgctaatatagtctcttggagtacattgataagtcgttccattaaatgttctattttgacgcataaccccaagatttgaacatacacacgttaaccaataattgaattaacttctcttgtaaaaacaagaggagaaatggcagatcgtatttcagtgtagccaaggaaattttaatgtattgaagaaaacata

SEQ ID NO: 635 - DNA, 1255 bp, Homo sapiens
taaccctctgaccctccggcttgtttcatttataccgcggggcaagatggtagagaacacttaccacatgattggaagtactttgaggaagaactagataaaagtgagtcattaattaattgttaagagtcagcagctgcacactcaggcgtctcgtttgatgggaaagggaagcaacttgagtgaatttaaatcacttcgcatgtatgacagtgtattaaagtaatgagccatgcatctggccaagttggcgttgtcaagctttgactttctctgtctgtctctctctctctgtctctgtctctctctgtctctatgtctctctctctgtctctgtctgtctttgtctctctctttctctttctgtctctctccttctctgtctccctctctgtctctctctctgtgtctctctgtcttcatctctctctgtctctctcagtctctgtgtctctctcagtctctctgtctctctctcttagtctctctctgtctctctgtctctctccctctctgtctccctctgtgtctctctctgtctctctgtcttcctctctgtctctctctgtctctctctcagtctctgtctgtctgtctctccctctctctctctctgtgtctctctctgtctctctctctctgtctctctatcttcctctctctctgtctctttcagtctatctctgtctctcagtctctcagtctttgtctctctctgtctctctctctctctctgtctctctctttggtagcacctagtttaattcctgtagcttacatgctacaaaaagattttacaaaatccagcaataaacaaaatgaaacttcctgatataccataactgatacctgtgactctgggaatttcttaagacatccggaaataagtgtacctttgtacgtgaaggacgtttgttttccccaagatctaggtcaaattaagaacagacttgtgtcccatccagtttgagataggctggttggctttctcagggaccttgtgtttgcagctctgtgacagtattcagttttaaactttggatttctttctcctgaatgagcaaaagtaatgcttttgcagaacgccggggaattaattgctgctaagatttgaagaaagacatgtgcacagttcctagctctgtatttttaccccaggagtactgcgaacttgatgattttggtttagtgacttccttgccagcggacttacgttttttgtttgcatgttgactgctttgcctagaagttctga

SEQ ID NO: 636 - DNA, 1194 bp, Homo sapiens
ctatgaaggattctgcagggtgaatgttgacatgaataactaaccagcaaataagtgtcaattaaaaattctattaccataattggccgtggcccttcctcatcaaagtacagtatgtttagatcaaatttaattttttttgagatgcttgcctgcttagtttcccaatttatctcctctttctgctaacaaaagaagctgttttccatttagaggggcatctttctacgctacctacatgtgaatactatgttcaaacactataaagatttttaagtgttttttaaaaacaaagagatttggtcatttttgcgggtttcttttctccttctaaatttcatggtcccttttatcctttcttcatggattctctacttttctttctcaaaatttccccttttcctgagggatttttgcttccagctgatgtgagggctttgatggtgtggtttatgtgttaggattacaactgctgttcccaaaaggccctaaaatgctgtggctcaagttaatttagaagtttactgctctttcttccaaattccatgtctgcatggtggaaggctggttctcctccaggttgcccagcaagaaagagggaaagggagaggctggggacagcagctcacctcccactagcaaaactcggtctcctgggattccaccaggccctacctagttacaaagagactgggaaaggtactccctagctgtggggctcctccttgctaaaatccctgggatggggaggctgcttttcctacaacaaagaagggagggaaaaaagccctgggggacagttagtctctgtcacaactcatttagctacacatttttgttttgttttgttttgttttgttttgttttgttttgagacagagtctggttttgtcgcccaggctggagcgcagtggcacaatctcggcttactgtaacctccacctcctgggttcaagcaattctcctgcctcactcagcctcctgagtagctgggattacaggcgcctgccaccatgcccggccaattttttttttttttttttttgtatctttaatagagaaggaggtttcaccatgttggccaggctggtctcgaactcttgacctcaagtgatcctcctatctcggcctcccaaagtgctgggattacaggcgtgcaccaccttgcccagcctacaaaaaatttttaaagat

SEQ ID NO: 637 - DNA, 1198 bp, Homo sapiens
tttgagttcctagaacagaattgctgtaaaagaagaactaaaatcagttttgttctaaaagattaaacaataaccttaaattttttagatgcgggcttaaagctatatatatatatatttgtccgatgatacctaatggtcactattgtcatgtctaccaaaaatttaatagcttggtatgtcattgaagcgtgacagttcaaagccatgttttaactttctccccaataagatatatctgttatttcctcttccaagcccaaattccatcatttgtaaaatgggaatagtaacctccattggataattattataatcaaattagatataaatgtcgtatatttttacagatcttagatatgattttccaagggcaggcccacatttacagtctgttcctgaaaaatctcagcactgaatgtaatggttgtcatactttgttttctgaagaaacgcttacagtacagtaaatatatgcatttgcaataatatcctccggaattctttctaatctgggaattctgacatgctttgcacctgctagggcgtagtctgtgtctgtctggggcttttactgctttctggttaagtgaggctctcctctgcctttcccatggaactgcgcagaagctgcacaggccagaccttgtgaatatgttcttgagacagggtctttccctgtcacccaggctggggtgcatatagcttactgcagcctcaaattcccagactcaagcaatcctcccacctcagcctccttagtagctgggactaccagcttgcaccaccatgcccagctaacttttttttttttttgtagagatgggctcttgctgtgttgcctagactggtcttgaactcctgggctcaagcgatcctccccactcagcctcctaaagtggtggaataacaggcatgagccaccgttcccagcttacagtcatcttttaaatgtctgcatttgtcttccatcattttttgatctgcttttagttgtagtcatctacaggtttaagtaacttttaatcttttttgaacccttagtcatattgaagatgttttatttaaaatactacttaaatgtagttattcgtatctagttttaccacaggaaaaaagtataataatatttctctctccctgttgtgtgtctcccctatctctttctcactctttttttttttttgagcactgtgat

SEQ ID NO: 638 - DNA, 1152 bp, Homo sapiens
ccctagttttatgattaatgatctgaaatcattctggattgaacgcatattaccaacttctaaaaaagtttttattaatattttcaaacataaaagagtaaaatgatacactttcatctgctggcaacttggatagatttaacagttatcaaaatgttgccatacttgattctttttgtctttttattcccaacgcatttccaaacaaattcaaaacttaatatcatttcacctctatattcttcagtatgcaactctaaaaatatggttattttctcatataatcacaacgttattatcatacataaaatatacagacattttccttgttaccatctaatacctggtccatattcagatatctttatttgtctcaaaaatatcttcaacagtttaaccaggatccaaaccagacttatatctcataaggacttgtaatctagacctgttatttttaatccacactcctacgctcctcctccttttttgcaggggaaggggatgagttcttactctgtcgcccaggctggaatgcagtggtacgatcataactcactgcagccttgaacttctgagctcaagccatcctcccacctcagcctcccaagtagctgcaactacaggcacatgccactacacccagctaatttttttattttttgtagagatggggtcttgctgtgttgcccaggatggtctcaaactcctgggctcaagcaatccttctgcctcagcctcccgaattgctgagattataggcgtgagccaccatgcccagccgcttcctttttgccatgcaattgatttgtttaagaaaccagatcttttgttcagcagaatatctcactttctggatttgtctgtttacttcttcgtagtgtcatttaaattattgttctatccctgtaactggcatttagtcctaagtgcttgattagatttaagttcattctttttttcttaaagggtattttgctgctatatacttcttattacttcagatcagtaggcatggaatgtctgattgtcacattcttagtgatactgaatgatttcattgggaaattattttttaatctagtcattcctttcacatgtattagctgaaattcatccctaaaggtgaacctcagcgaccctgaaatacacctc

SEQ ID NO: 639 - DNA, 1169 bp, Homo sapiens
agagggcacacaagagatgccacaatcgggaggcgggtagcgcatgggaatgaaaacctggagagatggagaccatggaactccagaaaagagaatatttataaaagaagggagtgagtgattggccgaatggcatagccaagacgtgaagagaatgcagagggcatggccttccggaggacgtgttgacctttgtaggtcattgtcacaagagtgacagcaggaagccaagtggccgctggccaatggggaaaataaggcctaaagaagctgtcttcagatcatttagtacccctgcttgaaactcctccctgggcttccacaagctgagggctagaaggccaagggcatgaggcgatgggagctggggctgctgggctggtcctgctctgtgcatgcagccgggagtggggatgtggagcaaacatgaacgctggggtggcccacagtgaagtgaatccaaatacccatgtagtggacagccagggtctgtggctgacacacgcattgggctccttttgtcttactcagcattccttcttccgtgttctcattgcttagatcttgacaaatattatacataatctggggatgaatgaatttttccatgcttgaaaggaacacctttggaaacccctgaccagggtaaagcaaggatcccaacgcactgcgaacagctgggtgacggagtaccgtttacatcttcacagaagtttttcaccatttctccaatcattctgtgttttccagcaagtttctatagaagtatgctccaactcactccgtcgtaagcacggcttctctcctgagtatgctaaactccccaaacgcagcaacaacacagcgttccgatctttggaattaataagcagtgaaacgtttgaaactgaacaaaaatttttacagctactgaacttcctgtaaggaaggcatgcttagtaaactgcactctttctgtaatactgtgaaatgggaggtatttacgttggagggctgattgctggttcttcatatgatgttttgaagtggaggtttctattaatgatgcctctgttgagcacatctggtatatttctgaagagaggctttgtaaacacattgggcaggcccagcttgtaagtgacaaggcagcacagtgagggtgcagtggagaaatccaaggaaataag

SEQ ID NO: 640 - DNA, 1125 bp, Homo sapiens
ccccatctccctctcaacctcaacccacctgcatgcatctcccccagaggaaacactgagggtaggggacaggaggctcaggacgcgccctctgaatcgagtgtttcttcttcacaagtcaccaagagaggacatgagggggaaagtcctttttgcccttctccaaaaaataaccttccacagagacaaactgtccttctatccacttttatcttttaataaatatcaaaaggaaaaagctgcaagggtgcaaagggcctgtgccagaagaaaacacacacagggaaaccgctttttttaatcaattgtagagaatagtcatttttaatctaaattagagaattgtgatacaatggcagtcctcaaaggcgtaacgagttcatctttctttcaccataggggttatagttggcttgtgctactctggaatcattttactgtttgtttttattatcttaagtgctaattaaaaaaaaaataaaattttaaaaaaacctgtagtttcattacctttttgaataatgtcatacaaaaaatgtatttgtttttttgtgctgtgagaattgatgtttgtagattaataatcattttgtttagaattacaaaatagtttttaaatattgtctgagaaaagccaaagttaatgcaacctagtggaaactgtaagaccatttgagtattgtttgttttattgatgcatttggattttgttgtttgatggaatttgagccaaaaaaaaaatacgcaggctttcctatttctacaactgattgtacttatgcattttgtaccagtggaactttttatactggagattaaaaaaaaaatggaaatttttgtggcttgctctggtgggcccctgacaatgactgatttcaagtttgatttcgggttgattgattgattgattgatagaaagaaagttgcttttcttttgagaattaaaaactttggcttgatttcttttttccctttgcttatatctagcattagaattttgtcttaaaataacagcggtaagtttcactttttattctgtattgtgcagttacacaataaggtaattagatttagaagtactcagtcactttaagtggataaatgtattagttaaaactttagggt

SEQ ID NO: 641 - DNA, 1179 bp, Homo sapiens
gtcacccaggctggagtgcagtggtgtgactcattgcagtcttgacctgggatcaagccatcctcccgcctcattagcctctctagtatccggaaccacacaggcatgtgcctccatgcctggctaattttttaaattttttgtagagatgaggtctccttatgttgagtaggctggtctcagtctcctggactcaagtgaacctcccgcctcagcctcccaaaatactgggattacaggtgtgagccacagcccccgcccttagatcacaacttgtcttggaaataaaagtggcatttgttcatataatgcaaaattattttcccagtgccatcaaatttaaatgattttaacactagttattctaagtgttaatatcaaatttaaaataattttaacactagttattctaagaatggatcttccaagttcagtttgtgaataagctttgtgtggtgaggaacctgctatatatttaaagtactgttttaatattttcaaaattatgactttctatagcccattgtttgtgaagtctcacactctgaccatgtgaggatattgtgtgtgtgtggaagagtgaggggggtatgtatgtgtttgcatttgtctttctcccttagtgtttcttgccaattacttaacaaatatcatctgcatggtaactgggtctgggcgctttgcatctagtaaataggctctaaaagtaagacatgttattatattgagttgccatccagtaggcagtatcattccaaaaggcatcttgaagaaagccgctcttccctgtcagtctttattttgctttcccgtgggattgtgttgctgatctgtcttgaggtacaatagaatgcaaatttaactggtatgtaattgtgtccaagactgtccaattttaggaagtggtcatttcttttaaacctatttgatagcttaccttcagcaattattgtcactagactaatctataaaacaatattaattctactatcctaactacttagaatgtagtttggctcattattaagggtcagtttatacttagagatgtttgtttctatgtctgcctatgaaattttataactaaaggttactttctagtgtgaaggtggtttcacttataaatgtgtggaattgaagctaaggatgaaaatataaaatatgagatctggaacatca

SEQ ID NO: 642 - DNA, 1230 bp, Homo sapiens
tttatttttaattttatttatttggtttttgagacggagtttcacttttgttgcctaggctggagtgcagtggtgccatctcggctcactgcaacctctaccacttaggttcaagcaattctcctgcctcagcctcctgagtagctgggattacaggcgcccgccaccatgccaagctaattttttgtatttttagtagagacagggtttcaccacgttggccaggctggtcccgaactcctgacctcaggtgatccacccactttggcctcccaaaatgctaagattgtaggtgtgagccactgcacctgtcgaatgcctttttagagtgctgacactccaccgcccttgacagtgactctccttgtctctattagattgttacaggtcagactgatttttgtttcttctctttcttgggcagagctcgaaagagcattccagacacatatgcagagcacctcattgctggcggactcatgacgcaggaggaggtgtctgaaataaaatcctcctactatgccaagttgaatgatcacttaaataacatggcccactacaggccccctgccctgaacctgcaggcccactggcagggcctggctcagccagaagcgcaaatcaccacctggagtacaggtgtgcccctcgacctcctgcggtttgttggcatgaagtctgtagaggtgccaagagagctgcagatgcacagtcacctgctgaagacacatgttcaggtgggcagcctccaaatggctggttattgcttctccttcctgctcagcaaaggagctgacgttggtctggtgttttcagttgtctgattcatttgacaaatatttattgtgtgtcgttaggttctagaaactgatcctagtgttgttttggtactgatagtcagttacctcagattttctcttcttttctttttcctccatgtatttatttatttatgcatgttcatacattacatgtacctggaatacatgcacactataagaaatacagagatacaagaatgtctgtttttatttttccaaccagtgagtagaaaacactttgtttcaggtggcttaaataaaagaaacaaaagtcaacacacataccccaaggtagccccctaaacatgctcatgttttacgtattgtcttaggatcactataggatgacaaaccaccctggtggacctgggacttaggggttttctggaatgtgggactttaagtgcta

SEQ ID NO: 643 - DNA, 1192 bp, Homo sapiens
atcacttgaaccagggaggctgaggttgcaatcagccaagatcacgccactgcactctagcctgcgtgacagagtgagactgcctcagaaaaaaataaataaataaaaactgtatataattgctctccttctctaatgtatccttttgtactctgtttttattcagcattgtttttgatgcttaatttcgttgctttttttttttttttttttttgagatcaagtcttgctctgtcgcccaggctgtagtgtagtggagccatctcagctcactgcaacctccgcctctcaggttccagtgactccctgcctcagcttcctgagtagctggtatcatagagacacgccaccaggcctagctaatttttgtatttttagtagagatggagtttcaccatgttgtccaggctggtcttgaactccttacctcaagtgatccacccgcctgggcctcccaaagtgctgggattacaggcatgagccaccatgcctggcctgcattaaattttttgtactcattgtgaaaaaggaaatggactcttagacgttccttttttttcttcctctgaattttacagtccagaatggagaagatgatggacggaatcaagctagactgggccaccgcggaagctcttgccttgggttctttacttgctcaaggtaagaattttcttttttttttctgttttttttttttttgagtctcaccctgtcgcccaggctggaatgcagtggtgcgatctcagctcactgcaacctccgcctcccaggttcaagcgattctcctgccccagcctcccaagtagggcgcaccaccatgcccagctaatttttgtatttttagtagagacggggtttcactatgttggtcaggctggtctcgaactcttgacctcgtgttccacccgcctcggcctcccaaagtgctaggattatgggcgtgagccaccgtgcccagccaaggtaagaattttctgtctagctagtagagagtacttttaatcacgtttgctacctgttacctttgcagtttatttgagttataactacctcccattgtgttcattgaccagagaggttctaaagcatgttaatttttctttcctgacaatattacttatttgtagtataagtcatgctgacaaccttcatcagagtatagacataggacagttatgcctgggaaaca

SEQ ID NO: 644 - DNA, 1192 bp, Homo sapiens
attctggtttttttgtttttgttttttatttttgagacggagtttcactcttgttgcccaggctagagtacaatggtgcaatctcagctcggcacaatcttggctcaacacaacctctgcctcctgggttcaagcgattctcctgcctcagcctcccaaagtgctgggattacagagcattctgttttttaaattagaaatgttatgtaggaagcaaaacatgattatttaatgagtgtgacttatatccaggaaagttatgctgttcaagtatttatttagcattgttaacaataaacatgacttttctaatgagatggaactgttttgtcatttgaccagggcaggaattttttttttcgagacggagtcctgctctgtctcccagactaaagtgcagtggtgcaatcttggctcactgcaacctccgcctcccaggttcaagcaattctgcctcagcctccccggtagctggaattacagggtcctgccaccacgtccagctagttgtgtatttttagtagagatgggattttgccgtgttggccaggctggtcttgaacttctgaccttaggtgatccacccgcctcggccttccaaaatgctgggattacaggcgtgagccaccacgccccgcccagggcaggaatttttaatgaaaatcaggttatttggaagctttctgatccccagtgtgttcgcatttggtagaagatacgtttccttaaagaataactgtcagatgtggtggctcacacctgtaattccagcactttgagaggccgagatgggcagttcacttgaggtcaggagtttgagaccagtctgggcaacatggtgaaaccctgtctctactaaaaacacaaaaattggccgggtgcagtggctcacacctgtaatcccagcactttgggaggctgaggcgggcggatcacgaggtcaggagatcgagaccatcctggccaacatggtgaaacgctgtctctaccaaaaatacaaaaattagcagggcgtggtggcaggagcctgtagtcccagctatttgggaggctgaggccgaacccaggaggcggaggttgcagtgagctgagattgcaccactgcactccagcctggcgacagagcgggactccgtctcaaaaactaaaacaaaataaaacgacaaaaattagccaggcgtggcggtgtgtg

SEQ ID NO: 645 - DNA, 1191 bp, Homo sapiens
agataccatgcagcaccgaccagcctctttctccctgcaggactgaaggacgtacgccctctcccggaatcgtctcagctacagagaaccaccttgcccaaggtcaccaccctcttgccaagggggtcacttggatctaatgattggttaatgctggggggagggggtaagtcttggcccccagcctcaacagtgatggcggtggctccggggtcatcctagcttccgagtttcgtctaggttgagggcgccatgttgggactgcatcagcttctctctctgcctggttctgcttcctttactttaccatttgttgttagtccagggcacaccccagtaaacttcctgcatgcgagttcatcttagactgcttcccagggaatcgtatgtacaacactcgggagtagagagtcactgaaacggccctagctctgagagacccctcctgaccagccatcacccctcccgctcttccttactctgatttattgtcttcgtagaatttaactctcaggtctatggccatactgccctgaatgcgcctgatcttgtctgatttcagaagctaagcagggtcgtgcccggttagtacttggatgggagaatttagtgctcgaacactattgctgtagctttctttaataaataaatttgactgcctttcctgctagactgtaagctctgtgcatgcagggacatagtctctcttgttctgcagagccaagagcagggcctggtacctgacaggcactcggacaacacgtactgaacaagtgaatgaacttccaggcaggaagagtcacacatcctcaccaacaactcctagggtttcagagaactagaaagtctaggaatacagagggtgctttcaaaagtgttgtctgtaattggaaatgccttatgtttgtttagtgctttagttttattcatttttttttaaagcagttcattcaatattgatagcaacccatattatcataaacccccatgtggtgggcaagatagagggttgctttgaagcactgggagaagagaaaccggccttggtgagttgagtctcttgctcagccaggcccacatggaaatgctggtatcctgcctcctggacccatggtcctgtctctgtatcatcagcagaagcaaactcaagtcagttgccactgaaactcaccgagtctgactttcccccat

SEQ ID NO: 646 - DNA, 1089 bp, Homo sapiens
gagatagaaagactacaggctgagctgtccaatccccatgccgggatcttcccacacccgtcctcacagatccagccccagcccctgtcttcccaggccatctctcagcagcacctgcaggatgcgggcacccgggagtggagccctcagaacgcatccatgtcggagtctctctccatcccagcttccctgaacgacgcggctttggctcagatgaacagtgaggtgcagctcctgactgaaaaggccctgatggagcttgggggtgggaagccgcttccgcacccccgggcgtggttcgtctccttggatggcaggtccaacgctcacgttagacattcatacattgatctccaaagagctggaaggaacggaagtaatgatgccagtttggactctggcgtagatatgaatgaaccaaaatcagcccggaagggaaggggagatgctttgtctctgcagcagaactacccgcccgtccaagagcaccagcagaaagagcctcgagccccagacagcacggcctacacgcagctcgtgtacctggatgacgtggaacagagtggtagcgaatgtgggaccacggtctgtacccccgaggacagtgccctgcgatgcttgttggaggggtcgagtcggagaagtggtggccagctgcccagcctgcaggaggagacgaccagacggactgcggatgccccctcggagccagcagccagcccccaccagagaagatctgcccacgaggaagaggaagacgatgatgatgatgaccaaggagaagacaagaaaagcccctggcagaaacgggaggagaggcccctgatggcgtttaacattaaatgagctatcgcagacccacctgactgtggaatataaaattgccaaatatcctttctcatggaagcgcgtacccgttcgtggaggaaacggaacggcagcccagccgtgggacggacgtggacgtttactgcattcctgtttgccgtgtaaatgttagaaaggaattaaagttattactcggaataaaggatgactttggcggatgtcgcccctgcaaggaggtggctgaaagtggtgtccagatgt

SEQ ID NO: 647 - DNA, 1128 bp, Homo sapiens
atttgattgcagaaataatgtgtggaataattttcctaacatccacctcaaccacccaatacgtttttaggctttttacaacaaatattgtcactggcacacacactacatagagtcataagtactttcatttctagcatcaaaattcattttctgattcaaaatgtagatgtgttcaggtctgtatgttggggttcattgggaaagtaggattgaccagaggagtgtcttgcatacattaattgagtgaaagcattttagaggagaaacagccgtgatagtcaggaatcttgaaatccagtgatctcctctaatcccattaaacgtgattgtataacaataccatctgttaaatgcatagctcaggcattggaaggtggaggaggggcggtacagattttgttgaggggcagaaatcctacaggcaagaaaaactggaggaaaacatgggcagaaggccaagactatcattgtctcatccgggcccctactatataattatatcatgaagccatttcagacaattacactcaatgaaataaaataacccattatcttttcaatgagtgctctgtgtgtgtgtgtgtgtgtgtgtgtgtgtgtgtgtgtgtagtataagcaaacaagtaacacagaacctgcgcatggaaggaggctttatccaaagggaatactgcatttcaattaaactttaagctccttgaaattgttaatttgaagttcagttgaactaggttcaaacattatagtcaaagtttatttttacttctcaaactgctactcaagttttgtgtgaaaagccaagcattatgtttttattgactaagatattcatagtttcatgataaacacattagaaattagaatattaaattttgggtaaaaatatctcatgcatgtagatcaaattgaagtaattcaactgggagagctcttggacttcaattgaggagtgttgtcaagtagaaatgaaaatgagtggaaagtgaaaaggcctgagttctagaaccagttctcccacgtgtgattttagtaattccacctctctgggtcttgccttccttatcaagaagtgacaaaggtgcatggattactcctcccagggtctttttaattctacacttctct

SEQ ID NO: 648 - DNA, 1189 bp, Homo sapiens
taacagtagttatattggctgtgaaataatgaatatccccatctcacttctcaaatgttgtgatgtagttatacttttctacttgatggttgttgcccttttgcggaaaaatcagaagcgcttgattagcatatttgtagactttatgcctatgtaaatggaatatgacttagttttttgttgtaacaccttgaattgtttattggtgccaggtactgtgctaagtgcattacatagattttctcatataatcttcgctgcaaacttttaaagtttgtacagttatttttagttagtaatagtggagccaggattcaaacctaagtttgcctgataaaaagcagtcttcctaatctgtacactaatactttcaaacacaggtgaggaaaagtcgtcattgtaacctgttttttcttggacctgccctctagagattcagagagaataggtggagcccaagaaactgcaatttaaacaagtcaggtgactgggatatagctaccgttgaactacactttgagaagtagacacttcactgtgcagctttttatcaaataaccaatgtaacatcgttgactcgcttaaggggaagtttagaaatccatttgtcttttcttctgaatcttgtacctttttgagttaaacttgagctcctgataataaagtgatgactctaatagtgttaatcttgtgtcacagatgaagactaagggaacagaaccacttttatatttagatttcttttacctgaaggaatctaaatgaaatgtagacttgttcgtgttctacagggctttcactttgtgaatagagcagtaagtttgtgtgcttttcagttattctgttatgtgagttagttcttctacttgtcagaaaatatgtattgtggaagaagaagaattttatgaatctagaatcaagtttatagcagtatactctgaataaataactgcacagttcctgtcaaatgtgaggggaacccatttgacatctttacagaactagtcaaaagattagaaagggagtacacattattttttcccactttaaaattgaagaatgatatgatgtatggttataatgcatttcactaattattgctttaattgtgtaaaggcatttcttttgaagaagctcctgttttcttcggagaagtcttcttggcgggattgttcaggtatgatagctg

SEQ ID NO: 649 - DNA, 1167 bp, Homo sapiens
tctttgtatctcccatagaccttacctgcctcgaataacatcttacacttattaactgcttaatacatatttatcaaatccatagtaactttttatttcatcctgttgaggcttttcgccctccattaaaagggtttcttgggagggagcggtggctcacgcctgtaatcccagcactttgggagatcgaggcaggcagatcacttgaggtcaggagttcaagaccagcctggccaacagagtgaaaccccatgtctactaaaaatacaaaacttagctgggtgtggtggcgggtgcccgtaatcccagctacttgggaggctgaggcaggagaatcacttgaatctggaaggtggaggttgcagtgagccaagattgtgccactccactccagcctgggtgacagagcaaggctccatctcaaaaaaaacaaaaaaaattcttcttatggttctgttctttaaaaaggtttctttctatggttctatttttatggtttatctttacttacaatttattgttcttgattcttttttttttaacttaaaaatgatgactgacacttcctaatttatgattaagaacttcccttcacaacacccccgcctccatttccgctgctaacccctcatatgagtgtgttcagatgagatcttgttcctggtctggcttaactgtgatacgaattattcaggccatggagctttttctagaattgtcactgggcttcaagacttccaccaaagtcaaaatcagtcggcgatggactacctcaaacagcttgaattgaattaaaatgaaccatagcactagaaaggcatgtaatttgatctgaaatattgcgcaggaacaatatcaagtctcaggcaagacaggcaattagcaactttgtgataataaagaatttgaaatagctcttgagttcataactcgttgcctgcctgtgtgttttggttgggggattcaaaatgtatatgttactattttacctgtgacattacaataagcatctgatggatttacactagtaacattgatcttttcccattttactcccttttactgattataaatgttataaacattaaaaactggaaaatacattaaattgtaatgaaggaaaaaaaatggtcgatcttcactcctcctgctcaaagatgagcttca

SEQ ID NO: 650 - DNA, 1179 bp, Homo sapiens
aaggtagccagattcttacattgcaactcggggttttgcaaggcacaaaagcagaagctgcttccaatgatatgggtcccaaactggctttgcatcactttattcacattctgttggttaaagtgattcaccgaccagctctggtacagggtagaagggggctacacaaggatttgagtattggaatgcactgaaggtcatcatggagactaacccactgtaggaagcacattcatcgaaaacgtcatttccagtactgcttatccatggataatgaggacctcctgtagctgtagtcactttggtgcatcgtttccaaaaacctaatgagttgtgatgtcaattgcagctgtcaatctacttttaatcacaggcctcaaatgaagaaattcatttagaggataagcaaattacagcttcagttttgttcataaacttaagccccttattgctaatttttttgaaagaacaagtttatgctgatttgtccaaggatactcagcaaatatttggaaaatagttcaaagtttaatgtataatcataatcctattgcttcttggccttttggcaaagatcaagtgtagtgtctgttcttatcagtttaataatcataatcctgaacatttatatattattattattattttgagatggagcctcgctctgttgcccaggctggagtgcaatggtacggccttggctcactacaacctctgcctcccgggttcaaacgattctcctgcctcagcctcctgactagctgggactacagacgcgtgccaccacacctggctaatttttgtatttttagtagacagggtttcactgtgatggccaggctggtctcgaactcctgacctcgtgatctgcccacctcggcctcccaaagtgctgggattacaggcctgagccaccatgcccgacctcatactttcttatttaagtggtgcttttaggtatcgttttacttgctttttatttcaaatcttatgtggttaatcaggcagatattccagttttcaagtgaggaaactaagtcatgagaagcttttaaatgctccacagtcacacagccagaaaacactggagccaagactccaagttttgggttcttcttttttatttttttaagacagggttttactttgttggccaggttggagtgcagtggtgtgatc

SEQ ID NO: 651 - DNA, 1173 bp, Homo sapiens
tcctctgccactctcgctccgaggtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaagtaaggctgcgcccatgcaagtagctgggcctcgggagggggctggagggagaggggaacgcccccccggcccccgcgagagctgccacgcccttggggatgtggccggggggaggcctgccagggagacagcggagagcggggctgtggctgtggtggcgcagccccgcccagaacccagaccttgcagttcgcatttcctcctctgtccccacacattgcccaaggacgctccgtttcaagttacagatttcttaaaactaccactttgtgtgcagttgaaggcccttgggcacaatgagagccagtcctccaaactttcagaaagtttcctgccccttctggcaggctgccaatcaccgggcgggagaaggaaggaggggaaggcggtggagggagcgagacaaagggatggtccctcgggggcggggatggcggggctgtcctgtaggtctgtgcggcc

SEQ ID NO: 652 - DNA, 1199 bp, Homo sapiens
atcatttagtttcttattacctccctatgccaggaaagaaatagttgcaatttattgtagtcatcatgaaatcttcccttgcacataaatttaaaatgtacctgctgcacattttaatatgtcttaattgcttttaaacttggctgtattgtgtacaactattataccatcttttataaacacagttttttaagaaatttctttttgtaagttacaacattccactggatccttatattgcctgtagtggaagagggtcttgtgtgtctgccccttctagttttcactcatgcagaagcaacataaccttctgatttgcacaataaattacatatatttagcaggatttttatttgccgtgatatataggataatttagtctttggcatgtggcattatatttattttggtttttttttttaaacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactcttttgttgtgttatttattggataatatctaaacaattctctacttggtcctattagttaatttgtcattacaatcatgtaagttgataaattcaggttatttatgcttgagatgtagttcttaattttgtcatttttgatagacctcacttctttttattattacttaaaaacatttacaaataggtggtgtcgaataaaataacttgtaccaaaatgaagataggtctctctaaaatgagctcaggtctgtgattttaatcataacaaacagacttcctaaaattaaaaaataaaaactttttttagtacatatagcatatgagtaacacaaattccactttgggagttaaagcataggaagttgccaagatataggggcttatcttccgctagcaagatgcagag

SEQ ID NO: 653 - DNA, 1179 bp, Homo sapiens
cgtcccccaggtgcgcggccaccatggcgtccagcgacgaggacggcaccaacggcggcgcctcggaggccggcgaggaccgggaggctcccggcgagcggaggcgcctgggggtcttggccaccgcctggctcaccttctacgacatcgccatgaccgcggggtacgcgcgccgcggggcaccctcgggccctccccgcgccgcggtccgcggaggttccgggttcagggggcgcgggccggggtgtaaggggcgcggggggtgcgggcagcggccgtgggggaagggagctgtcgccgcggccaccgccggggttgaatggagcgggcgggggggccgggccctgcgcgcctggcattgcctaatacggtgcacggcggggcgctggccggaggttaagtatagaaccgggcaggaatgcggtgccggcccgcgggggaggtggctgctgccccggcgccgctgccttcgctgctgttgaaggagcgcccagccctggccactcgatggtctcgggagcgcagagcttcatgctgcgatcgctgggcagagttttcgcccctgttaatttcaccgcgacttttttttttttttttttttaaagcacagcacgtcctagagcttgtcacttgggacgattttgaaataaccaccccacttatcccagcgtggagctcctgcccagcatctttatggcctcaggctccgtggctgataagctggaccttgatttttggctttgagtatgactttgcaagttaaggttacacaatgactgtcgctcttcgcagagctctcaaagtgacttttgtgtcaactgcttctcaaaacctgttgggaaaatgcttttccatttctcaattgcactgccttttaaaaaagttattttcccattatcactcgaagtattaacttatgtaaacgcgaggaaaagtttactattttctttttttctttttattatttatttatttattttgagacggagtctcgctcggtcttggctggagtgcagtggcgggatctcggctcactacaagctccgcctcccgggttcatgcctttcttctgcctcagcctcccgagtagctgggactacaggcgcccgccaccacgcctggctaatttttttgtatttttagtagagacggggtttcaccatgttagccaggatggtc

SEQ ID NO: 654 - DNA, 1221 bp, Homo sapiens
ttccatgctgttcttttgatacctacttctttttctggttagcagagcttcagattacatttctttgcagatacagtttccaggaggatcagggatattagatgaaagatttttgaagaattgatttgcaaagaggataatttctttcagacttacttttccattggccatttttaatgaactgttacatcttcgggctgactgaatgacagtcctttcctcaccacctaaatgtgatgcgaagtcctcctgtcagcatttcttacctccccagatctttgacagtgataaattttgagaaaaatcaaaagttgctgcttatcagaaaaagttctctaatcttttgaaaagactattgaaattcaaatgaggctctgtgtatgttttttctgggtactgctgggcagatttctcaatctcctctttttgagtattagtgtaaggatattctcaggataaaatgagatcattatgaagctttgaattctttagaagcaagtctgttatttttgtcacttttccttttcccacaaaccctgtttttgtcttagaaaataaatagttttgacttcatttgctattcacagaaccatgttgtaggtagtttatatccttctgattaaaaaaaaaatacttgttcttttataactgagaagaattgtgccactgattttgatgattttgagacagcctcaataaatgatgtgaacaattttagatttctgaagtgggttgtgtttctgatccatccatacaaatatgaatcagatgctgattctatttatgtgtaggaaagtaataaagtagttcatgagttttcaacataatatctgctgataactgtatcatatgttcctggatgtatcattaatcaagaactgtaagatagcactcaactatgatagtaggcaatttatatttgatcagataaactgttaactttttaataagttttaatatgcttagctattatgtttttgaataaggtggcaggttttagaatttaagtgtgttcttttaaaaaatgcacttaaaaaaaaaacaacctgcttggctaccagtcagtgagaatgatgaattaattattaaaatgcactaccagaccaaagtaataacatgctttccttttctaagatgaagtaagtgatattgttcagaatgactcactcaatattcttgggctttagaggggttgagtacctagggagcaggctctgggac

SEQ ID NO: 655 - DNA, 1195 bp, Homo sapiens
caggtgcctgcaaccacgcccagccaattttttgtatttttagtagagatgggtttcaccatgtgggccaggctggtcttaaacccctgacctcaggtgatccacccacctcggcctcccaaagcgctggaattataggcgtgagccaccacgcctggccgaatctggttcttctttagctcaggcagagtaatcgtattaccttttttttgttgttgtcataaaataagataatgcttctctaagaaataagtaggctgtgcacagtggctcacgcctgtaatcccagcactttgggaggccaaggagggcagatcacgaggtcaagatatcaagaccatcctggccaacatgatgaaaccccgtctctactaaaaatacaaaaattagctgggcgtggtggcacgtgcctgtaatcccagctactcagaaggctgaggcaggagaattcctggaaccagggcatcggaggttgcagtgagccgagatggcgccattgcactccagcctggtgacagagcgagactccaccttaaaaaaaaaaaagaaagaaagaattatagtggagactattaaagagcttgagtgtatccatgttgttgggtctacatgtaaaaacaatatatatatatatatgtatatatatatatatgtgtatatatatatatgtatatatatatgtgtatatatatatatgtatatatatatgtgtatatatatatatgtatatatatatatatatatataaataaggaacttaactatacataattttctgcagtatgaaggctgaacagatcttaattttttctacacatttttgtttttactttagcatgcatttgactgagtcgtgaagtttttaagggtgtgagatatgcttttttatgttttaatccccaattcagtgcctgaatgctgacgggtgctacacagacagtgaatcagtgggtctgtgcaaacgagggccagtgagaaacaccctagtgtcctaactgaaggaagaggccatttccagtgacagcacactcatcagttcacctggagtaccggaggcacgttttcaggttgactagggaaccaatgaggcttctgacaagcaggggacttgggtgcagggccagcaggagcccaggcctcctttctagcaagctgtgctgttctgccgggcttctcctgctatgggttattgagt

SEQ ID NO: 656 - DNA, 1099 bp, Homo sapiens
tcagtgacttatttgcatatttaagccctattcacaagagaccataatcattttaatcttatattttccctcaggaaatttagggactctgaagcccctattttattctcttggagtaaactgttgagtgtagttacaaaaacttttatttatgacttaaaaaaagtttagctgctatttcagtgaaagtgtaaaataaaacggtcatgatttttttcaattacagaatagttacaaattttaccatgttcatctattccacagagcatgttaaaaacaacaacaacaaaaacctaacagcaattacaaccttggtgttgcgtttattctaatcagagtgaatgattataatcacactttgctattttaacataaattggtgctttagagcattaaagaggaagcagcaggccctgtactcagtatttattatttcttgcctcagaatgcaaaacaactttaaagtgtctatattcatatatatgtgcatttcttaagatttaaatacaaactgttgttactccttaagcttcaggctttctgcgaaagctctaagaatatcttcattactatgcttggtcaactggaagatggtattaataaggtcagaattaggaattggattgctctgtgggtcctccggtattgtgcagaggaaagaaaaatgtctttcacaccacaaactgtgtgtctgaaccccagccaaacaaatgtgttccattggtccaatatataagcattaacaacaacaacaaaaaatttaaaacaagtaaattaatgcattcacatgatcacttcttgaaaatggttcaaagcatgttttcctgatggtgggattgtttaaatgacatgttttaaagtttttaatactttattagttatgaagtgcttcttttatatgttaagtttaggttgccagtactcataatttttatttctgcaattatgttataatgagttgtttgcatgcctacttaacccaagtaaaacgatgctgtttgctctggaatgttcatcttttagacaggttttggctcatttccaatcatggtgcaatatagtgtaacattcatttgttttcattcaacagttttatttt

SEQ ID NO: 657 - DNA, 1178 bp, Homo sapiens
attctcctgcctcagcctcccgagtagctgggactacaggcacatgccaccatgcttggctaatttttgtatttttagtagagagagggtttcaccatgttgatcaggttggtctcgaactcctgacctcaggtgatcttcctgcttcggccttccaaagtgctggggttacagatgtgagccactgtgcccagccagtggctcacttttaaatatgactttagtgtttgctttaaagacaatttattctctgtatggtattaataatatgagaagttcctttctgaactggagaatcattctctttatgattaagctgatttttaggaaacagtttcccaaaaacactgaatcaggtggaatagatttctgaaaaatatgtatatcatgtctgtgttcattatgaacttttctattttgcccattctattttgttcatgtggtcttatttcattttgcatcatttaacaaatataacgaggtcctacatcttaacttttaagatgtaaagacttacgtttatttccgtatatacttttattttaagaacttaatttatggccgggcacggtggctcacgcctgtaaccccagcactttgggaggctgaggagggaggatcacgaggtcaggagttcgagaccagcctgaccaacatggtgaaaccccgtctgtactgaaaatacaaaaattagctggttgtggtggtgtgcatctgtaatcccagctactcaggagattcacttgaaccctcggggtggaggttgcagtgagctgagattgcatcattgtacttcagcctgggagatacagtgagactccgtctcaaaattaatacatatataatatatatatttgttttaatatatataaaaaattagccaggtgtagtggtgggcacctgtaatcccagctattcaggaggctgaggaggctgaggctggagaatcacttgaacccgggaggcggaggttgcagtgagctgagatctcaccattgcactccagcctggatgacagagcaaaactccatcttaaaaaaaaattaatttataatacaagggcctttgcagccctgctgtatagtgtgggcattaagagccagacttatttctttttgacctctagatccacatggggaatcacttcatctctccaacctcaatttcattatctgtga

SEQ ID NO: 658 - DNA, 1198 bp, Homo sapiens
gtctttaagggagaaataggagacaacaattttccattcactattataagtaaaagagtggactgacatttgggtcctgaagtgttatttgatgggctcaagcttacaaacatttccccatttaatctctataaagtccctggtaggtgggaattattttcccattgtacagattacaatttaacccagaaggaaataaatgagcattcataagaaatgtttttagaaagatgtcacattttgaaaccagacctctaagtagtgaaagtaaattcccactacgttcattacagatcagaaaacgtgagactatcccaacagcaggatactttattatcccttggaattcaggcttaatgaaccctagtcaccagtccccacagatcaggctcctcaaagcctcatcctaatccagttcttctggatcatgcaagctctgtctgccttcccaaaagaaactagcctgggccttatcctaaactaggggctaagagcagaggctacacacagtcctcgcagtccctgaggtgactaatattatcaagtaccttctaaatgccaggctcatctacggccataccaccctggacgtgcccaatctcgtctacgtgccaggcttgggggcatatgcagatacatgggacagatcccttggaggatacagacagataagctcatggttcctgcacagggtggtgtgggctcttactgctgagctgagacctatgtggtgactgtgttggactgaaccccagggaaaggtgtggggtcgggtgtgatgggcacaaacagaaaagtggctgttatgattcacaaacttattgcatgtcattgtacgttacaggtaactttcagtgctctctgatgtatggagcattaacaatatggaactaaactagtgtttctcatatctttcaatcaccacttccaataaaaaatattttctattgggaggccgatgtgggaggatcacgaggtcaggagatcgagaacatcctggctaacatggtgaaaccccgtctctactaaaaatacaaaaaattagccgggcctggtggcgggcgcctgaagtcccagctactccggaggctgaggcaggagaatggcgtcaatccgggaggcggagcttgcagtgagccgagatcaagccactgcactccagcctgggcgacagagcgagactgtgtctcaaaaaaaa

SEQ ID NO: 659 - DNA, 1190 bp, Homo sapiens
ttaataatttactctagagttttcctgagaggtaacttcaagctcagtattgcattctttgtaaaattcactttctgatttgtcccagacatttctgtctatggttcacagattacatacgtactcttcaaaactctgaattcctcttggccttaagatatgaacttacaagtattatcttcactgctcctttaaatagtcctatacctgttctagtttgaaaactgaaacattggacctgtctcttggttgtttgtcttgcactaaacttaagttaaaaactcctgcataggctgggtgtggtggctcacacctgtaatcccagcactttgggaggccgaggcaggcagatcacttgaggcccggagttcgagaccagcctggccaacatgatgaaatcccgtctctactaaaaatacaaaagttagccagacatggtggtacacacctgtaatcccagctacgtggatggctgtaggcatgataattgcttgaacctgggaggcggaggttgcagggagttgagatcacaccaccgcactacagcctggcaacagagtgagactgtatcccaaaaaagaaaacaaaaacaaaaaaacccctctcctgtataactgtctttagcttctttacggggaaagcagttcattctggaactaaacccagtttaacatttaggttcattacagagagcaaatgatgctgcattgatttccttgaaactatttggtaatgttattattataaacgtttctctcccttttgtttctgtcctttctttctttttttccccttgctcttgattttcatcatgggtgccttacctactttctttaaattttgaaaactttttttttttaggttttggttatgtttttttgggggggtagataagagtctaccttgtgcttgtttaagccatacctttctgtaaaaaaaataaacagaatttttctcacacggctattttaaggattgagatatcatgtgtattcataaaatataaacttttacagttctgattttgtattgctaattatacatactgattcaactgagagtgacgttggctgtcttgacctaacaagcagtgaagataatacttgtaagttcatatcttcaggccaaggggaattcacagttctgaagagtacatatgtaatctgtgaactacacacaaagctcatctg

SEQ ID NO: 660 - DNA, 1202 bp, Homo sapiens
tgctaatgtctggtaacttgagatttttttgctgaaaggttttagagagttgtagaattaacattgaggaatgaggaaacctacctcatctccatacccagtgatacaagagctgtgggagcaaagtaacgttgagatagctacagagtaaacagtgggtttcagggtcgatctaagtttttgttggaacaagaatcagaggagatgttcagagaaaaggatggggtacattgcaccttgttctcggagcacagtggaaggctttcagctgttgaaggaggggtggcaggtgtggacataataggggaggttcacaaccgtgtagggatgaggcaggtgaggatggaccaggagtcttttgatgactgacataaaaacagggagaaagtcattatccgattgaccctggtagacttcaggcaaataagatgaggccttgagtgtttgaagaggttgggtagagaggtagtatgggcttcttcttgatcctgatggctggtagaagccttcagtcataggttcctttttggggaacggtgtcattttacattggttcaccacactcttatcttctcttgatggaaagatagggataggtcagggaaagaaaggctgttttacccagaactttagggttccttctagactatatgggtttttaaaaattattgatatatcgtagttgtacatattttggaggtacatgtaatattttgatacatgtacacaatgtgtagactccatggttgatgatggtagagcacacttaaattgaaagtcaagggaactttaattcactactgtaatttttaaatgtctgtatcatgtagtgtttgcacagttttaaccttagtttaccatctcttactccttagtaaaaaattccgtttcatttatttctttattaacttagattatactgccttatattttttagtgcactttttctgtgactaacctttaacccttttgcatataaatgttttaaaactagaaattagcaacaagtatctacttcaatattatgttattaatgtggtatcactatcaccttttaaatattgcaactataatttactagtgtaatattttcacacaaatctttggtaacgatggtagtggaccaccggtgatacataagcattgttcactaagattgttatcagagggagtaaaagtgtaagtgtcttttccagaagcca

SEQ ID NO: 661 - DNA, 1100 bp, Homo sapiens
ctggaatgcaatggtgccatctcagctcattgcaacctctgcctcctgaattcaagcgattctcctgcctcagcctcccgagtagctgggattacaggcgcccaccaccatgcctggctaatttttgtatttttagtagagacagggtttcaccatgttggccaggctggtctcaaactcctagactcaagtgatccgcaagtggtccacctcggcctcctaaagtgctgggattacaggcgtgagccaccgtgcccagcctctttggctactttaaaccagcatttcaaaataatattaaaagtgagaaaggccaaaacaaatgtatgaaacaactctattactttagcaaagaaccaagttactatactgaaagaaacaagacagtccaatacaaagtttaattcccaaagaaaattaacatattcccaagaatatatatggaacttattctaggaaaatgtagcaattaacaattttcattcattcaacaattatggcaagcctattagatgatgagctaaatactgacaaaataagatgaataaaagccaacttctaaaataaattattaaagaacctagaaaatactagagcaaaaccatccctgagacataaagatgaaaactaggaggaggatatgctagttttcaactggactataaaactgaactataatcttttaatacatactacttgtttcatcatttttacaagcatttaaaatacttctattaagtgaaatagcgaaattaaacttacaatttattaagatcatgaaatctcttaggctgcttcattccagggcaccaccacaaaaccaaacatgaaatacaaggcactttcttttataggcatcgatttaaagttaattctccatatagtattctttaagatatttaaatgactactttccctttccaaactgcctcaaaagtttctgaaatttcctgagacttttacgtaatatatctttccttacttttctgtttcctttttcctttgttgggacaataattttaatattatttcttcaatttttaaatttcttaaatttctctgatcatatgcagtttatcctggtggacctaaattggtgt

SEQ ID NO: 662 - DNA, 1219 bp, Homo sapiens
attctcactaagtgtcttaaagatgccaacctaaggccttggttaggttcctggtgccagagagatcagagttgaccttgttctcaaagagctgtggttattttgttttgacctctctgttggcttaaactgtgtaaagggcttgcttttattttgccacactcagaactctgccagagcagataggccatttgtcgtaaacatttaaaggcaaatgtatttatttgatttttattttttgtagaaacagggttttgccatgttgcccaggctggtctcaaactccttggcctcccaaagtgctgggattacaggcatgagccaccatgcctggcctacaggcaaatgtattagccagtgctgaatggggtaaggggtagcaattgaggcaaacaatgaatataataaattgtttctataagtatagaaaaaagcttgaaaggacacaaaaatatttttataaagctgttttaagctaagtgttattacaaaagagtcaaaaagataaaaaattaaaaagttcatcaagtagaaatgttatatagtaagctaaggttaattgattatcaaaaagcttggggatgtgagggggatctggctgcgacatctgtcaccccactgatcgccagggttgattcagctgatctggctggctaggcgggtgtccccttcttccctcactgctccatgtgtgcccctcccgaagctgcatgctcggtccaagaggacaaccatccctgatagaggaggaccagtcttcagtcaagggtatacaagtagctgtgctcccctgctagaacctccaaacaagctctcaaaaagcttgggcagacagactgaaaagtgacatgctttggggactaagggctttcaaagctcctacatattccttggaaactagatggccatgtgcatgcccaggacagagcacatgctcagaaagacttgagaaggctctaagttctcacttctggctgatattcaggctctgcacaagcagaaactgaagctaagaaagatgtaaactgcccaactgagtgtggaaggcatggccccaagatatacacagtctactggcaaacactggaactatatatattatttattcatttatatttagtcatacaccacataacaatgtttccatcaacaatgaatcgcatatatgatggtggtcccataagaatacaatacaatggagctttaaaattcctatctt

SEQ ID NO: 663 - DNA, 1183 bp, Homo sapiens
tgttcctgtagctttttttccctgatgtttctttccagtaacaaaatgttagtgtgaaatcattgtactgtatttagtacaaaacaaatagggatttcatctatgcatttagtaatacctgaatataaaaataaagcagccaaataaaattcagatgaccttgggaatactacacaagtaaatcacgagagatgagcgaacgaagcactgggcaaattgttcgaaacaaagggaaagtttctcagctcacaagatgaaagctttgattttctcataaaagaaaactaataagaaatagttattttcctgaaatacaacgttccaaatgggagttggcgggggggagcaacagtattttaatacattttgcaatctgcaatgctgcttgattttgttgtataattttgcgatatgcttaaaaggtggaaaatagaattaagagggttggaaacgtgaagtaaaatattttggttctgatagtaccaatcagaaagcagaaacagccacacactgcctttattattcttcataaaggctgaggcagaaggggaaaatgacaccgaagtctctgtggcgcaatcggttagcgcgttcggctgttaaccgaaaggttggtggttcgagcccacccagggacgcgctctccttttatgagctggtcgcgggaagttttgcagaaatcgagttcaggcctccgggataagaaggggtggatttccagggaccaagcaaagaaaccaccgacccttacactacgcggccagccggcgagcccttcgctttcggccggtgcagagcggcctcctctcccccgctgtcctctcccggctgcaggtgagcgcggccactccttccccggggtcttcacggcggtctaggcctcgccagggtgctggagcggggacgcgcagaggccgcgcgggcccgtttgccgcgcgcgcccgccgctccagctctgcgcgtccccggaggcccgcgcgtacacggggaaggcggcccgggctggtcttgctcggcttcgtgacgcgtgaaatgtaacggggccaccgaaatgcatgtatttcaacagtgtcaagttcaagctgcaaactgaaaactcctacattttgttgaagcatggccgcccttttgtctgttccctgtcagcgtaaacatctccgtttgcgacttaaacattaattgt

SEQ ID NO: 664 - DNA, 1200 bp, Homo sapiens
ggtggctgaggcaggagaatcgcttgatcctgggagggtgaggttgcagtggaccgagatcgcgccactgcactccagcctgggcgacaagagtgaaactctgtctcaaaaaaaaaaaaaaaaaaaaaaaaaactttcccctagctctgctttaaaatacatatacaggtcattcattataaataaaaagaacttaaagcaacctcctatgtaaatatggagaattcactgagtattaagtgtttttatataaacaaaaataacatgtggctctagaaagagccacaaaagccatgtaggaaagcttgtctcattctatgcccagtgggcacaactttttaagctaaaagcaaacagtggacaacaggttcatttctaattttgttttttttcctttttgcattgaacatcttaatatggaaagtgatattaatgactaccctacactattctaacttcctaacattatatgctaaaactattttcttttcttaccagcttttaaacactgactgcaattagtgttgagatgtgcaatttgaggtaaacagaaagaaatcaaaagaaattcccaccattagaattattcaaagacagagtaattaagcaggcatcacaaacagttttaatcggttttgaactcatttctgaacacgttaatgaccttaaaagtgatagccagcaatttcattatattaatttgaaggaaaactttgacaatgtttgtgtctttaattttaccattactacgctgtctcaaacatgccaataaattcagtttatttctgcaatgtttttgttctctagttctacttatgtaataaaatcgcatattaaagttaaattttggtatactcaatatagacacgtctcgataaatttagttaagtatacttggtaagtctaaattttggaagagaaagtggtaaacaattactcttaaaatggtatgattcaaggactaatatcctaaaacaaaaataaacatgaaacatcatggttttcaattgttgtctatcactggcaagaataacagtttcaaataatttccttcaaaaggagctccactgttgctgtatgcctgcaaagcacaagcttacttgaattttgagaataaagtggacctccattaacatgaggctgagcagaaaattgagcagtcacagagggagttcgtctgtatccaccagaagatgtcga

SEQ ID NO: 665 - DNA, 1177 bp, Homo sapiens
gagatcatggagtcatggtaacagagaaattccttgaattccttgtccttattatggcagtataatactctattgtgtggagatattatagcttattcaaacagtctcctattgatagttatatgggttgtttccagtcttctgctattatagatagtgctgcagtgaataactgtgtacatatggttttgtatttttgccagtgattttttgagatacattcctaaaagtgagcttactgggtcagaaagtaaatctgtgtgtaatattgctggatatcacttaccagtgcatcagagttttttctcacagctttgctgagtgtcttgtcagacttttgtatatttgtcatttgggtgaatgagaaatagtatctcatattggtttgcacttgcatttctttcctataatgagtgaggttgaacatcttttcagtggttaagagtggttccattgcttttttggtgagctttctgttagatctctgttccattttttttttctgtgtagaactggaagggacgtgagaccattttgtttagtctctgagttcatgacactgatacctggagaaataaatgattttcctgaagttgtaggtagctaggatagcctttttttttttcatttttagattatatgttagtgatatttactctttgtggtgtaagttgttgattccccttcttacccacctacagtttgtcaccttttaaccttgctcctctttgaggagttcttgccttctgagttatctataggagtttgggaagaaggggtgggtaaggaattggagcacataagattcacagtagtttttgtggggcatgataggcttgaatcatcatagataacaaggaagttggatttccgatggtggttagtggacacaggaatataaggcagattggatttagtccatttcattgtaagtggattgggagcttgaggctgacagtaaagtccttatgatgtaatgcagtgaattggtgatggaaagggtctaggcaaggagaaccagttggtgcagtgtgtctctgatactgtgactacagttagtggcccctttagtggatgagctactcaggagagagtggttcccagctggcacatagggatttctgccatggcttaattcagtagtatcctgagactatcatattggtacagtgagttt

SEQ ID NO: 666 - DNA, 1177 bp, Homo sapiens
atgttttagaatgctcctctctaggtactttctttttaaccctgtccaatgtacttgacttttgttttctcactgagaaaatgaaagttcagaatgatttttttggggatagtaaggagactttgcataatgggaaataatggtcaggggaaaaccctttgttttataaggggccatttttgtatgctttttttactgaaacagagaaggtcaggttaattccatatccaaattaaatttatgattttcaaaagggaagccttgataatctaaccaaacgtgtccattatctaaagttatttggaaaattgtgtcactttaggtggaggaagctaaacaagaattacaggaagttgttgaattcttgaaaaatccacaaaaatttactattcttggaggtaaacttccaaaaggtaagatatcttttctttatcatgatttgatggaaaaaacaaaaacaaagaaacaaacaaaaaaaacctatattacttatttaattttaactgattaaagtttaagtcttaattgctattttacaaaatagatgttcattctgaacatacaattccatagccttttttttttggtaactgcaagtttttatatactttcaaatttaaagttacaagaatagtacatagaatgctcctcataccctttacctagactcacaaatttttaatatttagtttcctttttagacccaggcttgagtgcagtgatgcaatcatggctcgctgtagccacaacctcccgagttcaggcggccctcccaagtagctgagaccacaggtacacaccaccatgccggctaatttttgtattttttgtagagatgaggttactccatgttgcccaggctgctcttgaactcctgggctcaagcgatccactcactttggcctcctaaagtactaggactgcaggcatgagccagcgcactcaacctaactccattttaaaaatcattcactttgtctctttatgtatatataaatataaaaattatttgtaaataaataaatttttaactatttgagagtaaattgtaaacaatcaccccaagtgtgtatttcctaagaataaggatattcttctatgtaactccagaataatattaaaattaggacattactgggtgtggtggctcacgcctttaatcccagcagtttaggag

SEQ ID NO: 667 - DNA, 1175 bp, Homo sapiens
tccctttctcaagagagaaaacaaattggagaacaggaagtgtgaatggcttcataaaggtttttgtttctttattttttgtttgtgtttgtttttgagacacggtcttgcttcattgcctaagccagagtgcagtggtgcaatcatggctcattgtagccttaactttctgggctcaagtgatcctctcacctcagcctcctgagtagctaggatcacaggcatgtgccaccacgcccagctaatttttgtggagatggaatcttgccctgttgtccaggctggtcttgaactccagggatcaagtgatcctcctgccttgacctcttaaaatgctaggattacaggcatgagccaccatgcttggccttaagtttttgataatagggtacttacaggaaatcatagcagttgtgagaaagaatgccagattccaaaattggatgtgatgaaatatgattattaacaataacctaatatttgcatttcattgagctgtcatatttcataaatgtgatttcatgtaaagctttttctttctctcctagattccctaaggcgaacccgtctgattctcttcgttctgctgctattcggcatttatggacttctaaaaaacccatttttatctggtaaaagctttttttatttgtctaacttatttcttattcctttaaatacatgattccttttaatgcctaatctaacccttaaagaaagaacatattaatgtttacagtactagaattaggctttcattcctagtagtggttagtttcccagatttttagaaaatgatacctgtccaattataaaatttaaaaattatcctggtcaacagggtgaaaggaaaattaattaattaattttaaaattatgtagaagaattttataatggcaatacaagctgaaatagtcttctatttcaaagataaacaaattcagtttattcataaaatcacattaaatgtttcccttttttttagtttgcttatctgaaattaagcaatagtgtcagacttacgtggttccaattaccttttccactactgtgcagttttcaccctgtgttgcctattctcttaaatattaaggatatgtacagattcttaaaaaatactttgtgggccaaaactattggtgttcattctagaattactattttaaatttgttt

SEQ ID NO: 668 - DNA, 1141 bp, Homo sapiens
actttgggaggccgaggtgggcagatcaggaggtcaggagatcaagaccacatcctggctaacacagtgaaaccccgtctctactaaaaatacaaaaaattagccgggcatggtggcgggcgcctgtagtcccagctacttgggaggccgaggcaggagaatggcgtgaacctgggaggcagagcttgcggtgagccgaggtcgtgccactgcactccagcctgggcgacagagcgggactccgtctcaaaaaaacaataaataaataaaaataatgtaaccaacaagtgatagctagtaaatggaagaactgtgagatgtagttaaattagcgatgctttagatactttcataaaagcagtcatatcatggataaataaaagttgaaactcatattgtgatttccctaatatttgatagaattatttatatttcataggatttttgttttttggtttggaaattagaaaatttactttttgcaatttccctccaggtaacttagatatatttagtacattacgttcctcttgcttgtatcgacatcattcaagagctcttcaaagcatttgttcagatcttcagtactggccaggtatgaagcaacaaccataaattgtggaaaaaaaaatatttatttactatagtctgatttgtctttcttaatggtattaattctaaacattcatttgcaattcacaggacctaaagagtatttggaattaatgagtttgggtacttctgtataatttttaatctggaaaatatataggagctaaattttgagcgtgatagtgccacaataaatcaaactccagggaacttatctacgcttgtttcaagataaatgactaaccacatttgcttactcatcctcactttcaaaagcccattgaaattaattttatatatatatatatgagaaaaaaagagcaacaacagaagcgttccgttaacggacgagaaatttgagggctttcagtaagttgtaaaataagtgacatcaaattgacagtaaaatcaaatttgcatttattcatataatttttgaatacaaggcactagtgatagatgtcaggtgatagtgatcactgtaaatgaaaaagacatgttttctaccttcatgggactaatggtgtca

SEQ ID NO: 669 - DNA, 1186 bp, Homo sapiens
attatcttccatagagtaacataagctgcttttcaaaggtaccattgtgataatgagatcaaatttataagttattatttttaattttctaaattaaataaaagaaagaatgcaaaccaggagtgaatttcaaatgagatgtaatcgactttatatcttagtcacggagttgccatggcatgtagtagaaaaccacaggaagaatggtcatattcactttgtgggctgcccataatctttcttgggcattcacaactcttgagtttggtgttcaggcatcattattaaaaagtggagtcctatgtaccagactgagtttttacaaatgatttgcaggctagacataacccactgatggaaatggtgaagaatgagcttcatgtaggtttaaaagtgtattctgagcctgtagatgattaatcaggtttttattcaatcatataaatgtattcctttgtaatcatttttgtttaactgaggatatctagtgtctgcttcatagggtgctttgaaatataaaatgaaaacttatttatactgtttttacaacagtcaaaaaggaaacacacgaaaatcacttttctgcaactgatgaactatatagactggactcttaacctcttagtgcctcagtttttccttcggggtatactattttagatacacctacttcacaggagtactggagggatttgcaagctaacgggccaaatgcttccataggaataaggcatgcccagctaacagaaatttaagtccctcttccccacctctctcatctagaccaaaaagaagactacaatttagatccttggagacttttcctgtatgccttccaaaacttcctgctcacttagatgtaccttgtgctttgaagatttctttgatgcagtctttgtaacaaataatttttttttttaaatggagtttctctcttgttgcccaggctggagggcaatggcgtgatcttggctcactgcaacttccacctcctgggttcaagtgattctcctgcctcactcccaagtagctgggattacaggcatgcaccaccatgcctggctaattttgtatttttagtagagacggggtttctccatgttggtaaggctgatctcaaactcccaacctcaggtgatctgcctgcctcggcctcccaaagtgctgggattagaggcgtgagcca

SEQ ID NO: 670 - DNA, 1203 bp, Homo sapiens
tttcctagtaaccctcctaacccatccccctaactgacaaaaacgactcttccatccgggagactttgggatttccgggctacaggactccaccccccacaacctagtcagtcccaccaccaacgttcggcctggggcacttcccaaatgcctaaggacgcagggggttgcgctagtaagttgaaggcccagggcaccccctttctagggttgacgacccgtaaagactcctcattggccccgccctctacgcccagtatcctatttttatttttttttttaattattggtttcttaaatagagccagggtatcgccatgttgccaggctcgtcttgaactcctggcctcaagcaatcctccccactcgacctctcaaagtatcgagattacaggcgtgagccactgtgcccggccgtccccatgcccagtctcctattaaatcccgctggaggtgcctggctccctggggctgggtggaaagggtagtgtaggggaagttgccctccgtcccagcccagtttaggagccggcgacctcctctctccttcggctgctcctcggacgttcttggctcagggcagcgaaaactgtcgaagacctgcgggccagggactgctgagcacctccatccaaggtccccaatgcttttctccatctaccctttagagtgggtgtcacgattgccactggaaaggctaagtgacttgccctaggtcacataatttaaatggcagaactggagtttctcacagaacctgtcccgacttaaagccctttgcttaggccccatttaacttcctcaaaccttaacttaggagagtgcaggcgctggggaccgcagagtcatttttgttgcccagcggtgccgtcgcgtgcagctttgggcccaggtgcagaacccaaccgcgcatccccagcgcgcacttcgtccacccggctgccagagcggacacatcggtccggcctcggtttcccccttctgaacaaaagcgcgcacagtgtgctccccgcaccaagccgggactgtggccccctttccccgcttcccggaccctcctctggggacagacggaccgcgcgcgtccttgccgcggcggcgggtcgggtgggtggggtttgctgcactgctgctgcggcggcggcggcgccagtgggtcctccggtgactctggggcggggctgtggggagggcacggactga

SEQ ID NO: 671 - DNA, 1170 bp, Homo sapiens
atcttgacaatttacttaacaagtaaccagtagttcatcaaaaccaacttgtacagactaataaatctttttcacagtattcagttttctcacctcttgctattgtatattgtagatttttttcattcatgtgttatttaatttacactgatctctgctattttaaccccccaaataagttatttgtcctttaaggttggttactataatacccctcagtaagattccagtattaatttctgggcagtttgttctctgtatacaattgcaaatgataagcatttttgtgagtgaccacctttgcaatatgtttgttaatttacttcatgttgggttctttctgaaatgtacatctttacatataaaaacctcacattctacttgatttacacttcctagtctacattacatgtggttgaaggttttatacattctatatgcttttactaaatatacaagatttactactagaaatttggagaaagaacactaacacatgtacttgtgatttgttcatgttatattaaaacttgagatttgtgtatttatgtagagtctgtattgacaagactgttgttttttgctccttgagctatataataatctgtgtattggattgttgtcttgatttggtctaaatttgaatatatatgagttacttgaatataacaaaaatgaattttgtttgatagatttatattgtaacctttttctagttcttgaataaatatagcctgctttccctagatgcatttgtgtaggaagtatatacatttccctattactctcatcagctgaagaatatgtactattgtgttactcaaattatgtggctttcattttgttgttttgttgcaagcttagtgttttgtagtggaggttttgtaaatgaaacagttgtaatatctaaggtcaggcacctagtaacagggttttgttaattcttttcagaatcattgaagcagtcttaaagggtcttttgcagatggtacaaattagaacaattagaatatagtattttgagttctagtagtactgagattgacccaaacaaataaaaaactattcaatttctgagtaatagttaatatttattgaaagcttccttggtgccagatgcctttctaagtgctgaattatctcattaaacctcacagcaaccttaagaga

SEQ ID NO: 672 - DNA, 1111 bp, Homo sapiens
atgttgtgattttattcctaaactgactataatgatgtaaagtgacttttcatcactttgtatcagggaaaaaaaagaatgcagctattacatgggcatactttagctcttgagcttgtgcattttgacagtaaaactatgacttttacaagtaaaccgattgaaagcatataagctattataatcgagcagtggctcagttgtaaaaagtcttcttggggttgaattcacatcttgtggaaaagccaggggccacatagcagatcagtcttggtttctcttcagtcctatcttattttttatctgaaacaatataaaccagcttgccttttatcttatttactgttattttcactgaattgtttttaatggttaaacccatccccaataattaattagcttaagatattggagcgaatgctgtaggatctgaaattgtttttcagaaacagttaatgttttgagaattgatgtcattttagacttaaatgcttttatgtttcctgtctacttgtgtgtgtgtgtgtgtgtgtgtgtgtgtgtgtgtttctttttttttttttttttcctgagatggagtctcgctctgttgcctaggctggagtgcagtggcacgatctcggctcactgcaacctttgcctcctgagttcaaatgattctcctgccgctcagcctcccaaggagctgggattccaggcatgcgccacgacgcccaactaatatttgtatttttagtagagacagggtttcgctggtctcaaactcctgacctcaggtgatccacttgccttggcctcccaaagtgctgggattttaggcgtgagccaccaccacgcccagcccttgtatgtgtattgtaataatgtttactttttaaaaatcaatacattatttgttacttttcagttttttttcctcttagtatttattcttaggtatatgtgtggtttttgaaaagccatcttctgactttaaaaagcactaattttgtggatgctgcagtgatgtatcgttatggtttttcttctgcctaggctcagaatttatcagaatcaggtggttaaaatcaggcctgttggtcagagtggtagtttatattttggtttgtta

SEQ ID NO: 673 - DNA, 1163 bp, Homo sapiens
cattttgggtgtaaccaccttggtgtacctaccctgatttgtattaagaccagtgtcttattgaggtaggttgttactgtggccataaacatttttcaccttatttcatgagatataaattaaatcctgtagaattatattgtccttttatcctaatggaagcttatttgaatgtgtggttaataaataattatctttgagatagcattggtggtagacagattggtacttttcaaatcagatatgggtatgatttaccaggttttatggcttcaggttatctaacctttcttgttcagctttcttacctatgaaatagggtgagaaatgtctaaatcattattctagtcatgtgaatgtttactgagcatcttctgtgtgctccagtgtgtaagggttaaatgagattacttacgttaggtgcctggcacatgagaggtgttcctttgatgtttgttccaattttctctattcaggtaatttttcaggctgattatctttttatttagaatctacatcaggagacaaacccgtatcacattcttgcacaactccttccacgtcttctgcctctggactgaaccccacatctgcacctccaacatctgcttcagcggtccctgtttctcctgttccacagtcgccaatacctcccttacttcaggacccaaatcttcttagacaattgcttcctgctttgcaagccacgctgcagcttaataattctaatgtggacatatctaaaataaatgaaggtaaatcttcataacagttttttaaaaatttatttgcattgtgcaaagttatgtaagtagtaaaatccccagtttaggaatggtctttgttttcttttgaaatttatagttgaacacttttttttgttttgttttttgtttttggagtttggaaatttatatccactgtagtttaagaccattggtagtataattgagttagtggtgcttggatcttgtgtatatttttcaatacttgttatgtgtctggtagttactggaggtaagccattctatatacataatgtgtatggtgaaattttacattaaaacaatcgagcgtttgttgaaatcggtattaaaacttctggtatgtttctaaaaaacctgtataaataattactcagaatatttaaaatatgctaatta

SEQ ID NO: 674 - DNA, 1164 bp, Homo sapiens
ggcccgagaaagtgcctggattttacaacaggaagatacagatcgaccttccatatcaagtaatcggccctgggggctggtatccctattgctaccatctgctccaaacagaaagtcctttaccaagaagaaaagcaataagtttgcaattgaaacagtcaaaaacttgctagaatctttaaaaggtaacagaacagaaaatttcacaaaaaccagtgggaagagaacaattagtactcagacatgatggctgctacattgtgtaaagaactgggcttagcctatcaaatggtctgtggacttacttggaaaaactgatttgaaactttcacagatctcagctttcatctgatgtcacttttcatgatcttctcattggcccccttaacctggtctgaagttctgggatgttttcagtttgatcagtctgatactcagtggcactttattaaaacatcagctgtggagtgtggcggtgcacacctgtagtcccagctgctcaggaggctgaggcaggaggatctcttgagcccaggattttgaatccatcgtggacaacatagcaagattccatctctaaaaaaaatgaaaataaacataagccacaaggaatgggtgaaagattattgtaatgtgctttaactaaataggtaaatatactaaacaaatgctaaaactcagttttaggatgaaaccattgttgatatccacatcagtccctgtttagaaaacatttaaaatgacttttagttatgtacagtacgttggcaatgaatacattaagcttcaaaatttggtagtgctctcgaatatgtatatttgtatttttcaagcgaagttctcttattcacatataaattaaagtgggttggtactgatatcaaaaaatgtttatgtttttagaacagacatttcagtcactgcattcttaggtattccaaaccaaatatgatgacatcaatagattgcattttaaaaatattgtttgatttttctattttcaaaaataaaattctgtttctaactaaaatgtgatattcccagtattccttcacatctcttttgagaactcccctcttcctgcaggaaagagacatatttgtctctcagtatatgcagaaaattggttccaggaccatccacgtacacccagatctgcacaca

SEQ ID NO: 675 - DNA, 1180 bp, Homo sapiens
aacccgtaatgccgtgttctaggaggtgatcatttaaacccgtaatgccgtgttctaggaggtactaaaatattttggaattgttatagaaatgaaagtaaatgcatattagttattagtgagcctttctaagaaggtgaaggaggtttgagggagtaatgaaaggaaggaaagttcttctcaactcttgtgtctacctggttagtgtatatttactgttccagttatcggcttttgttttggtcataagtgactgaaaaatgtagattacaattagaatgaaagtgtttttaatgtggcagtgcatatgatagtagacacatgtttgctttttggggtttgagatttgaagtaatgttctttaaatggcctatactatatgatgcttgtgagtaaatacgaaatccagattgcattaacttttttcttcattctctttctccatttaaataaaacagctatattcatccaacaagccataaagccataatgtggtataacatcctttttgagaggtgaatattattgaatgaaaatggctgacagaagtgggaagattattccaggacaagtgtatattgaggtggaatatgattatgaatatgaagcaaaggacagaaagattgtgataaaacaaggggagaggtacatcttggtgaaaaagaccaatgatgactggtggcaagtcaagccagatgaaaactccaaagcgttttatgtgccagcccagtatgtgaaggaggtcacgcgcaaagctctcatgccacctgttaagcaggtagctggtctgccaaataactccacgaaaataatgcagagtttgcatcttcagagatcaacagaaaatgtgaacaaattgcctgagctttcaagtttcggaaagccatcgtcatctgttcaaggaacaggtcttattcgtgatgccaatcagaattttggacccagttataatcaaggtcagactgtcaacctaagcctggacctgacccataataacggaaagtttaacaatgactcacattctcctaaagtttccagccagaataggacacgctcatttggtcattttcccggtccagagttcttggatgtagagaaaactagcttctcccaggaacaatcttgtgattccgcaggagaaggctctgaaagaatacatcaagattctgaatctggtgat

SEQ ID NO: 676 - DNA, 1962 bp, Homo sapiens
atataactagtagttgctggttagtgttccttggtttaagaaggtcactgaccactgtctgctggttaaaagattagccgtctttttcttttttaaacaaatacaattcataaatcagcttacccatagctttatttgggagaataaaaacaaagggagggctgacctccctttaaacattactgcttctaaacagttctacttaggtagtatataaaaggaaaccaaatcatttaatattgccatccttctaattttggggaaagtagccacagatgttggctaaaatgtttataataaactgttggcatattttattttgttttattcttcatgattatctcaaacaccaattttgtaaaactaaacatatttactctatgctttctcccatttttaggtgttaaaaagtaatcgaagtacgaagaggacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaattt

SEQ ID NO: 677 - DNA, 1188 bp, Homo sapiens
atcaggaaaagagcagaaaactacatgaacttacgtgagtaattgtttttaattaaagtttaaaaataaaagctaaattagaggattataggcattacctttggatatagccagtggatacatattttactttgtatgggctaaaggattttttcttaaatccactgagttggtttgatttatatctaaatacttggaatatatacttgcatttgagtgaaagcaaggtcttatatttcattgtggttaagattaaggtttctctttattaatctgcttgctgtttctttatctccatattacttcaggatccagcataaaaatgaacctaaaacaatatattaagtaacttcgaagattttaagatctaacacaaaaactgagtttttgttaaattttctcttgcataaaagagcattgtggtgtttagccttgccattttgaacagaggttttcatggtttaccttttctcattttctcaaaactcagttttctagaatcttagcaggtagaaagtgcatgattataatttttcacataccttgagtttgtgagacaatttgcaaatcaactgatattgttaggatagttagaacatcaggaccagttcagagtggattatatgaagattctgctaacttgcagctgtaattttgtttagaatacttgtaatgtaaaatattttagtctttgacagtttataatctataattaatcagtatcattttggataaatagcagtataatacatgtggcatattttaaaatataaattatagaactattccttattctttgaattctgccacattttatttcatctcttccattgctatatatggaatgtataacaatagactgttgtttagaaggcatatgaaaattttttgaaattgcaaagctgcagtggctcacacccataatctcagcactttgggaggccagggcaggagaatcagttgagcccagtgtttgagaatcagcctaggcaatatagtgagaccccgtctctacaaaaatttttttagacagggctgattgtacatgcctgtagtcccagctatttgggagacgaggtgaggaggatcacttgagcccaggaggttgaggttgcagtgagcagtgtttgggacagaaactctgtgtcaaaaaaaaaaaaattttttttttgaaagacagcacaggta

SEQ ID NO: 678 - DNA, 1257 bp, Homo sapiens
tctgcatgatctggcgcttgactccttgtacataagaatttgtcactcaccacctcactcactgtgcttcagcctcactggccttctctgtgtggtctcctcgtctcaggctcctggtgtacacagcaatcccccatcatccatggttttgctttctgcaggttcagtcacctacagtccaactgcagtctgaaaatattaagtggaaaattctagaaatgatttctaagttaaaatgagtttttaaaaacgttttaaattagttttcagtagtagtctaacactacatcacagtgcctaccttattcacctcacttcatcacatcatggaggcattttctcacatcacaataagggtgaatgcggtatattttgagaaagagactagagtcacataacctgtcacagtatattgttatatttgttctattattgttacttattgtgcctaattcgtaaattaagctttatcataggtatgtacgtataggaaaaatatagcatacacagggttcaatagtggtttcagccatccactgagattgtcttgaaatgtatcccctgtggataagggagaactgctgtacttggggagggagtaaatatgaatagtagaaggtaatgattatttcagctgttgaggaaggaaggtttttgttgttttttttttaagccttagaagaacctaaccatatttgttttacattatatacatccctgacctgtagtgccctcttctttatccaactttttattataaaatttttcaaatgtatagaaaagttgaaagagtaatacagtggccatctatataccttcaacccagattctgcaatattttgtagtattttctcttgttcttttttgttttttttttttttgagacggagtctcgctctgtcgcccaggctggagtgcagcggtgcaatctcggctcactgcaagttccgcctcctgggttcatgccattctcctgcctcagcctccctagtagctgggactacaggcgcccaccaccacacccggctaatttttttttgtatttttagtagagacagggtttcaccgtgttagccaggatggtctcgatctcctgacctcgtgatccgcccgccttggcctcccaaagtgctgggattacaggcgtgagccaccgtgcccagctggtttttttcctgttctttaaatcttgttttctgaaccatttgaaagtatgttgcatatatcatgacacttcaccccaaatgccatttataa

SEQ ID NO: 679 - DNA, 1150 bp, Homo sapiens
gtgaaaggctgttcctgtctgtggtatttaaaatttaaagaacttctgttattatacaattgggaatcctcagggagtaaaatgttaatgaaatccataacatgcacagattttatgatagcagttttaagaaattcctttggtggagtttgttgatttctgtcccagcggtaataattgcaccttttacagagtgcattaatgttcacatttaggagcaatggctacatttatgtcgcgtgtgaggtaacacaccaactcctaagctttaaatactttcatatcgtaatttgaaagcaccagagcaaaaaaatatgtgttcttcagaactggcagaacccacactttaaaactcctctagcacatccacagccaccttctccaaaggtgagagagagctgaaccctgtaaattccaaagccctggtgtggatgaggattttgtacccttgtatagttctcattttatgcaccatttgaaagcaccacatcaaaatggcaattttgatccacgtcagaatagcaattttggatgctgatctgaaacataggcagacgcaagcatgcatgcacacacacacacacacacacacacacacacaaacctctaccctccttctccactctccttctccttccctccctccctcccttagccatctaatctcattcaattctggattcaaataaagagaggaaagtagattaaattttaaaatgctctataaatcccaatagtaataaaatacattatgcttttatatttccaactattgaacagagtaagtgtttgagactaattgcacatgttaggattgaggatgatgacatatgcacttgtgcatgtgacttgggcacttttttcccagctctgtttaccccaaggggtgaaaaatgcacttatgtatggcattattctaattgccttctttcaggagaatgagatgtctcaattctaccaaagttttattcttcctacaattccaatgctttaaacttctaactacatattttggatctagaaaaataaataaataagctcctttattcttttagctagcctgagaaggctatcagtgaaattctccaggggatgggtgatcggaccagacaggtgcttgggttgtttcaagcatttaaaattctgtgat

SEQ ID NO: 680 - DNA, 1361 bp, Homo sapiens
gatcacgccactgcactccagcctaggtgacagagtgagactctgtctcaaaaacaaataggaaagataatctctttatttaaaccacaaatgccactattttcaggaaggttatgccaaataattgtgattacctttggcagaagaaccttgcttttttttttttcttttttaatatttctagaacctggttgtaggtattggtctacaggaccataggtactgcttagtgaagcgtaatcagcacaggagcaaatgaacccatgactatccatattagatatggtgttactatattaacaaagaaacggtaatgatacatcctggcctggatggtggttaagaagtatttctgacactttctcatgaaatagatatatgattatgatataatgttaagtatataaaaagcaacatataaaattgtgtgctaaaatagggactggacctatgaaatgataagattttgtgtttgaggctggacatgatggctcattcatgtaatcccagtacttttggaggctgaagtggaaggatcacttgaagccaggagttcaagtccagtcttggcaacatggcaaaaccttgtctctgcaaaaaatacaaaagttagccgagtgtgctggcatacacctatggtcccagccacttgggaggctgaggtgggaggatcacttgaatctgggagtgtggggctgcagtgagccatgatcatgccactgtactccagcttggcatggcagagtgagaacctgtcttaaacaaaaacaaaataaggccgggcatggtggctcatgcctgtaatcccagacctttgggaggccaaggtgggcagatcacctgaggtcaggagtgcgagaccagcgtggccaacatggtgaaaccctatgtatactaaaaatacaaacattagccaggtgtggtgatgggtacctgtagtcccacctactctggaggctgaggcataggccaggcgcggtggctcacaccttaatcctagcactttgggaggctgaggcgggcggatcatgaagtcaagagatcgagtccatcctggccaacatggtgaagccccatctctactaaaaatacaaaaattagctgggcgtggtgatgtgcgcctgtaatcccagccactcagaaggctgaggcaggagaattgcttgaacccaggaggtggaggttgcagtgagctgagatcgcgccactgcactctagcccaggtgacagagcaagactctgtctcaaaaaaaaaaaaaaaaaaattactactattcttacttgggcttcataatctaacttaaagtagatactctaaatcttttcccctatggaaaacaattatggctaaaacattttaa

SEQ ID NO: 681 - DNA, 8695 bp, Homo sapiens
aagcccctcttcagggactgcggttggctgtagaaaatgcagtccttggcttcattgtccacacttcctgcccagagcagtagtctctgtctaggggacacccacgtctggctggtgggcagggaaggggcttcaccaattcctggtgtaaatccgtttcccactttctcttctttatgtgcaggcttcttcctctgcacagagaaagcctgtgacatgccctttagtggggagtatcaaagggttgtgagtgctcagtatgtgagagaaagactagtcttaagaggacgtgtgtgtcattcttagaacaacaaaaagaagacatggaaagtatttgactaattgatttttgccatttggagcaaaaatctaatttttgtcaaagtgatgctgggaccatgtaattttgtgaaagtgaagctggaacacataattcctcacacactcagccttgtgcgggcggctgtgattccttcgccaccatgaagtgaagtgcatccaaagtgtgagccagtgtactgccttttttttttttttttttttttttttttttttttttttgagacagagtttcgttcttgttgcccagtctggagtgcaatggcacaatctcggctcaccacaacctctgcctcctgggttcaagcgattttcctgcctcagcctcccgagtagctgggattacaggcatatgccaccatgccaggctaattttgtatttttagtagggacgagatttctccatgttggtcaggctggtcttgaactcctgacctcaggtgatccggccacctcggcctcccaaagtgctgggattacaggcgtgagccgctgtgcccggctggactgtgtttctttttgcactttttggtttttcattttagtgttcttttgtgctttctgacctaagtgctggcaatgtgtaccttcatgtgtgaattgattatgaagacaatttctaagagcaatcctcaagactcagtttttgtctggctttctgtaatcattgaagcaacttaaaaaaaaatgtccacttcatctttagagttctccccctgcccaggcacacaggtctcactgcacaccctattcgtcaccccacaagatgcatgtgctgtctttggcttagcagttcacatgcaaatacaaatacagtcacgtgcagcataaaagcatttcagtcagtgatggaccacataaaccacaatggtcccgtcagattataatggaactgagaagttcctattgtctagtgacgtcgtagtgtcgacctgcagtgcagtccttaggtgtctttggtgatgctgctgtgaagaaacctactgtgctgtggttgtataaacgtctagcacatacagttgtgcacggtgcatggtgcttgatcatgacaatctttgactctgttactggcttatgtatttactgtactttttattgttattttagagagtcatccttctttaaaaaaaagcccgttgtaaaacagcttcaggcagggccttcaggaggtttccagaagatggcagctccatgtgtgctgtcacctctgaagcccttccagtgggacagaggtgctggtggaagacagtgatgttgatgatcctgaccctgtgtaggtctaggctaatgtgtgtgtgtgtgtgtcttagtttttcccaacaatgtttacaaagtaaaaaaccataatttaaaaatggaaaaaagtttataggataaggatagaaaggaaatatttttgtacagttgtccaatgtgtgtgtgtttaagccaagtgttattatgagtcaaaaagttgaaaaaattaaaagtatataaagtaaaaaagttacagtaatctaagtttaatttattgtggaagaaagaatctttagaaaatgtagtgtagcctaagcatgcagtgtttctaaagtttacagtggtgtacactcatgcctttggcctcgacactcactcaccactcactcactcacccagggcaacttccagtcccgcaagctccattcatggtgagtgccctgcatgggcataccatcattcaccctttataccatatgtttgactgtaccttgtctatgtttggatgcacaaatacttaccattgtgttccagttgcctacagtattcaagacaataacacgttgtacaggtttgtagcctaggagcaagaggctatgccatgtagcctaggtgtgtaggaggctctaccctctaggtctgtgtaagtgcactctagcctgatggcacaactatgaaatccctgaatcacacatttctgttttaccttaattaattatggagataaggccttgctgtgtttcccaggccgatctcaaactcctgagctcaaataatcctccttccttggctcccgaagtgctgagattacaggtgtgagtcctgtgcccaagccatgcgtctctcagaatgagtgtgcccctgttaagcgatgcatgtctctgtatgctcatgtcatgcctggcctttactggctacttgtacagtcatctgtcagctgtgacttttggggctataaatccatcaaagttcaggaatctcccaaacttggttcatttaatgcttagcagacgtagctccacagccatatttaaaactgatgatgatggtgtcccttgtttggaggattcatttgtaagtgaccataatgagtttatcctggccattccccagagaacagcaggactcctggttcatctaggatgtgtgaagtgactggccctctgagattgctgggcttccttaaaaatgtcacatacaaggacatagattttcacattgtgtagtattgtttatatcaggggtccccaacccgcagaccactgtgtggtactggtccatggcccattaggagccaggctgcacagcaggaggtgagcagcaggggagggagcattactgactgagctccgccgcctgtcaggtcagcatcggtgttagcggaactgtgtgtgagggatctaggttgcacgccccttttgagaatctaactaatgcctgatgatctgaggcggaggccagatggtttcatcctgaaaccatcctcccaagcccccatttgtggaaaaattgtcttacatgaaactggtccttgttgccaaaaaaaagttgggggccactggtttagatcttgcagtattgtgaagtaatttttggtcttctgagagactccaagcagcacaccagcatgaaaagatgagccattcacggcagctcttggcattggttttaagatgaaatacatcaatattaaaaataactataaaacattcatgaaagtttttggagtttctttgaagaatgtctttgaagctgacttaacattattgcatttattacagttgctctgcagttcaactgggctttataggtttgcatctggggttcacatatgcattttaagacgaggtttgagtctgtttgtataaatcaaatgcagtcctcagactcatgtgcaggccgcatggcgatcccgggatgaagtagatatttctatttataaacagattcctgagtacttcagatattatttgtatgttggactcctgtctagaattggcacatatctacatgtacagagaagaataatgaaatgtcaggggtctcactgcaccctcctctttgatcccattctctgaggttttaatttgggcccaggaagcagcacttaaatatccctactccagctgctagcttcaaacaatacaaagctaggcttccaaatatatttatcatttcttggttgaatatttgcaaaaactgacctaccctacgatttctctcaaataggccttagcaactacaaatatggatgagaagatagaaagggaagctttatgtttgcttgcattttagctaaaagataattagaagtgcaatttaagttatgataatggaaaaaaagagctacacgttaagtgtggtgcattgactgcatcgagaaaaggtgcagtctaaagcccagcaaagcttaaaagagaaaaactagaaaaaaagaactttttggaatataaactgtgacagattttttgtattttctgtgggcttgaaaagtccttaacgttttcgttgttactgccctggtactatttatgtgttagaatacagaacaactttaaatttgtggagtcttatcagtaggactgctggctttgcgaaacccgtgcaaaacggacactttgaagtgaccttccctgtttaactcatccgctcctcccttcagtgagtacatactactgtgtgcggtgtgctcttccagatgctgggatgcagtagtgaatggagacaaagcccctgtcctcatgggcttagactccagcttatgacttgttgtttataataaataatgaacattgtgaggttattcacaggaagggatgaataatggatggatcttcaaaacgtgattctggttaactacagacatcctgaagttccaggtataaaaagccttctttaaagcatactatagcagtcagaatgaatgagtagttaataaagctctttgctgaaataaaagcaaatatgttcacacttccaaaaaataaatacccaagtgggagttgtatggttctgatgtcaaacatgttatgagaccatcagaggtatatggaaatttggggaggaagacagtaattatataaaagtgcatgcaagcctgggcaatatagggagaccctgtcagcctgcaaaaaaataatgataataaaaaatcgtagctgaaggtggtggcatatacctgtgggtcccagctgcttgggaggctaaggtagaatcactaaggagaatcacttggggcagggaagtggtggctgcagtgagctatgattgtgctattgcactccagcctgggcgacagaacgagaccttgtctcacgcacacgaaaagcaattactgaattagagatgtgatgtgggaaacgctcccatctaagtaatgaccaagaatattccgtgatagagatgaagtcttagcaggacttccctctcaggttattagtggtgatgatcctgctttgttttattaccttattactattatgctctctgaggtatgaagtgatattaatctgtttgcagtgagaaataacactttatagcattgctatcatttaaacatattaaaatatgttgtaatgcagaaaaacaccctggggagagaggtgaaaacttaggagtttaatttgaaatgcagttgggaaattatttggacagcagagaaagctttagggcaaaatttcagtaataaagtatattattttctaaattattcatcagggagttgagtttgtttttcatgtacctggacttaatcacgattacaaaaaaatgcttagctaattgtagtcattcatctatactaatccaaaaacaaaaatgaggagttattgatggtttttatttaggtaaaacaatttatttgactgtgagtggttacatatgataaccatatattcagttatttctaacttgcctgttttgtgaagaatgctattttgtgactgttcctgcgtctcgctatgttttgggggttctggcctagttcctacaacatatactcttatcccggttctgtgttgtcctggtgattctcccaagagctaatcagttaaagagattttcttttccattttggattttagcttggagttttactcttagtagtaaaatggtatctaaaaataaaacggggaagaattagaacatgtcagatatagtaacacgttttaataatttgctctaaaaatctgctcatcagctgataacctttcgtttgtccacatgtctgctttttaaaacgcttggtttcttaatatcccagtgagaacaggcacctgcagagatacttagttgctcccagccgcagctgcagagcgacttctagattctgcgtatcttggtttatttcatgctgttttctttaagccatactgtctgctggtcagatggtaagagatacctgttttggaaaatttggtaaataatccagggttacaagtaaatttagcataatgtagaggctttattttgctcatttaaaatatgtagtcttggccaggcacagtggatcacacctgtaatcccagcactttgggaggctgaggcaggtggatcacttgacgtcaggagttcgagaccagcctggtcaacacgatgaaaccccgtctctactaataatacaaaaattagttgggcgtggtggtatgcgcctgtaattccagctactggggaggctgaggcatgagaatctcttgaacctgggaggtagaggttacagtgagccgagatcatatcactgcactccagtctgggtgacagagtgaaactgtgtctccaaaaaataaaataaaataaatcaaaataaaataaaaataaaataaaataaaataaaataaaaatagtgttggctgggtgtgatggctcatgcctgtaattccagcactttggaaggccaaggcgagaggatcatttgaggccaggagtttgagaccagcctgggcaacatagtgagaccccatcactacaaaatataaaaaattagctgggtgtggtggcactcgcctgtagtcccagctattcaggaggctgatgcagaaggattgcttgagcccaggagttcaaggctgaagtgggccaggatctcatcattgcactccagcctgggcgacagagtaagaccctatttctaaaataaataaataaaacatgtagttttacctctattcagcaattagattccttacaactcataaactgtatgagaaattgaattccactgtttttgtcactgagaatgctcttgtcctagcagacctgtgtgtgctaaattaaggtctgatctccatcagtcactaagatgtggccaaacataaaggcttttcatagttgttataccccgtaagtgatgaccctgagaaatgagagtgagactgtcaaggtacatcttttgtccttattccctagattagttcttgaaataagccaccagttaagaattttgggatttcctgtgcactggcagtggttgaagggtttaacatgcctgaaaccttgagcacaaatccctcctgcagctgccctgggccatgtcagccggcaccagccatgctgtggcaccagagaataagcctgcacttaatgtcatagcatttcagagaactgtcggagcgtggggctggcccttgggatttagctgctgcttgtatgaagcagttttaaaatattaagcttagaaaagtcccactgagctgggtaaagactttgtgtcctttgggtccctctctatgttttatcagttttcagctgcagggcagatgtctcccctgggctgcagtcttaggcactaagatgtgttgctggcagatttgactctagaagccccaaagggcaggcagggataaatagttttgaattttgtttctagtctcttctgtgttgtattggtttcagagttcagtatccagtcacagtggacagttttgtagtattttgcagcctaaaaaatttatgcaagcagtaaattaaaaatctgaaaaacacacgcatacacatgtgtgcacacgaaggcacatacacatccctccatggagtcttccactcttgtgtgttttgtaattctctttatttttatttgtttacttggagacagggtctcgctctgttgcccagggtagagtgcagtggtgcaatcatagctcagtgcagcctccacctgctgggctcaagcaagcctcccacctcagcctcccaagtagctgggactacaggtgcgcaccaccatgcccagttaattttctaattttttggtagagatggagtctcactatgttgcccaggccaacctttaactcctggtctcaggtgatcctccccagttgtacctctcagactgattataggtgtgagccgccacacctgacctataattttattttagatttacatgagaagtgatgctgttttaaagtgtaatgctctgaattaaaggaattctctatggtaatatatttatacataacaaagcactaacaattacagaaggccttgatgcctgttctattattcgttttatgtttctgtgagtaattgatgctttgatgtattttggccatagaggcactattgtaatgcatgtagactgactttcactggacagaggtttgctgagctggttctgttcatgtgctatggctggagacatgaggcagaggacacagaggccctgccctgatggcactcacactgtaaacttgaggcaatgaggacgcacagttaggagctgaagttgtaccacagaacacataaagggagagttagacacaagacgagggggctccaggtgagccagtgagagccgtggggccttctgtccctccagccagcagacgctgagtgactgcaggacccagccgattccaggttcccgagcaagctgccttctgtgcttgtgatttttatgttgtggggggattgatggtgccgcctcaggtggagatcagtgtgacggagtccacagggcaggatagaacactggatgtgtgcagtagggtcttaggccaagtccactttctctgatgggggagcatttcagcaaaggcccttctgggcatatgaaggtttcccagtcagttatcagggcaatgggaagccacagagctgggggtctgctggagagtgatca

SEQ ID NO: 682 - DNA, 1192 bp, Homo sapiens
tattgttagtgaccttttcatatacctatggcttgcctcccaaaattgattttttttttttttttttttgagatggagtctctgttacccaggctggagtgcagtggcaccatcttggctcactgcagcctcctcctcccaggctcaagcaattcacctgcctcagcctcccaagtagctgggattacaggcatgcaccaccatgcccaactaattttttgtattttagtagagacagggctttaccatgttgcccagggtggtctcgaactcctgagctcagacagtccacccatctcggcctcccagagtgctgggattacaggcgtgagccaccacgcttggccccgaaattaatatttaagtgttgtagaacaggggttttattatagatttggctgtaccgctgttattgcataacacaattattttcagactgggtgtttggttcttaattcactggtggtgtgcaccatgccatcctgccatccccagctgctgtcagagtacatggtaaatatagaaatgtgtccagtcagtagtagccacgtggacgctcttctccatatttgacttttcttgctcttagaaggcttttccagtaatctgcgtgggaccgtgactttgcttgcttatggtgtttccagcacctccaccagactctcagggtttggaaagctgttctgggtgaatggtgtctacagaactttgaactctgcgattgcaggggaacatgcttataaatgcgtgtttaatacagaatgttgtagaggagattaggtacttttaattttgtattatgggttgttttcaagatctaattatgtgttggtaggaatggctgttttatttctacttgtgggaaaaaggctgcctggagtttgtttaatttttctgatatagcatcatagactggtagagcaatataggaaccccagagaccatccaactccctcatttctatacaaaaggacttgggtgcccacaaagaggaaatgacttgtgcagtttcaggccacttaaccacagagtcattttattgtcctttttgtggctactgatagataaggcttgcactcactagatgcccttgtcatcaaggcccaggtcaccagctgcacacaatttatctgtatgtctttaaagcaggggggtccaatcttttggtatccccgggccacactggaagaag

SEQ ID NO: 683 - DNA, 1190 bp, Homo sapiens
aatgggtgattcaggtaaatgaagttagttcagtgattgtgatccctgtgtgaccactttagtttttatttgtgtttaaaattaaaaactaaacttgaggcataatatcatttggtacctgcaaattttaattaacacatggaatgctttgtccacagttttccaaagtggttatgccactgtatactcccagaagcaaaggtgagaatattccagttgccccatattcttaccaatacctgatatttctttaaaacacgtgaaattgagtttcactgtaatcttcctaataatagataagaacgttttaaaacccagttgccctttgcagtgtgcgtcatcagaaccgtccagtcttggggtgccttccataaatgagaactttgtgatctcctcttccacgaatgagatatttagttattttgttgaggagtgataccagccttttgctcagcctcttgaaagagaaaaggtcagcatcatcttagggatttcattgagcacaaaaacagaatttaccataagcatgtgtgagctctgaatgtcactacatatctgtcctaatgcgtctcatgttttaagtgtcttgctcctttgtctttctgttttttttttccccagcaatctgattgaaatgggaaacagagggataggaatagcgtgcgcttttggacctctggatatgtaattctgctagatttagccaaaaatttgtgtcacgttcctatagaagagagctactgacctggggatgcttaacttggggccggcttgttgagaagtcatacattacattctgtgaatttatcttttttaaatcttcgtatcgtgtcagagtctctggaaccttttttgtccttagctccctttaacctttgtgctagagaaaaggcaggtccagaatggaaagggatttcccggtaaagcatggcagcttttctcatcctgcaggtctctcttaagagagctatgcatcctggttcttagaagatggcaggtgaggaaggggcctctgatatccaaagttagacttgattgttctttagtagtgactgagtctaagggagtatttgttgtttggagctttaaagtttattgtatataagcagtatcccattatgtcagtttccattataaaaatactatactttattattggcttttacaatatgagaatgcaggtttcccta

SEQ ID NO: 684 - DNA, 1137 bp, Homo sapiens
tgtaggaaggcttgtatggcaaattgtggttacgtgtggttaattttagctctgagcatggtagtggctacccatcacccgtgccagcagctttgtatgtgttcctgaagcagcttgctgaagccaggataggcattaaggaccctgtcctgcaaatattggggaactgtgctctagtcactgattgctccttctgatcgtggaggtgcagacacggaggtgtaaacacagaggtgagcggctattgtaactcattgccattgttgcaagtccttccccttattcactggagagatgctcttttgatttaatgaattgcttcccccctggccttcatccccccttccttggcaaaatttctgagccattcccagagcctagggtggagaaagtgaaatagttctttctagcacccatgttttagatgaagtaaattcctgaggatttaaagacttcgtgctttccccttcatttctctctctctctctctttttttttttttttccattatcggaaccagaaatgtaaggactgggacctttagcaaccacgtatacagaggaatttagaaagttgccacacatgcccaggaaaaggtccaggctcagaagtgacctcagaagagcttaagtttacatctcagtctaatctttcatatgcagacaccctgtaactattttttaaaaataaatgaatgagaacaaaaagcctagcaaaccttgggtaatggggagaatctgatctccagagataccacaccataaatttcaaatgtccacttttcaacaacaacaaaaaaatcaaaagatgaacaaagaaacaagaaagtatgactaattgaaagcaaaaaagaaaagaaactgtccctgaaaaagaccagattgtgggcttaccagacaaattaaaacactgtcttaaagatgtttaaaaagctaaaagataatgtggacaaagtcaagaaaactataaacaaaatggaaacatcaataaagatagagaaaacaaattctggagctgaaaagtacaacaactttgctagagggatttaaaagcatatttgagcaagcagaagaatgagtgaatttgaagatagggtcattgaaatcaaatttaaggaaagaaaaaagactgaagctg

SEQ ID NO: 685 - DNA, 1153 bp, Homo sapiens
ttctccattagagaaggtatttataaaaataggaatgaggagagctagaaaacctggagtgtggcattagaatagaactcatatcttttaaatatataggaacaaataaataaattgttgtgtgtgcacatatgcatatattttgtgttcattctactgagaggacctaaacacaatgacacctcagtaacagtaagcacaccaactgccaagttattagttcctaaatactatccacaaaaaaggggaacagggatgattcctagtcagagattgggagaaatacaagatgagcctgaatcatctcatgtacctgacagtaagaaaatactctggctggtctcagtggctcatgtctgtaattctagcatgttagaaggtcaaggtgggtgggttgcttgagctcaggagtttgagaccagcctgggcaacatggcacaattgtctctacaaaaaatacaaaaattagccaggcatggtggcatgcacctgtagtccgaggtactcaggaggcagagacgtgggaggatcgcttgagcctgggagattgaggctgcactgagctgtgatcgtgccactgtactctagcctggaagacagagtgagaccccatctcaggaaaaaagaaaaaaaaaaagatgtcattcagcaggttaatggataaactgtggaacatccagaaaactttaacattcttcaaagaaatagaaaacacaatcctaaaatttatatgggaaccacaaaagacttagaatagtcagctatcctgagcaaaaggaatcaaactggaggaatcatattacctgacttccaattattcaacagagctacagtaaccaaaacagcatgatactggcataacaacagacacataggaacagtatagacaacccagaaacaaattcatacatctatggtgaccacttttgacaaaggaatgaagaacatacactggggaaaagataatgtctttaataaatggtgctgggaaaactggatatccatatgcagaagaatgaaactagacccccatctcttagcatatacaaaaatcaaaattaattaaaaagttaaatctaagacctcaaactatgaaacagctaaaagaaaacatcggggaatctctccaggacattggagtgggcaaagattt

SEQ ID NO: 686 - DNA, 1172 bp, Homo sapiens
cacactgtcacccaggctggagtacagtggcacaacctctgctcactgcagcctccacctgccaggctcaagcaattctcctgcctcagcctcccgagtagctgggattacaagtaagtgccaccacacccagctgatttttgtgttttttgtagagatgaggtttcgccatgtttcccagactgttctcaaactcctgagctcaaagcagtccacccaccttggcctcccaaagtgctgggattacagatgtgagccatcttgctcattctagtttaaacttttgagtggtttgtgtctcctgattggactcctacaaatacagaattgatgctaggaagggtaccaggagatagacgcacacagatgggatttgggaataggtttggttatccaaggagcagtgctgagctccttgctaatgggatatgggatgctgatgatttccaggaagtgacctcacaatgactcaagctaccacatgctgttgattgtgaaatgccagttgaagcatatgtcctgcgagcttaggggtgctacaagttgaccactgcagcagtaaagatgactctgaagaatggcgtgggatggatcctttcgaatgcacttgagcagcggtctccaaccacagggccacagagctggaggtgagcagcaggtgagtgaagggaaacttcatctgtatttctagcccctcccatcacttgcatgaccacctgagctccatgtcctgtcagatcagcagcagcattagattctcataggagcacaaactctgttgtgaagtgtgcatgcgagggatctaggttgtgtactccttatgagaatctaatgcctgatattctgttactgtctcccatcaccccagatggacagtctagttgcaggaaaacaagctcagagatcccactgagtctacgttatagtgagttgtagaatcatttcattatatgttactatgtagtaataatagaaataaagtgcacaatatatgtaatgcacttgaatcatcctgaaattattcccttactcccagtctgtggaaaaattgtcttccacacattcactctgttttttggtagaggcagggtcttaatatattgcccaggctgatctcaaactcctggcctcaagtaatatacctctctcagcctcccaaagtgctgagatta

SEQ ID NO: 687 - DNA, 1205 bp, Homo sapiens
tggttagaccccccagtggaggtatacactaatgatagcttttggatacctggttctacagatgatagaggcccatctcacccccaaaaggagggaacaattatgaatatttcgttgggatttgagcatttaactacttgcttgggaaaagccaacaggtgcttacctcccagtcatcaatcttggctggcaatagtgcctgaaggtaacatctctgtggcacaattacatatgctttctgaccttagtatttattacaatgattatgcccctgtaaccaaagtttaccgccctcaaaaacctatctgtatagtggattgaacatgttcagaaaaaaatgaagatatttacttgggaagattgtattgcagggcaagcaaaggtgttgtgtaatgattcatatggagtcactattgattggtcccctaaaggggcatttataaggctcacttctcaatctgtaggtaatggtcaccctgcatctaaagaaaatgatcagatggtagacactataaaaaatacaacaaaagttcctattatttggacatatggtgatatggtggaacctcgaccccaaatgatacgacctgctgtaggagctaaacataaggaattgtggaaaatattaatggcactgaaaaagataaaagatttgggaagggaaatatactaagccatcccaatataatcctaattacatgttagaattggctcacaatgattcagtctggatacatagttgtgtctgtcctccctttctgcttgtagtgagtgatttaaaacttgatctccctaatcatcatgtgactgtcaagaatgtagattgttttcttgtgtgaattcttccttgtataatactgatcattctatcttagtggtaagagcccgagaaggagtatggatacctgtaaagctttcccgtccttgagaagcctctccttctgtgcatattattactgaaattcttcaaaagattttgaggcactctcagggtttcattgctactttaatcattatgggattgattgctgtcacagctactgccacggtagctggagttgctttaccaacacagtacaaacagcagattatgtaaataattggcagaaaaattctactttgctgtggaattcccaaactaatatacaccagaaattaaccaatcagattaatgatctccgacaaactatcgtatggttgggaga

SEQ ID NO: 688 - DNA, 1391 bp, Homo sapiens
agtggagccacaggcgcaagtggaggtggtgccgccgcggcgcagcggggccacaggaaccgaccgtgtctggagaaattccactcctgaattctgccaaacgaggaagtgttgaggacagccaaatcatcagggagatgtaattcataagaaacctgtgtaatttaaatactcataatttatttcagctaacgaataaaattgcagtattgcactcggtgcatctgggaactaactaccgaacggcgctgaaacctcaggccgtttctaaaggagcggcgcgaggacttctgggaaatgtagtcttcactttctcagggagcggcgcgagggcttgtgggaaatgtagcgtgtactttctaagggagcggcgcgaggacttgtgggaaatgtagtgtgcactttttggccccggtcgcgggagccgctttgggctttctgcgcatgtgcgcggtgtggctccaggtttgtttttctccggtacagcctggtagggagggctcccggcatctccctgcttcggggcagaggatgccgggggtagagtacgggagggctggagcgagggtggactggaggtgccgcttgtcctggaggtgggagagagggagcggctttgccgcctggcctgcgtcctaatcctgtcctggttcttctgctcccgaagggaacgtaggtcccgcgcctgtgataagtaaggttggattttctcttccctgaggtgaaggatgcccggaggcctcggcaggaccgtgcggaaacgggccttctgcccaaaagatgctgcttctctccttattctttcccctcagaatctcgctgtctccttccaaccacctgtggtcggcatccccgcgttgtcactgcgacgcagaggcgagcgaggtggcgggaagcacccgcggggcggggagggaccctgcgggcgcggactccacaccaagcctctgctcagcgtcaccccgcttgctgtgtcctcgcaggtcgcagcttcatggcctgatgccttcaggaagtattttgaagtcatcgtggctgtggattgggggatttcttgtttccactgacctgtgaggccgcgcacgtggagggaggcaccccgggtcctccggcactgtccggcctcgcctgtgtccctagtagcagtgggcatttccagacggtgcagcttgtggctaaagtgacaggaagatgtaggagctttcagtcttggatgaggattcgaactgaagggcttaggcccagctgtcttggagcaaaacatctgttgtggggtgagaagggaaaggaggggtgagggtgcaggggccctcctaggaggacatcggacctgttgggccgagacctcattagagatctagagcacggatgggaggagcagaggctcgatt

SEQ ID NO: 689 - DNA, 1163 bp, Homo sapiens
ctcactgtggacaatccacacacattcttctttcctctcctggcggggcacagagccacccccttgccttttcttttcttgaaggttctagttcagctcctgattcatcagacccttctagccccctgcatctagcagtgaagcatgaagcctggtggggatgtggtactcccatctggtgtggccaccagctctgccaatgttcctgtagccttggaaaacttgctctctcggttcttttgggtgctgtgtactccccagcttccccccttccccccccattttgcacctgggtttagtgaaaggatggcatttggttgacccatatagaaacccagaatgaggtctcagggccaggaggcctggtatttgtaggccagggaaggggaagaggcaagtggtctggggtatcaccagccagccctctctgatttggcctctactccccataagtcacagtaccataagcaggcttctggcctcagcaatttggtctttgtgcccaagtttattgtgagaatttcctgaaaactctataaaaggtctcttcctactgtaggcctctaatgtttctcccctttttgcttcagtccactcttcagtcttgtaggcctagttttcaaacctgcacatgtgtcctacctggccacaggcatgcaggcctcaggcagctgggccagtttgggagcctcgggtgatgtctgcacgatctggggctgcctctgcacccctgctgtgggcttcagggttggagaagggctgggaccaaccgggtgagatccacaagtctctggatgtggctgaaggcaaatacacaattgaagtactttctgttttgaagtgctttcccttttgaatctggtttgaaacatgcagcttctgtctctagcccaaggaaagaccaaaacatagggaaataaaagcatttatctttgtcttggaagtaattgttgaagttgtgcagttgatcagtgcacagttagatgcaatgtttatagaaattgattgttaaaccaaatttacactggcatgtgtggtgtagtttctaaaaggcacttcacatttgaaatttttcttaccttagaaagtttctagtgatctaaatgtctagttttgtattcttttgtgtgtgttcactgtttctcagtattaccacttgaata

SEQ ID NO: 690 - DNA, 1099 bp, Homo sapiens
cagatctagccttctctgagcagtgaagatgggatgttttatggtcattttccctggtgtggagagcccaagtggagttcttcagcacaccctacaccatcccctcactaacacccccacctgtccagtcttacctgccttcatatcaaaagcactcagttaacccagagggcttcagccctgccctgcctgactttctaggaaacccctctctccacccaccctaatcagacactgtctgaaggttccccctcatcattttaaaaggaagagaaatttttctgacacagaggttctggtgaagtggccagctcccacatcacagggtgatggtggtttggactggaccaggatcagacagtgctgtcctggggctggccatctgataaggggctccagaaagggcagtgatggacccctgggaggctttctgctctcctgatcacaggtttttggtgagaggacctattggccactagggtgtctgcgggggtgtgtgtgtgtgtgtgtgtgtgtgtgtgtgtgtgtgtgatgtgtgtttacttggaatgacttctttcagcatgaagcccactgttttgctgaacgtatctcactgtttcctgaaactcagtacattcagctggcttaagggtcctggggcctcgctgtgtcatatttgcacaagcctagtgtctgtgcagactgtacactggagttcagttgtaagacccttttgatcccttattctgttcctgtaatagaaaagccatttcactcaatggaatagaaacccagatctaatggagagatgttctaatctgccatacactggggcagtggccagtgatttggactttgtggcacagatggaaatttccaggttctctaggtggtaggcagaggcctcactttttaagaaactcccccactccacccctgccaatgaggacattgcttagaggtatttctatcagtgttgagtagaagagatcatttcttggtgttgaatttcaggtaaggatgccagcttctgcatatcagggtggtgatgtttgggctgcgacaggtctagacagcagtctgaaagggggctcaaggaagtagctgtgaaaggccc

SEQ ID NO: 691 - DNA, 1186 bp, Homo sapiens
tcgtgggaggggcctgagacaggaaggagattgagtcaccgagctggccaagaggaaagagaagagaagagaagagaagagaagagaagagaagagaagagaaggagggaaggaaggagaaagaaagaaagaaagaaagaatgaaagaaagaaagaaagaaagagaaagaaagagagagaggaagggaggaaggatggaaggaaggaaggaaggagaaagagagaaagaaagagagagagaaacagagagaaagggagaaagggaggaagggaggagagaaaagaaagagaaagaaagaaagaaggaaagaaagagaaagaaaagagagaggaaggaaggaaggaagaaagaaagaaagaaagaaagaaagaaagaaagaaagaaagaaagaaagaaagtaatcagcatgtccaaggagaggaactaacattccccctctccctctgtctctctctccctctctctcctctcatacagcacacacttaaacacacacaccacaccagcggggcagtctcatgtatcttatccttagggcaacctcactgtgggcactgtattttgaaccccttctccccaaccttggttgcagtgcctggcatccactctagcaaccacctcttttccataccagctgaggtggcttttacgaagccaagccaccctattcctgggatgagaccaggttggctttagccaatcagcacattgcattggtttgggtggttcagggatgggtgagtggaccaaccaaggccatgaggcaagaagagatgtttgggagagtagggaggggcagcttcccagcacttctgagagagacactggaagataggctctttctttgtgttggtcatgaaagaaagagtattagttcctgaagcgagctggtgtccagcattttttaataatgaggggactttgttgagaatgaagcaggcattccagaagcaaacaggagaactggaaaaaaaaacccagacttggttaacattgtcaagctgctggatccagccatgcctgaagtccatattatgagggctttcctgctcaaggagccaataaatcccctctttttaactgactttcttattgtctgcaattgaaagtttcttacctggtggtattttcttttttgatcaaagagaaaatggatattcagaaggtatacgtttgccagataaa

SEQ ID NO: 692 - DNA, 1391 bp, Homo sapiens
atactacattcctctgtttgtcaatttttagatttcgattctatttttggctactattgttcatatttcaatataaactttataatcaggttgtcttgttttcaagaagtctttctggcatttttattggtatagcattacatttacatattaattagggagtgttgatgttttatgatgagtctgcctgttatatccagcgggaggaaggagttatgatgagagggctttaggacggtctagaaatgtccccagatctaaagcactcagtttatcacaagaccaggcatcacaagaccttagtggtgaccaagttcccttcactgcatgtagcaggcactccgtgagcacctaccttgtgccagtatgtggctggggctgctggtcgccttacatggactccttccatctctttactaataagatattttagcagaacgctgctgcttggctaaacagctccaattttcggtccttttcatagctaggtttggtcatgcaaatggaggctcatgtgaggcttctgagaattcttcttaaaagggagggggtgttgcgaaggcccatggcgtgtgttgatatgatataatttctgcccagtgctctgaatgccaaagtgaagaaattcaatgaagtgcaggtaaaggagtaactatgactctcttaagtagctgaatgccttgtcatctaattagtgatgtgcatgaattaatgaagtggagattctcactgtccctatctactatccggtgaaaccacagccaagggaagagtcttggtggaattggcggggaaagaagaccttgttgagcttgactctagtctggcatggtgaagagacacgagaggtgtagaataagtgggaggcccccggcgacccccctccccttgagggagcggggtggggtacactgtccttgtaggcccctgatgaaaaaagaaaaagaagggagcagggaaaacccctctttttgtcccttcctccttccagatgcctgcaacatatatctggtggctggaacttggtagacatcatggaccagaacactccatgcttagatggtggttagtagaggtagttggagtcagggtctctgggactgaggagcggcctcaactcttgacttctgtattagtcagggttcgccagagaaacagaaccaataggagatctatatgtatatctatatagtctatatctacatctatagctaaacctatatctgtatggaattgtcacaattatggaggctgagaagtcctgctacctgctggctgaaagctggagacccaagagtaggtggtagtttaagtccaaatatgaagacctgagaaacaggagagccagtggtgtaagtcccagttcaagtgcaggagaagatcaacatccc

SEQ ID NO: 693 - DNA, 1135 bp, Homo sapiens
ggcatgctctactactaatagactgggcacagaaacccagcaaggcctgcctgcccagattctcccttggcctttctgtgcagcatttcttcttcctgggtatggggtacgatcttttctgaaatgggggtcttacagcctgcaatcagacaaggtaggtcatagaatttctttatggccagttccaagacagaaaggtgtggggaaagattagagtcctgctgtggggagaaaagggagtaggtgaaaggagggcaggagaaggtcagagagagagattctgtttctgaggctgcttctgaggcctgaagtgccccagtaatacaacaaaagaccttcacctttgtccctctgaagctgttccaaagctgattccagaaccaaggacaaataccttaacaagtgattgttttagtcacttaggaagggctatgggagttatgagctaggaaccatggatgaaaaccaatatatgtatatcataatatcacactttatcactgttttgtcactgagcacttccatttcctctttagctttgctctatagtgcatttggtgtcatcattgagaaaacacgaggtgcagaagatgaccttaacacagtagcagctggaaccatgacaggcatgttgtataaatgtacaggtgagtactgttgaatggggagccatctcttaatacacttgaagtgcgctttttaaaattcatggttttcaaggaaattacactctgttgcagtataatctagtgttctaactttatggttattttggtttggtttggtttttaattgtggtaaaataaacataagatttacccatcttaaccatttttaagtatacagtacattagtattatagtcacatgattatataaccaatctctggaactttttcatcttgcaaaactgatactctgtacctattaagcctcccaatttaccacttccttagctcttgataatgttacactttctgtctctgaattggctgctttaggcacctcatataagtagaatcatacaatatttgtccttttttgattggcttattttacgtagcataatatcctcaaggttcatccatgttgttgcatgtgccagaattcccttcctttttaaagctaaataatat

SEQ ID NO: 694 - DNA, 1292 bp, Homo sapiens
tgcagtggtatgatctcagctcactgcaacctcagcctcctgggttcaagtgattatcctgcctcagcctccaagtagctgggactataagcacacatcaccacacccagccaatttttttgaatttttaatagggtttcactatgttggccaggctggttgaactcctatcctcaagcgatccacccacctcggcctcccgaagtgctgggattacctgagccaccgtgcccagcccatttcacagtactttttatttaaccctatcgtgctagggcactatgcaatatacagctatttcattttccttttgtctctgtttcccaggtggtcttcgagggatagcacgaggtggtctgacaggactaacacttaccagcctctatgcactatataataactgggagcacatgaaaggctccttgctccaacagtcactctgaagattttgccaactcatgaatggaggacacttcagtagtcatctagatccttttataagacagtttggagttattctctctcttctacctacaattagtttgaaaaattggagattttgatttgctgtgatgaaaatcctggatggctgaccaagactggcacttgttccagccattagtgagttgaagccaaagccctttggtgactcactgagtaccatggttctgttctcctctggagatcttgcacgtatctgttttcctcccccatgaactagaaaaccacttactcccagaattcaggtcgtgcttgttagtactatatcaccaagtccattcatttaatgatccaaaactgtaatgttgcactgtattccaaataaagggtaaaaacagaaccaaagttataactccaacacacaaacatagtggttgtctcaatttaaaagtatctacctgggtataaagtgaaaggtacccttggcattttttgtcccagtgggcaaaacaacatcttcgtgtttgtgttaaaatgagctacttggtggccgggtgtggtggctcacgcctgtaatccctgtactttgggaggccaaggcaggtggatcacctgaggtcaggagtttgaaaatcagcctggccaatatggtgaaaccttgtctctactaaaaatacaaaaatcagctgggtgtggtgggtgtgcacctgtaaccccagctactcaggaggttgaggctggagaatcgcttgaacccaggaggcggaggttgcagtgagcccagatcatgccactgcactccagcccaggtgacagagtgagactccatttcaaaaaaagaaatgagctac

SEQ ID NO: 695 - DNA, 1161 bp, Homo sapiens
gtggggcactgtgagctgtcggggagggcattgtgaagtgtggggtggggcattgtgtgccacatgcctgggctcccacctggggccagtgggcttcagtctgtaggtgactacagaaggaggaggaactccgtctgttctctcttcaggcagttgttgtgtctctcagcgcttgttggtttcacaacctattaaataagccggctggtcttcaccctcccagacaagtcaactcaggggaggcagcagggtgcgggccttggcccgcagccctagccggggccggggccagggctggtgcccggggcctcgctgtgaggtgggcaggcgaggagcgggaagaccatctctgcaagtgcagcatagcctcggcctaggacagcgggagtgcgtggccaaagctgtgagcagaggcacaggtggtggcagacagtagaggcgccccatggggaacatactgacctgtcgtgtgcaccctagcgtcagcctcgagtttgaccagcagcaggggtcggtgtgtccctctgaatctgagacctatgaggcaggagctagggacaggatggcaggagcgcccatggctgctgctgtacagcctgctgaggtgactgttgaagttggtgaggacctccacatgcaccacgttcgtgaccgggagatgcctgaaggtgaggaggtgataggtgccatctaccctcggtttgcctctggctgctgctgtccccatggttccctttgaggcatcccacacttcgagctcctttctgcttgtagccagctttcccgggggctggccaggaacaaaagctggctctgccttgaattcccaccccttagtctttccccaccgagtccagtcagtttcttttcgcctcccctcccaatcgcccagttcttgctctctcatctcattctcccaggctggcatgggaccatttatttatggctcttgtcgaataagcagcagttgaataaataagttgataaatttttataaatgattacatcctttttcttttctccctctatacatatagctttggagtttaacctttctgccaatccagagtcaagcacaatattccagaggaactctcaaacagaaggtgagacaacagtgtctgtagctctatttattatcctgtggtactttgtttaggc

SEQ ID NO: 696 - DNA, 1176 bp, Homo sapiens
atgtagtacaaagatctaatttaaaatcacttactttctgagcctccatgtcttcatctgtaaaataggtacaatacactaacccaaaatttttgccgagataatttgataatcttataaagtcttttcaattaaaagacttcagtatacgtttcttcctttaaaaaaacttttttacttcttcttaagactctattgtagagtttatgactcctgaagttaataacttccttctaaagactttacaaactttgacctttgttattttgatttacatgtgtgaggcatttcatgaaaatgcagaaaacaagttgctgtttgccaagacattggatcagctagcatagtgtggtgctatttttaataatacgtaattcctgtggccatttgataaaactagaagctcattaaatgaagcccagagtgacagtcgtatgaaattcaatttcataagaccaggactatttcagggatggtttttgagaggagctgtaacttagatctgtcggctaaatttagtctgtcagctcgctgggtccctcctctccattgctgtttataatagaggatgaatgtttgtgtgtgtgtgttttttttttggtcagaatggagtggggaagttgtgtgtgtgtgtgtgtgtgtgtgtatgtgtgtgtttgtgtgtgtgttttcttgaagggtctccacctttgaaaagtctttatagctttttattgattataaaaatagtagctattcattataagaaatatttgcctgtgagaaaatatgcagaattgttaagtcaccaggggtaacttgtatcagttttgtatgtagacctaaattcttattttctatgaatatatatctgtgatatagatgtcacaaaatcatgatcatgcattttctatatccttgaacattttccaagaagatactttacaattgtatgggattgcttctaagggcactgatttgtttaatttcctattgtatatgggagttcttcttttcccccttagattagctgataccaactgaaactcacaggtcagctgtcaattaaatgtaatcccaattcttaatttctaaggttactaccatgtaaaacttgcctaatataaaagagatatatgtgtatatcaagatatactctaaccatctagttttatctaatagtttcaacctcaatag

SEQ ID NO: 697 - DNA, 1103 bp, Homo sapiens
tctgctgctctagaaagaagctcctcatctttgcctaatggtttatatttgagaaaggtctcagtacccagagtttaacagtccatgtcattagcctgtaactattttttttagaaagtcacctcatccatttcctttattaccatatttctcatgccggaatgtcagaagtcataaaacttgtgatatcttgcaggacacattaggaaatgtgttggaatgtgctcattggattgattcagctctgggggaacaagtcctaataaaataacagtagacctcaaaaattaggttccagtcccaactctgacatgagcaagttgtacccatggatgagtcatttaaatttgttcttggtttgcttatttgagaacaaattagctccttttccatttcatccatttcttgtgaggatcaaatgaaatcgtggctttgatatgagtgcaaaacattacacgaatgtaggagtgtgtgctctggagttagattacctgcgtccaaaccagggctcccctatttgctggctgtgtaacctggggcaagtaggataacttctcacatgttctcatgtggggaagattatgattgcgataataataataattaaatctatctcctagaactgttttggagattaattaggataatgttgtaaagtaattaatattcttctgatagagaaaatagcaaacaactattaattgttactgttagagaaacagaaattcaagtcattccatgcattttagtatacttctatgatgcttccttcagtagattttcaataaaaggctgttggataatagtaaattgaacactgtatttatctttagggtcaaataaataccaatgactatatttactgttttttttcataataagccttttgataaattatctataatttataactgtcagagaaaagttcttctttttcaaaaaatagcactatattatttaaaagaattataaatatctaaatatgtgaatcattgtcacgttttcacttgcctgatacactaagggatcacataaattataatgaattataaaatcagagaagaaattgatcaaagaatcagatttttttccaaaggactact

SEQ ID NO: 698 - DNA, 1145 bp, Homo sapiens
caaaaaataaaattggtattaaatgtaaatatcccaaatcctttctcctatttttcaacatgtttatactgtggtggaagttggcctgagacatatctcatatatcattagtctttgtaaaatacaaatttgctagaataagataattaattgaaaaaaatgacaagataacatatatgatgtaatgaaattattgatgatgtaactatagagaaaaaaagccttaaacatatcttccaaatacactgaccttctaataaccaatataacatttgtatgcataatattagtacactagactgaataagagagcttaatgcagtaaaatgaaaactgatgctctccatttttatattgttgaaatgtagtttttattatgtatgagcaaatatattttgttacttccataaagcacccagagaagctttcactacagcttcatgagatattgatgacttgcgcttaatgatgccaaatttcagtcaaccagggattatgaatatgtaaattggtgctcagaactcagttgtaaatactaagaggctactattatcaagaaatacatcaaaaagtaaattctttggactctgtagaacatgcactagctttatccagcatctatttcaagactagtcaagaagacatctcctgcatctaatgttttgctttcttaaaaagaagtttttaaaatggattatatagaatagtagctgcagacaaaacttaaatgaagctaaaagtgatgatttagagaaggttataggataatatgttgataggtcatagctaattatcggctttatccgtacatattcgtttaaagtggtcatctaactgatttgttcatatcttcttgtactttctgacagaatagaatatgacagttggaaagcgttagtagcctgaaacccgcagaaccactggaaggctgaaagtttttgattttattcagcacgctaatcatgtgataatagattggtcattcttcttgattcctccttcttaatcaggagttacggattatggacaaataacccttacctttcagtgctccagtccctcagacacctgttaccaaaaggtgttctaggtttcccttattcaaatgatagcagtggagaagtcattctcttaagggggacagc

SEQ ID NO: 699 - DNA, 1212 bp, Homo sapiens
aactaagagattataagtgagtgttgttttaagccactaggtttccatgaatttgttacaaaggaataaaaagataatataattttgaagggtgtgttttaaacagccaggaaaagaaacaaagaccaaaaggctacttaaaaagcagatggaaaaatctaacagagaattcacagtcacgagggtgtaaaaaatgcacaaaatcatagtataggacaccagtattagtgacagcaattaccattataccaagagtatggagctataaataaacatctagtatctggatcaacagcattttattcattgtttgccatggttgagtgataaagtagctaacattaaaaggtaagaatactttttcacttatatctatctaaggatcttgtgtttgtatgtatagggaagtttatttttggagatgtgggaataatatacattgaataaaacattattaaaagtaggcataaattaaaatatataagcaatttcaatttggagaagagggaatgaggtgtactaaaatttataaagaattaaataaagaggataaagacaaattggaaattgaaaaggaataagaaacatttttctgtgttgggattgtagtatgtagaaatctaatcttatagtataatatttgtaattaagatgcttagttccaatatgtttcattcagcactgggttattgtttagtacatttgtgcaataattagataaaatatattttaatgaaagtagattttgtgagttggaaaatacacttgctttagcaaagtaaactaaagttaatgtattttcaccaaatatagttttcttttaatttttttaaattttgtaaaaatgtaagacatatttagagtaactccctagttagttctttactaattgatgctttgaaaagacaatgacttttttatctgatgtatttttaataaaatagtctctcacatcacatttctaatgaatgcattaaaattctcaagtgactaaagggagtttaaattatctctgtattattatgtcagccatctagatctatgatatcaaaatatatatatttaagatgtgcacaaattaattaaaatgataagtttctaaatctctctttgtataagttccaagaattataaaaatagcactattttctgatcaaacagttaacactaaattttacaatgtttgtaaatgtggcttagaggccagtcttt

SEQ ID NO: 700 - DNA, 1137 bp, Homo sapiens
ctcagctctccagttgtaaagtgggataatagtgcccacctttatagggccaatatgggagtaaatctaattatttttgcaaaacatgtaacacaatttctggcatatagcaacttccaataaatactggctatcagtaattgaagacccaaggaaggtacagaatgtgtttctgaggcaaagggcccacatggctcccaggctttctcatctgagcaggtattaatttaggtgtgatcacaaacatttctagttatatattaaagactctaccttgccagccacatcataagtaactaatatattctgcagaatgagtggactgtggtttaattgttaaataaaaaatagatattacctttgcccatctcagatagtatcctctagtgctcaagaacattcattgtttctcagttgtctgctctgatagacccaacatatccaaattgaatatctattttcctctcagcatttctatgttttttatagacatacctttgtttgtgagatccagtcttctcaaccagctctttcttaccaattttgcctgagaaaagattactaattcttcaagattaatttcagatgccccttcctacactgtagcctttttagcctcatagcattatgtattttaaatatgtcttctcttactatccttgtacaaagtcagttattttatatatttttgtctcatcagtagttctgaaggtcaggaactctctctttcaaattatgcctctttaatatctagaaatgtattcacaggacaaatgttttgtatttatgtatctaattgaagaaatacttccagatcaaacaaaatcctgcagggacctgtaaaatatcaaaaggactatcaccttgaacaccaagaggggcctcctctgtgtagcctggatggaaaatgcctaaacatccttggtagtcaatggaagaaaactccctacttaaaggaataaaaggctgggacaataaaagtactgacctcttagggatctaaggaaaagattctggaccagaatgggcctaggcttgaagtggatctcttccaaaagaatagtgaatagtttttatcttttctaaaagatggattgaatggaattcttccatttgtagtagttcttgtaagtttaa

SEQ ID NO: 701 - DNA, 1224 bp, Homo sapiens
gtgagataagggtctaatttcattcttctacatgtggatattcagtttcccctgcaccatttattgaagagaacgcccctttgcccttatatactcttggtgcctttgtcataaatcagttggctgtaaatgtggagatttatttctgccctgtctcttctgttccattggtctatgtgtctgttttgtcatacaaaagacataagtaatttacaaataccattacagtattagagtattgtgaatttaactgtgtacttatttttaccagcgggttttatactttcagagtttttgtgatactcactagcttttgtgctttcagcttaaagaattctgtctagcactttttgtaatgaagtaggtggtaatgaaccccctcaacttttgtttttctgaaaatgtctttaattctccttcatttctgaaggacagctttgctggctacagtattcttagctgggttccttgttttttgtttttttgtttgtttgtttgttagttttaacaatttaagtatgccatcccactctctcctggcctgtaagatttttgctgcgaagtcttctgctagctgtattataattttttataagttatttgcttcatttctcttgctgctttcaggctcttctctttggctttgatttttgagtttgattgtactatgtcttagggaaatctttttttttttttttggattagatatgattggagacttttggccttgtacttagatacttacatcattctccagattgagaaagttttctgcaactgtttttttaaaataaatgttctaacccctttatctttctcttttccttatttaactcccatgacttgtacatttgctcttttatttatttatttatttatttatttatttatttatttattttttatttattttttttttttgagatggagtctcactctgttgctcaggctggagtgcagtgttgcaatctcagctcactgcaacctccacctcctgagttcaagtgattctcctgcctcagcctcccgagtagctgggattgcaggcatgcgcaaccatgcctggctaatttttgtatttttagtagagatggggtttcaccatgttggccaggctggtcttgatctcctgacctcaggtgattcacctgccttgacctcccaaagtgctgggattacaggcgtgagccaccacacccggccacgttctctcttttgatgctg

SEQ ID NO: 702 - DNA, 1198 bp, Homo sapiens
catctatgtccctgcaaaggacatgaactcatccttttttatggctgcagagttaacgcaggtgtttctaatgtgatagattaagaggtaaggactttaagaggtgtttaggtcttgaggactcctcccacataaatgggattaggtgcccttctaaaggggcttgaaagagggagttgggtctcttttttgccccttcaccttgtatcttgtgaggacccagcattcctcccctccagaggatacagtgttcaaggtgccatcttggaagcagagagcagccctcaccagacaattgaacccaatgctgctttgatgttggaattcccaccctccagaacggtaagaaataaatttctattctttataaattacccagtctcaggtattttgttgtagaagcatgagacagactaaggagaaatctgcttctaagctcacgtgagtgttggcaggattcagtcctttgctggttgtcagactgaggacctcagctctttcatggctgtaggctagagtctaccctcagcttcttgccatgtgggcctctccatatggcagtttacttcatcaaagtcagaaggagagagagagagagagagtcagtagagtctgccagcaagacagcagttacaatattaggtaacgtaatcattgatgtaacattccattaccttttgccatactctattggttagaatcaatgtacctattctacttacattggaagagagggaattaaataaggcatgcatatcaggatgtagagataatcaggggtcatcttagagtctatctgctactgtaagttagaaagattatttaacttgtatatgcattggagtcttcttctgtgagtgaaaataataatagtacctatttatagggtcattaggaatattacataatttacataaataaaacagctagaatagtggctggcatagaggaggtactgcattactgttagatgctatgacagaatgagcatccttatctgaaatgcttgggaccagagtgttttggatttggggtttttttttttggattttggaatattcatagaagacatactggctgagcatctcatatgtgaaaatctgaaatccaaaatgttccagtgagcatttccttttagtgtcatgtcagcactcaaaaagtttcagaacttggagattttcaggtttgggattttcaa

SEQ ID NO: 703 - DNA, 1180 bp, Homo sapiens
tggttccatgtctttgctgttgtgaatagtggagagtagctgcttttaatatatgtgaaccattagacagagaaaccgtcatgggtaatttattgggaattccatgggatttttaccatattgagttcataaaaaaagaaatatgaatactttcccatttagctgtgagattatttgcataatattgtcagccaccaaattaaaagataaattggaatcacaactattattttactactttactgttttgaacttaattcaacctgtagtgatgtagctggcaagacttatgtttgttggaagatacagttgattttgactttacatagtagtgtatctaattgtcatatgtaaaatactttatagataaaattatgtttctatataggagagtacacagaaagaatatagcacagtagtaagctattttgtaatctgaacatttttaagttcaagtttgcttttctcaaaactgagtgcaaagagagccaggataaagttaaaaagacatgggctttaaagtcagatgatgtttattaaaattctatctccattatatgaatttaggcaatttcttgacttctctgagtcttttctgagtcaaattctctgtcgatgaaatattaatagttaaaagttgtttactatttcagactcgaattctgctatctcatcattgtttagtcttctctattcattaaatgaaagcaccatctgctctattgctcagacctagaccaaagatgtttccttcattcctgtttttactctaaacacatgaaacccattagtaggtcctatctgcttttctaccaaaacatcttcacaatgcattcccttttctctatctacacttcagcattctatctagaccatcatcttctctatctagaatatagtgcagagagtatgccatttaccttagtcttcagtgacttaaaatttcataagcaaatgtcaggataattttgaaataattactggaaaagtgctaactgaggcagaaaatccttttaatgtgagtaggatgaattatacctcagatgcccttaaggtttgcatatatactataatggagcagagacaaagttttgtattgaatgcttcatttttcttaggattaattcacaatatttaatggtatggcatatagtataacacgggaactttttctcactct

SEQ ID NO: 704 - DNA, 1099 bp, Homo sapiens
acttattctttaaagtatagggaaattgattggcttgtaattggaaattcaaaggtagggttaacatcctcaaactgctggctaaacaagtttagcatctcttaaatatagattttagaaaaagagggaaagagtcattaccagatactttggagggaacatcaagaaagaacttttccagagctcctagcaaagcacttctcatgtcatcgatcccatttctttataaaattttttgtcatttggcctttttaatttttaaattattttatttttaattgacaaataattgtatatatttataggatacaaagtaatgttttgatatatgaatacattgtggagtgattaaatcaaggtaattaacatatctatcatatctttttgtggtaagaatatttaaaatctattactttagcaattttgaaatatgcattactattaactacagtcaccatgccgtgcaacagatcactacaacctattcctcctgtctaattgaaactttgagccctttgatcaacatctcctcttctcctactactcctctccagcctctattctactctctgtttctacgaattcaacatttttagcttccatatataagtgaaatcatgtggtatttgtcttctgtgcctagcttatttcacttagtataatgttctccaggtgcattcatgttgtcacaaatgacaagatttcccctttattaaaaccaaatagtatttcatagtgtgtatatatacatttctttattcattcatccctttgcagacacttaggttgattccatatcttagcttttgtgaatagtgctgtaataacacagagtgtagatatgttttctacatactgatttcatttcctttggatatatgcccagaagtgggattgctggatcatatggtagttctatttttaattttttttagcaatctccacagtgtttttgattatggctgtgccaatctacattcccacaaacagtgtacaaggattcccttttctccacatcctcaacaacactgatcttttgtcttttttgatagtagacattttaaaaggtgggaggtaatatcacattgaggttttgatt

SEQ ID NO: 705 - DNA, 1218 bp, Homo sapiens
atataaatgtactgccaaaagcaatatctcaatattatttacaatatacctattgatactttttatttttcaagaatgaaagaaagccaattgttttgaaataaagcatgtttttcttgtgaatatctatgaaagaatgtcttctacatgtcaaatatattgtctagtatatagttccttttaaaaaatgataccaaagtagaataacataaaaacactatttttagatacgtacagccttccttctgttatttagaattgagaatgctttattcaagctaactgggtttttaacttgctgttgtcaattgtaatagtgttaaataatgatgacttaggattatatggctgaattagatatagggaacactcttactgaggaaaaaataagaggtgacatttcaacattatacaaaccatatttttaaagctcacattttttttaaagggttccggggactataaacactcctactgagtgagcatcgtagaagtccttctgggtattaatcttattcatctagtcttgtccatgtgttatttatatttctatactgctcaaatttattaagatttatttgtctcttctgtatgtcttcaaagtattgttttctgtctactaaatctttcaaagattccaggctcaggcatcatttgtcttttcctaagctctgactattttgagctctatattgtgttcacagtgcaaaggtcctgttgatttccccaagatgaaaacattactgagttatgtgcagagacctgaagacaaaatctggccctgaagttggttgagattattcatggggagaattttccagctcttttttttttcctgcctaaagccattgaatgcctcttaaatcactgacataaaatttaggtcaacacattgcctggggtcatttaaatttcaaatctgctgccattttcttgcttgtaactattgggagagaagaacattgtgcctacagttagtgagctggagctgagaatctggcacaagaaatttcaactcagagtcaaatttatttatgctcagctgcaggaagtatgtcaggaaggttaatgagtctaaattggcattctgtcttctgactcagagctgaattgaaaaccacgtatagtgataagggttagcctctgccagattttgtaccacttgttggagtttaggacttggtaaattttttgtgagtgtggaagaattttgactcc

SEQ ID NO: 706 - DNA, 1220 bp, Homo sapiens
tttttcttttggcttcagaagaataatgcatataactcatgtttacaaaattgcttatagtagttttactttggtaattatcacaatatagaagtaaacataatgctaaagttacaaaggctaggcctagcgtggtggctcacgcctgtaattccaacactttgggaggctgaggcaggcagatcatttgaggtcaggagttcaagaccaggctggcctacatggcgaaaatcccatctctactaaaaatacaaaaattagccaggcatggtggcaggcacctgtagtcccagctactagggaggctgaggcaggagaattgcttgaacccgggagacggaggttgcagtgagctgagatcatgccccttctactccagcctggatgactgagccagactttgtcacaacaacaacaacaacaacaatgtaacaaaggctaatcaccaattaaaataacattgtgataaaagactctttaagattatttttgacttgaaccatattgaaaatgatgttgactctgtctgaagacttttgaggacaaagctcattttataacacatattttaattgcattgcctggcatgatgctgtgtgtctgctcagtcctgttctcagccccccttctgaaaaaaaaaattctttttggactacatagaactggctatgattgtaaaccgtatcactcaatctgaatttctagcttctctttcttttaatatctgctgtataaaatggtgacaaaatatttcgtagtcatttattatgtgttgaatggcattccttccgaaaaaaagatatgcctaactcctaacacctggtacctgtgaatgtaatcttatttgaaaataggatctttgcagatactcttcttcagataagatcatcttggattgatggcctctaaattcaaaatgagatccttatatgagaacacagtgggatgtttgagacatatacatacagaagagtgagacagagtggaagatcatgtgaggacagtggcagagattagttactcagctacaagccaaggaacaccaaggaatgccagcagcaaccagaagctaggaaagagtcgaggaaccttgccttttagagcctgcagaggaaccaacctgccaatgccttgatgttagacttccagcttccagaagtgtgagagaataaatttttgttgttagaagctaccatgttttggcaatttgttacaacagt

SEQ ID NO: 707 - DNA, 1219 bp, Homo sapiens
agctcttttacaaatgtctcccaaagcaccaagaaggaacaaagaatgtgacccaggaagctcacaccatgagtctacattgcagaaacctttgttcaacaaaactgcagatgctctattgaatccactggggattgtcctaatgctagggacacgtatataagttaatgattttattaattttaacattgttaaatgttttcctttggggaattctaatttatatatcaatattcaggtaatatttgctgaaaacacaaactctaagagtcaaaatgatctgcattcacattctcatcttctaatataacatagagacaatgactttattatctttttagaaactttcactactttagtttcttcataattttataaattaatgtatctcaaaaaactttgccctaaatagttagtaatagctatcaacttcagaaaaactaaaactttaaaaataacttttagaaggaaaatgaaatacagaaataatacatctcatttacaattaattaaaaataatatgaattatcactatttcctatgaaaacatctcatgccaacttctttcattaagtttggatttaaaatgttataattcagttgaaactggtagaatcttagtaaaattataacaataagaaattgtttaaattatatatataatatagaataattacatttagttccacttgttagtttattctgattatttagccggttgattcataatttaccaacttgggtcagaaatatttcctattcttagcttttgctgtcagcagagataataataataaagagcctgaacaacaaaggattgtgtattgtttcaatttcattaaagttgaatccctgctttaagagagactcacattttatattttattgttttattaaaaagacaatctagatatttgcttttccaaatttcccataagataagaaagacatattttttcttaattacacccttgctaagtcacgctagcttcctgaccttggacaaaattcttaacctctttgtgtctcattttcaataactgtgaattaaagataataattatatatttctcaagggattattgtgtgaattaaataaaataatcctctaaaatacttagtacagattctggaacataataagtagaaaaaattaataactattattatttttatttactatattatatgacatactttttctttatgatcttcagga

SEQ ID NO: 708 - DNA, 1293 bp, Homo sapiens
cctccagcttctgtataccctgcagggtaagctgttgttccctgaggctgaggctgaggcagagaatcttccagatgataaaccccagcagccgactcgaccccaggagcagagtacaggagacaccatggggagagaccctggtgtgtccttcaaggtaaatgagagatggaacaggtgggcatgggctggcaggtggagacagaagctgggagattggccttacccactgtctatactgtatttctccaaggctgttggtctacaacctgctggagatgtaaatttgccatgacttcctggaggacagcagcatggagaaagatcctagaaaaggtcagacccaactcaggccttggtgtccctggactgcaagtgtggaaggagggaaagcctggtttacctctctctgcatctgagctctgctacccatggagcagatggatggtgggaacaggaaagagcttatgttacacctcattcccatgcttagcccacccagagctaacccctgtcttcttccccaggcctctgacttccctcacctcccaaccatcattacaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttgtgccttatctaaaacatttctcgatcactggtttcagatgttcatttattatattcttttcaaagattcagagattggcttttgtcatccactattgtatgttttgtttcattgacctctagtgataccttgatctttcccactttctgttttcggattggagaagatgtaccttttttgtcaactcttacttttatcagatgatcaactcacgtatttggatctttatttgttttctcaaataaatatttaaggttatacatttcttctgacttcctttatt

SEQ ID NO: 709 - DNA, 1175 bp, Homo sapiens
gtacagtatagaaacctccatttttgccttcgaatgcatatttaagagttaacagaatgaaaaaaaaaagtcttgttggataatagtgtttgactagcgttttaagaacttgagagtaaaagcaacaataagattttttcacctcttcctgcttccacccccaaactgagaacatcactcaattgtttggaagaaactgtaggtctatataaattttatttataatgtatgtgtaatatacataatcataatacagttctcagatgcagggaagaagtttggcatttaatcattgaggctttaggtttttgatgtgatcagactgggccatgtcaaacccggaattttcaccaacagttcactcaccctcctggtacattgccattccaaggaattctgagagtaggcaaacaaattttgccttcatggtacagttctcagtttttcttataggagaaatatggtatatgtttataagaatcttttatgagattatagatttcaatgctgtggatagtgtcttgcacccaaacaagaaagtccataatggaatgatcttccctcagcttcctatcgatttagttacctcttgaaagcacaaaaattaaaacattgccatatgttgaatttttaaaaagcacttggagtgagcgaacatttcctgataaatgccttttagagataggttcttgatattcagacatctgcagaaatgttctggttcccaaagtcatttcacttcgaaataaaacacagctccttcaaacagcactttttccacataaatctagttgcctctccctgtggacattcagaactgatagaacaaacactactcttttgaatttgatggttcgtgtcctttaaagtgtttgaggacctatgcagagcctgtaacacttgggtagtacctgctaggacaatttcttggcaattgtcttactactagggatcagtaagatttagattctgagcccataatggcaacagccccctcacctatgggaagctgacttccctcagtcgggcacttctcatgggggctgaacatggttcctgccattctgttacccactctcccaggtgagccctggattggctcccagaaggcctttgtaaaatcagtagccgtcctgcaggcaggtgggagcaacaggggcttcagtagcttcatt

SEQ ID NO: 710 - DNA, 1178 bp, Homo sapiens
ctctgaaatctgcagcttgagcagcatctatggagtggtttcagctaaattatttcatttgagtctcacggcaagtctgtgggagtaggtagtgtgtacctccttagaaaataaaggatctggggctcaggtgaaatgctgttaaattattggccagggaacagtgctggtaaatgggacagttggcatttccagggaggtggcctcacatccaggctagggttctttctcctctgttagctccttggcagaggaggaggttaaaaaaagggtctgatagttcagcacttacaagcaaagggcattcaattccaaaatttctaggaaattccaatgtcgcatttgacccagcaacaaaaattgggaaccactagtctatacatttgtgagtacatatgatatttcttctgagatttgaaataatgccccatttaaaaaatatttttaattgaatttttttgactaggaaggacatcacttggtatttggtccccttccctttaacacaaaaggtggcgtatatgatattatattctgttctgcccctccccctgccatttaattatattttggatacttctctttttttttttttttttaacagttgcatggtaagccattgtgtgggtatctcttaccattgtgcatttaatttgttttcagtcttttgtctcaaaatgtcaccgtcaccttgaacgtaggtcattttgtatgtgggtgagtgtatcagaggggataattcctagccactctcttcaaccatttccttatgttgactcaatcattacatcagtcttgtgaagtagccagtagcatattatccttgtttacagacaggaaactgaggctcagagagggttgggtgacttgcttaaagtcataccgcagagagtaggagagccagaattgacacctagctaagcaagctgattctagggaattccctcactttttgatgctgcctttcttggtaaattcacagaagtgacattgttgtgtcgattgccctatatatgtgtaattcgaatagatgttgcttctacaatttacacttccattagtaggatatgagagatatgtggccccatactacactgtcagagggttttctcaaactggattttggtagtctggtaaatggacagtgacatattagtacagtctttgcatttctctca

SEQ ID NO: 711 - DNA, 1208 bp, Homo sapiens
agtttgttatcttgaattcgtctatttatgcaattctaagtgaaaaatgaaacgaaagtagaaaagaggtcagtcatctgtagtatgcccctaaagtttagcagcttgttcaatcatattctcaggctcctagtggaaaagaaccaaaagggttacctacaccagctgagccattttctacaatgacatattcctaatacctgtgaataaatgacaccaaaaaatatgacagtgctatgcttccagggtcctttagactgtgttgatttaaaaacagcttgctcactaaatataaagaaagttttaaaattttaaataatcatcctataaagaagttgtcagactcacttgctgcaccactcaaaggagagagaacgttgggtagattcatatgaatgtgaaaataacttcagctaaagcaaacaatgtgtcagattgaaagaacagtgacttgacaagcctaattttactttccaggtagtgtttaccttccgtaagtgaacttagggaatgagtccaagaatactgcctggaattccaggagactgaatgtatgtgctccggaaaaatcaatttgcaaatatattgagagtttttatagtcatgctggctgcctctttaaaaaaaaaaaaagaaaactaagcaagtagaatgctgccaaatatgactgagtcttagatggtaacatcaaaatttgtatttcccattttagaagcagttgaattttgagctatctgaactctgcccctgcttttctttaatattgagtcatagccatcctatttttaaagagaaaagccaatgactttcaagatttgtacatagtatatagtgatttatagtttacaaagtacttttacatttttgtcttatttaatccttccaacaagccttaaggcaagtcaggcaattttgcttgtgaccttttacagatgaggatattaaggctcggacagctcaaatgatgtttctgccttcacacagtttatgactggtatagctaagacttgaagtcaagattattgattctcagcctaatgttctgttacactaagctatctctctaaaattatttacaaagaataataacaatcatcttctgtgaaatgattgctatgtggcaggcactaggtaaataattatatatataaccttaggaaatccccaaaacaatgctataaggtaaatacaactatcccccaacccct

SEQ ID NO: 712 - DNA, 1177 bp, Homo sapiens
ccatatgaacttgagaagaatgtgtattctgctgttgttagatgaagtactccatgaatatcaactaggtgcagttgcttaatggtgctttttacttcaactatgtccttactgattttctgcctgctggatctgtcaattactgataaaaaggtgtcgaagtctccaccgtacttgtggatttatttgtttctccttgttgttcttttagtttttgccttacatatcttgatgttgtgtttttagacctatacatattaatagttatgtcttcttagaatattgatctttttatcattatataatgctcctttttatccctgatatttttccttgctctgaagtcagcgttttaagaaattaatatagctacatcagctgtcatttgattcatgttagcatggtgtatcttttccattcttttacttttaatttatgtgtttctttatatttaaagtgggtttcttatagacaacatatagttgggtgttcttttttaaattcattctaacagtctctgtcttttaatttgtgcatttaaaccctttgtgtttaaagtatttagttgtgttaatatctaccatatttttcactgttttgtatttgctgcccttattctctgtttcttctctggtattgagcactttatatgattccattttctctctaagcatataaattgtattctttaaaaaaatattttggtggtttccctagggcttgcattaacaaccaatccaagtttactttcaaataataataataccacaccagtacatgaataatacaagtgccttataacagaggctatccaattcctccctttcatcccttataatattgctgtcattcatttgatttatcctgcaggatctctaaattactggtaaattaacagatccagcaggataagctataatcactgaattacaagctataatcaccaaataaactataatcactgaataccttgttactcttgttattattttagagactgggggggtctcactatgttgcctaggctggccttgaattcctaggcttaggcaatcctcccacctcagcctcctgaatagctggaactacaggcatatgccactgtgcttactgttattgcatggcaggtcttctggtgacatattccctcaatttttgtccagaaaagtctttattt

SEQ ID NO: 713 - DNA, 1284 bp, Homo sapiens
catttttagctatttttataacacattgtgctatggggggttttggaacttgctggaagctacatcagaaactgccatagttaattgccatttcaagaatgttgtaaataactcaggtggccgtttaattctcaatgtaaatataattaactagacgtctttcctatatttgtgtctcagttttaaagctatttctggatgcttgagtcttaccgtaattgataacaaaaagaggttattgagaatatctatgatttacagagtaagttattctagacctcaagagtgaaatgtaggggaggagacatttgtgtgttaaactaatggaaatgctcatttaatagatattcactgaaagtattagttttggtttattgctagaaaagttgaggttttatggagatttttgtaaaaaatggtttatttcctaaataaatatctctttttcttttttctcccagaaaatgttaatctatgatccagccaaacgaatttctggcaaaatggcactgaatcatccatattttaatgatttggacaatcagattaagaagatgtagctttctgacaaaaagtttccatatgttatatcaacagatagttgtgtttttattgttaactcttgtctatttttgtcttatatatatttctttgttatcaaacttcagctgtacttcgtcttctaatttcaaaaatataacttaaaaatgtaaatattctatatgaatttaaatataattctgtaaatgtgtgtaggtctcactgtaacaactatttgttactataataaaactataatattgatgtcaggaatcaggaaaaaatttgagttggcttaaatcatctcagtccttatggcagttttattttcctgtagttggaactactaaaatttaggaaaatgctaagttcaagtttcgtaatgctttgaagtatttttatgctctgaatgtttaaatgttctcatcagtttcttgccatgttgttaactatacaacctggctaaagatgaatatttttctactggtattttaatttttgacctaaatgtttaagcattcggaatgagaaaactatacagatttgagaaatgatgctaaatttataggagttttcagtaacttaaaaagctaacatgagagcatgccaaaatttgctaagtcttacaaagatcaagggctgtccgcaacagggaagaacagttttgaaaatttatgaactatcttatttttaggtaggttttgaaagctttttgtctaagtgaattcttatgccttggtcaga

SEQ ID NO: 714 - DNA, 1178 bp, Homo sapiens
cttgtgatgaagtagatgctagcattgccaaggctacctattgcccaatgttgaagttcagccctacaggtgaccggacttgctagcaggccaacgtgagtatccagtaggctataaatgtgtgccagctgtcccgacagtggctgaatggagctccagtaggcaggttgtgtttagagaaaaccaaggagaaaataacagttaacgggaataaactgtttggggtcaaaataacagtcccatgtttttgtacttgtgtgagatataaaaagaaaacttgagtgtcaattaggcttagtacgaacttccaaacattctttcctgtgcttgtgcacctccaaggaagtggctggacgaaggcaaaactccctgaacctcttacgtctttgattgctctggaaagccttggtgtccttactgtggtgttcactctcttcttacagagtttcataaatggacgctgacatggactacgaaagacccaacgttgaaactatcaaatgtgtggtcgtgggtgacaatgccgtggggaagacgcgcttgatctgtgccagggcgtgcaacaccacactcacgcagtatcagctgctggccacccacgtgccaacagtgtgggcgattgaccagtaccgcgtgtgccaggaggtaagatgcacagagtgtcttcagcatccctagggcacatcattgctggttgccagtctgattttttctaaaggaggagcgtggataaattacacattcaaaacaaaactaacctttttagtgccacgagagaaaacaaaagcaaaatgcaaaccggagactgtggctctggtatcctgaatgagggttgagacagatgattccaggaagggaattaagacttagcttaaatcccgtcagatagaataaggaaacttaatgcaagtgaattgatggcactgagggtgctgacttgaacacgcttctcctggggaacttctgactgacaccgagcacagatgctctctctctctcctgcaggtcttggagcgttctcgggatgttgttgatgaagtgagtgtttctctcaggctttgggatacttttggtgatcatcacaaagacagacgctttgcatatggcaggtaaaccaagactagtacagcgtggttgagcttgaatgcaatttccttttcaaaaccagcagcgggttt

SEQ ID NO: 715 - DNA, 1211 bp, Homo sapiens
gatctctgcagcaaaccaccatggcacccgtttaaacctacccatcctgcacatgtacccttaaagttaaaagttgaaggaaaaaaaacagtttaatgacaatgaaatcacataatatttttcattttgatgactacaaagcagttttataaatatgaaggtaacccagttatcaaaagtataagtgtttgaatttaacccgatattaagtttacccaaccactaaaagccctagtcaattttgggagagcagtttttagaacatgacccataccacatgaaacttaactgacaataaaatggaaatttcatttgatgcccttaacacactctgtcatgtgtctgtgatttgaaaaaaactaataccaaatttcctcccccacatgactgtaagtactggcaaatctagttgtacatttttacagtgtattgtatcatgtatacaaatataaatacttctgcagctttttagtataaaacatcatttacatatatacggcccaaatacacgtctgccgttgtggattctacctatttttgggaattaggcgatagtaatctcaggtgtacactcaatataagaggcatatacccaaaataagaaaatcaaccctgccgctctgtaaaccacagggtattgcacttccaggcatcaagccagacatcttgaattattttcacttcatctctcttcaatttaggactaagactaaatgtttgacaaaataatctaggaagttgagtcagtcagaagcagaagaaaatgcattatcgcagctgaagtgtcactttgttcccatgtagcaccacctaatcgctcctggtaaagctggacaaggccctagtcctggccttgcccccaagcctgcagctttgaccaccgcatacaaatcatgcatttcgttttcagtgttaagaagtgaatttccctcttggcatgggacaacctaattcctatatgcaattaaaagaataaggctgaaagattatgaaatttcaggaaagaagatttatgaactaagttctttgtgtgatgcaagatggagaaagggaaattttatgccggttcactgagaggaagccaagctgtttccaaaatactctatagtctttaatttttctacttaaaatcagttattgccagtctaatattttttatcttaaggctttctctaggtaaccagcgtaagttagggagagtttgaatttat

SEQ ID NO: 716 - DNA, 1212 bp, Homo sapiens
cagacagcgtttggcacggtttaggactctgagcttccaaagctgcctgcctctgtgccacctactgctgatttatttataaccatagttatttatattcagtaaataattaattgtgaacttcaatgaatcaatagctttttctaaaagattccattaggaggaaagaaaatttgcattcttaaagggtagttgacattttccgatgctctgagaacagtaagggaaaataatattttgaacatacagaattgtttttataattttcctgagtcatttgatgaattgctatagaattctaagcactaatttttaatcgactagcttttctaaaacaccattgatctatggttttatgtgtgtaaaagttaggtggtaatcgttgcctccatttcacttaatgcctttaagaattccaaacttttcttctctgatattaacatactcttggatttggggcaattaaccttttgtatatcaaattaatggataattccatcacattttaaaaattctaaataactaatttaaccttgataagtattttgatgtatttaaagtgataataacttaaaattgatagtctcttgattttttttttttttttttcagcaaatggtagaaggtctgattagttggagaaggttgtattgtgttttgcgaggaggtaaactctattgtttttacagtccagaggaaattgaagctaaagtggaaccagctttggtagtacccattaacaaggtaaaggaaatgctattttgagaaaaaaatatacatcttaggaagtttgtttttgtctgtgcagtttacattgttgttgtcttataaataaaagagaagtactggtaaaaacaggttacttcataaatatgatttaatctgtttctgtttttctattagagcttatctgttataagaaaatgtatatttcctaagaaaacatagtaatggacatctataccagtaaataggttttaaggcagagaatgtaactccacattagcagtatatttaaattttttatgaatttacttaagagattaaacataaattgttagctcatgttattatagtgatgctgtttctagttagcattcaaatgaagccataaaaagacattcttgactatactttctgatttcttatgggattgataggcaattgtccagtcttctgacagaacagaaaagcctgacagtccatttagaa

SEQ ID NO: 717 - DNA, 1202 bp, Homo sapiens
gcgtcctgagtggctgggatacaggcgcccgccaccacacccagctaatttctgtatttttagtagagacagggtttcaccatgttggccaggctggtctcagactcctgaccttaagtgatccactacctcggcttcccacagtgctaggattacagtcatgagccactgtaccaggcctatagtttcctttttttgttgtgtctgggtaatactggcctcaaggaatgagtttggaagtattccctcctcttctttgtttgttttgttttgttttgttttgttttatgcatttgagtatgattcatatagaattcagtagtaaagtcattagatcctggacttttctttggaaaagaaatgggaaaagatgcaaggtttttgtttctttttttttttttttttttggctctgtcacccaggctggtgtgcggtggctcagtcttggctcactgcagtcttcgcctctctggcccaagcaattctcctgcctcaacctccaagtagctgggactacaggcatgcacaaccatacattttgtatgttttgtagaggcagggtttcaccatgttggccaggctggtcttgaactcctgggctcaagtgatccaccttctttgtcctttcaaagtgttgggattacaggtttgagccaccatgcctggctgggagatttttaattaaggctttgattccattatttgttactggtttgttgaggttttcttttctttcctggttcaattttggtaggttgtgtgtccatgaatttatccatttttctgggtttttcaatttgttagcttgtatagttgttgatagtagtctctaatgagtctttgtatttctgaggtctcagctatatcttttttttccatttctaatttatttgggtcttctcctttttttcctcagtctagctaaatatttattgattttatctatcttttcaaaatccagcttttcatttttttaaaattttcttctgttttttgtttttttgtttttgtttttgttttttttgtctcagtttatttccgttctcacttttattatgtccctcttactactaattttggatttagtttgttcttttgtagttccttggagtgcattgttgcgttgtatatttgaagtctactttttaaatatagatgtttattgctgtaaactttcctcttagtatcgcttttgccaaatc

SEQ ID NO: 718 - DNA, 1116 bp, Homo sapiens
taaaaccattcattcatagacttttaaaataatagctttattgaggcataattcacataccatgtaattcacccaattaaagtacacagttgtatggtttttagcatgttcacagagctgtgcaaccattaccacaatttgaaattcttcatcagccctgaaagaaactgtcttttagcagtcacttcccatttccttcaacccatctggctgaggcaaacgctaatatccttctgtctctatagatttgcctgttctggacatttcatataaatggaatcatataatatgtggtcttttgtgactggcttctttcacattgcaaaaagttgtagcatttattggtacttcattttattactgaataatagtccattgtatacataaacattttatatcatcagttgatggatatttgggttgtttccactttttggctgttacgaataatgctgctgtgaacatatatgtacaaatatttgtagccatatgttttcatttcttttgggtgttttttttttaagtaaactaagattaatcaagttctaaaggaaaagaagttgggtgctacttttggaaaaaatcttctgtgaataatataacatttctctcattctctttttatcctcatgtatttttgccaggttatgctgcactaacatgttcggataacatgtacaataacaaaggtttgtttctttcatatgttacatgttataattggctggggctctgtcttacctctcttttcatccagtattcagactaaggaaacacccttctttgggacatcttgttcttattataaccaaaggaaaaagcaacagaactagtggaaacatgcatttaaagcctttgctcagaactgacatatgtcacgtttctggtcacatttcactggtctaggcaagtgatatgaccaaacctaagaattgagcagggaaatataaactgactataggtaggcactgaaaatcacatggcattaggtggggtcatatatagtcttcatttgtagaaggagacacaaatgatttgggacagaaactgaggctatcacagctcagaagaagtaatgaaacttgtggaggaaagctgaagaagactcaagtggca

SEQ ID NO: 719 - DNA, 1216 bp, Homo sapiens
tataaggcagcaacagctttgctttggaagattctctgcccttctgtgaaatgattggcaatggagacctggaagacaaggagactccttaggaggctccctaactggagagaggggattaaagcctctctccagttaaagtacttgagctacagaatgtaaggtttgaggctaacgacagggagcaataatgtgaggaagaaaatgtcatgaaaagaaatgtatttctcaagtgtcaggaactgttattttgtgagccgtgaacacattagcacattagaaagcacacttgtagagaatataaacatcattctatttttcctctttactcagtttctctctctaaacatgaaagagcaatcacaggatctacacaaacttggaaacctttttcacaccaggaggtagaatttacttgattctttctaacccactgagacaaccacctcctcctgagcaagatcagacccttctctcaacatgaacctctggtagcatgggcagggaacctccataaccaaagcaccctgtatgtagaagcactttgtcccaagatcctgcactttaacaccagagaaattagccctggacaccactcttttttttttcttttttgagacagagtctctctctgtcgcccacgctggagtgcggtggtgtgatctcaactcactgcaacctccacctcccaattcaagcaattctcatgtctcatgactcaacctcccaagtagctgggactataggtgcacgccaccacacccggctaatttttttgtatttttagtagagacagggtttcaccatattggccaggctggccttgaactcctagcctcaagtgatccgcccaccttcctcgctaagtgctagaattacagccatgagccaccgcacctggccctggataccactgtttacagctgcgtggtcttgggcagcatgctaaacccttctgagcttcagtcttcttgcctttaagtcattataataaataccacatgaaaccgttgtaaagaaaattagccgggcgtgatggcgcacacctgtagtcctggctactagggaagctgaggcactagaatcacttgaaccctggaggcaaaggttgcagtgagctgagatcgtgccactgcactccagcctgggcaacagagcaagactctgtctcaaaaaaaaaaaaaagactgttgtaaagattaaattagtttaacta

SEQ ID NO: 720 - DNA, 1180 bp, Homo sapiens
aactattatagggagaatgttctagtttggggcttattaacactatttttaagtaaaactaacatctgtggctttttcccccaggagattgatgattatattgtacaagcaaaggaacgaggctatgaaaccatggtaaactttggacggcaaggtttaaaccttgcagctactgctgctgttactgcagcagtaaaggtaattgttcatttacctttttaatccaatgtcatattaagtcaacaaataaaggtggcttcttatttcaaaccattataaaattgtggcattttgctatatttatttttctaatactggaaaacaagtaaataattttaaagatattttaattttgtgttttccatacttgatattttgaatctcttaattcatcacaaaatgaggtcgttaataaataatacatacctgaaaatgtcatttagtcataattttcccacttaatcaccttaaagtagtttgagtaaatcacctgatgtaaagatgaccattgtttatttctctgtctttggtgttctttctctctctttttttctgtctctttgtcaatggcaatatcttggtaggatttctggcttacttctgcacctctacttcaatcaatttgaggtaaccgattattcaaaataaggcatgaaaaagtctgttcttaaaacttggtacttagccagttactaatgtcatttgttgtgtttgcaagccaagttatcaaatgaatgtgttctgtaaaaatttgcattatggttttggatttctttgcatgttgtaatttgtgtgatttattttaaatactttagcataattgattttggtgtgtttggtatggaaagaaaatagccttctgtgttccttagttgcttcatgtataaaatgggggtaatatacctgtgagaatatttaaaagcacagtgcttgcttgcatatagtaggagcccaataaacataaatatcatgtgtctatctccattcaaaattcaagtgaaaatttaagttttttgctattaaattaaattgagattgaatagtattctgctttcaagttagtctgttttagttatcttgaactaaaacaactctatggaaataaatattccagttgagtggtgattttatataactaatagtgaagggatatgaaatgagggcactttcacttttcaga

SEQ ID NO: 721 - DNA, 1336 bp, Homo sapiens
catattactttttaactttaaatctcaaagagattttgagttattgaattcttaaggctttcttagcttgaactgataactatgcattatgaaccctaagtcaatatatttttggtggttttagtgatcagtaatcaaatttgtacttattatgcttgttcaggtaatttacttgactgttctatttgtttgtccaaaagataaaatgatgagagagattcgagaggtctttgatctgtctcccttttaagaaatgaagccagctggtaatgtatattcaggacttcctcagagtattggccaagaacataatgtttacacaggagtaccttggtataatgcatacattgtctcatgatactagtcataaaatattttatggattatttcacattcttcatatataacaagtaaaattaattcagttttcttctcccaacgtttaattctgaataactctatctactttaccctaatttttagcctcttaatttctggaaggactctaatttctattccaaatttctatgaattctaattgtaaattatcggaacagagttttatttatatgacctggtactagacttcttaatataactgttacactgtccttgtctttcctactcaaagacagtatcatctgaagttgcctaataaggtcatgtgagtcaagaactttatctgtgggagctgatttgcaccattttaccttttttttttttttttttttgagacggagtcttgctctgtcaccaggctggagtgcagtggcgcgatctcggctcactacaacctctgcctcccgggttcgagcgattctcctgcctcggcctcccgagtaactgggtctacaggcccgtgctaccacgcccagctaatttttgtctttttagtagagacagggtttaaccatgttgcccaggatggtctccatctcttgacctcgtgatccgcccgcctcggcctcccaaacttctgggattacaggcgtgagccaccgcacccagccaccattttatctctctaaagtctggtcccagtattaaacctattctttagtaaactcatattactgttctaaattgaagaaattatttattactctgtacttctagactcaaaattctttatcaaagatagtctcaaagaggtagtacaagtcctgtttaactgcactttttcacattcacagtgcttcctctgatatctttccttacatcattatacactgttgatatcattttactcttctttctcttctacatttcttaaattttggttcttttcctgtacatgtgttttagcggggcccttttctttgaactttgtctaatt

SEQ ID NO: 722 - DNA, 1120 bp, Homo sapiens
ctctccaatagggtactccagtcaatacacaaagtggcttattccaaggaaaaacccaaatacgaggtaaaaggagttgttaactctacacaccagagtgacctactcagtcctggagcatgtcagcttccccagacacaccacttttcctaacaccagtgaagtgttgcaggcagctgatgctgggaagaggaaagaagggagatcccccaagccaaagcaattttggcagctggggtgtctctagaatcccagctatggggtcagctagcaacaagtagcttgcattcaaagtgattgatgctttgcttggtagtgtgaacgctgctgttcccagttgctccatctgttggataccaggcaagctagaccacttgaagtttacaatcccatgttgggcaccaaaaattgtaacttaacccaggttcagctgcttgctgctcgaaagccaaactcgaaagagaagtgttgatgagaggaaatgcaggtttattcaggagccaacaaccagaggatatgaccaactagtgttgcaaaactatctcaggtttctcagggtgaccaaaatggttttaaaggggaatgagattttgtaattatgaatatacatatatttttttttgagacggagtcttgctctgtcacccagctggagtgcagtggcaccatctcagctcactgcaacctttgcctcctgagttcaagtgattctcctgcctcagcctcctgagtagctgggattacaggtacgtgcccccgtgcctggctaatttttttggaatatacaaatttttaaagggaaatggtgacttgcccaataaaatgcttaaatttaggttaaatatgtctcataagtattaaaggcagaaatattttgttgaattattatactactcttttttgtatttcatttatgaatgcaaagtatttactctaatgcaggggtatccaaccttttggcttccctgggccacattggaagaagaattgtcttggaccacagataaaatacactaacactaacaataacactaacaatagctgatgagctgaaaacaaaaaaatcacaacaaaatctcataatgttttcaggaaatttatgaatttgttttgggccaca

SEQ ID NO: 723 - DNA, 1199 bp, Homo sapiens
aattcagttctgctgaggcccagttaccatttttcaacactaaaaagaataggaaaatgcccttttgtttcactttataaagtttcaaaagcatgaatcagaaaatcattttactttggaacaaagattttctaggaaatttaatcttttattattcaagataattcaaccaaacactttgagccaattttaaatattttgtctacatctcattagactaatgcacttttcttccttttatttttctagacttaatcacacagattcctataagtaattaggtttttcattctttctaaactctttatcttagcacttcattcattcagtcatgacatagtaatgtttgtggaatcccagttgcttttattgagaatggctatatattctctcattaagtaattatttttctttatgtttaataagggagaaagtagcctattgcctcagattcaggagtaaagatgaaattcactgggaagacattatgtttgaaattttccttagggttcctcttcactgggtgaattcagttttagtgataaagcctaaaagttctcaacatctctaaaaatattatctttcttactctaaagcatgtggaaaaagttggctttggagaagttatgtttggctaggaaagatactatatctcatctcaagaatgttaacacatatatattcatctcactctgctaccaaggaagggaaagatgttcagatggccacatcacttgaatagctgagtgatagaactgccttctaggtcactgttccaaatctgaactagcccattctgtccctcccccggccctcccccagttggaggagaatcctttgttgattctcacaatactatgactagacaacatttgggagcaaaaataaaaaaatatgcttctaaatagccttaaatgaattgttttgtctttgtgataattccctgtgactttatgcttgtgacttcctgctgcctgcaagtgatgttggaaaatggaaacacagcagtttattcacttttctttatcctgcatgtctcaagcttggactttggcagttgaagtaagataatcattttgtgccataaaagaagaaaaacagtttgccaacaggagcctaaatttaacattagaagactgggaaatatggaagagaggtgatatcccagcaacactactccaacacagtaatctggcagt

SEQ ID NO: 724 - DNA, 2017 bp, Homo sapiens
gaagcccgagggggcgggcggggggggggaagggacgagcccacaggcagcatcccgacacctcacacttcctgcctcaatgcacagaagaaagtgttctgaaggcgacgcccccagtcttggcgggaaacgccgcggaagacgcttctctcgcagaaatgccaaattttcgggagcgcgggctcgcagcacgtaacagaacagatctttttgtttcacggccctctcgtagacctaataagcgcgagggcgaaaaccaggtcagcgaccagaagccaggcaaggttgcgattttcggagcacagcgaaggggagagtttctaagttctgaatgtacctctatttagggtggtttctattatttcttcgcgtctaccctgtagttgccgcaccctgagccctcagccccgccgcttcgcacggagcggagctcagagggtgcgcgctccgccctttcgcgggcctggcatgagcgcagtggttgttacactaaagtgtctccgcctgtcgaatattctcgtggcagcgatggccgagtggttaaggcgttggacttgaaatccaatggggtctccccgcgcaggttcgaaccctgctcgctgcggaagcgggtgctcttattttttctatttttttaaataaacaccttcaaatgaaaacttttactcttctctgtattttcaatgcctgtcagctaaatggcgcgcctacggagtggttttatacgctgtagaaaagcgaataaatgtcagtgctgcaaacatgtactgtttacaccaagaggaaaatccttccactgtcctaaaaggcaaggtaactcttcgtgctccatgagaagagcaaggtggcaaaatagaaataaaatgaatataaatattgacgcaagttttcgggctatcacagcctgagcaagctatcagctcactaaaactaagaaaaagctatgccaccttcccttccatcccagaatcacttccgacggtttccagaccacatccaaaagtggtatgaaatgggaaataataaaagcaattttaaagttctacttataaagcatcttagatacatccacataatggaacactatgcatgtaagcattaaaatgatgttaatggccgggcgcggtggctcacgcttgtaatcccagcactttgggaggccgaggcgggcggatcacgaggtcatgagatcgagaccatcctggctaacacggtgaaaccccgtctctactaaaaatacaaaaaaattagccgggcgtgatggcgggcgcctgtagtcccagctactcaggaggctgaggcaggagaatggcgtgaacccgggaggcggagcttgcagtgagccgagattgcgccactgcacttccacctgggccacagagcgagactccgtctcaaaaaaaaaaaaaaaaaaaaaatgatgttaatgatgtgtgagggccttcccaatgcattgccaaatgcaaaaaggacagatcaaaaaacagcacatcatactatgatcatatttttgttaagcaactcatgtatatacccatctatgtgggaagaatgggagagaaagagagagatggagaatgaatggaggctggaaagaaatacaccaaagtgttagcagggattattatccctgggtggtgtgatttgggaagatttttattttcttaaataattttttccttaactgggttttctaaaatttgtacatggacccagtattatgttttaaataagaaaattgtgaggttagtctttgggaccctacacatcccctgtctgctacctttaacccactttcaccatatctctcccaccccatgtttcccaggtgctcttatggacatacctgatacctcaaggctagggatagttttctgtggtatctacgtggattccacgcacacagccccatcctatttgagacttggctgaacacacacactcaccacatttacattttcaatccatcctctctgcccaatcccctccctttctgcccccatttaagtcacttaca

SEQ ID NO: 725 - DNA, 1206 bp, Homo sapiens
actaaaaaaaaatcttattaccatggaattcaattatagtacttgtatttcaagcgatccttttgccattgacttttaacttttgaaaggtttttgaaaactgtgtaatttgtttcaaatttctttgcatgtgaattgtcaaattccccaccaccagaggcatctatgtatttcctcttattaagtatttaagcatgtgaggtcttatcatccatataaattgtaattcgtgttcataagaattccagtctgtttaagttaatccatttctctaagatgttaataattcataccaaagtcttacccttacattgtacctgctgcagtgaaatattatccccaagctgttttactataacaagatcgacttttcctacttctgattttaaatatttactttctttcctttaaaggttttgcagatgtgaatggttggcaccttcgtttccgctggtccaaggatgctccctcagaactcctgaggaagttcagaaactatgaaatatgaaatatctctgcttcaaaaaatgaggaagagcaagactgtcccctatgctgccaacatgcagtctttgtttatgtcttaaaaatgtcatgtttatgtcatgtctgtgaattgctgagtactaattgattcctccatccttgaatcagttctcataatgctttttaaataagaaaaattcagaagatgaatttcttccaatatttgaataaattaaagctcttagatacagagtagattgtattatatgctttttcctattaatactacttatagaaatccattaaaaagcaatctctgtacagtgtatttaaatatttcattgacatactgtgatctctattagtgatggatgtacaaaaaatgttttcttacccttgacttacaatgaaatgtgaaattacttgtctgaaccccgtggggagaaataaataattttcccaaagttcataaatgaatttataattcaattttttttagggtcttgctctgtcacccaggctatgcagtggcataatcatagctcaatacaacctcaaactcctgtgctcaaattatcctcttacctcagcctccctagtagctgggactagaggcacacgccaccatgtctggccaattttttattttctatagaggtgaggtcttgctatgttgcccaagctagtcttgtactcctggcctcaagtgatcctcccatc

SEQ ID NO: 726 - DNA, 1188 bp, Homo sapiens
catacaagtcttgacaacagcatctggtctactagactttcttacagatttaatttcttttgtattttaagaactttataatgactgaaggaatgtgttttcaaaatattatttggtaaagcaacagattgtgatgggaaaatgttttctgtaggtttatttgttgcatactttgacttaaaaataaatttttatattcaaaccactgatgttgatactttttatatactagttactcctaaagatgtgctgccttcataagatttgggttgatgtattttactattagttctacaagaagtagtgtggtgtaattttagaggataatggttcacctctgcgtaaactgcaagtcttaagcagacatctggaatagagcttgacaaataattagtgtaacttttttctttagttcctcctggacaacactgtaaatataaagcctaaagatgaagtggcttcaggagtataaattcagctaattatttctatattattatttttcaaatgtcatttatcaggcatagctctgaaacattgatgatctaagaggtattgatttctgaatattcataattgtgttacctgggtatgagagtgttggaagctgaattctagccctagattttggagtaaaaccccttcagcacttgaccgaaataccaaaaatgtctccaaaaaattgatagttgcaggttatcgcaagatgtcttagagtagggttaaggttctcagtgacacaagaattcagtattaagtacataggtatttactatggagtataattctcacaattgtattttcagttttctgcccaatagagtttaaataactgtataaatgatgactttaaaaaaatgtaagcaacaagtccatgtcatagtcaataaaaacaatcctgcagttgggttttgtatctgatccctgcttggagttttagtttaaagaatctatatgtagcaaggaaaaggtgctttttaattttaatccctttgatcaatatggcttttttccaaattggctaatggatcaaaatgaaacctgttgatgtgaattcagttattgaacttgttacttgtttttgccagaaatgttattaataaatgtcattgtgggagataatagtatggcgtctgtcctagaatgctttgtgtcagttactaattctaaaatcaaattggtagaagg

SEQ ID NO: 727 - DNA, 1185 bp, Homo sapiens
ttcttacagttctggaatctgggaagtccaagattgggcagctacatttggtcatcttctggtgagggctttgtgctgcatcataacatggcagaagacatcacagggcaagaggggtgtaccgagagtcaaactggcttttattttttatttttatttattatttttcttatagagacatgatctctctatgttgcctaggctggtcttgaactcctagactcaagtgatcctcctgccttggcctcccaaagtgcttggattacaggtgtcagccaccattcctggcctaccaaactggctgttataacagacccattcttgtgataacctgttagtccattaacctgttaattcattcatgaaggcagagacctcataagccaattacctcttaaaggcctcgcctggtttttttttgtttttttttttgttttttttttttgagacaaggtctggctctgttgcccaggctgtagtgcagtggtacaatctcagcttactgcagccttgacctccccagttcaggcaatcctcctgcctcagcccccctagtagctgggactataggcacacaccaccacacctggctaaattttgtattttttgtagagatgaggtttcaccatgttgaccaggctggtctcaaactcctgacctcaagtgatctgcttgccttggcctcccagagtgctgggattacaggcatgagccactgtgccggcaaggccttacttcttaatattgttaaattgggaattaagtttcaatgtgagttttgaagaggacaaacattcaaaccataacagatgccttattactgctgggggttaggaaggttcaggctcccacttggcattttctgatactaccacagcagggtgcaagaactttacctcatcattgccaggcaagagtagaaatccaggctcctcactcagcctttgctgactgaggtttgttgcgggggcatgggttttttctcgggtgttttgctggaatagggcatttattgtccagagttttctgtcttgctaggctatttcctggccctttggcccgggaacagctccacttggggctttttttgtctatgcccattagtatttaatgggttgagggcttcatcaacacccaatatgagctatatatgagataaaaagaaacctgaggtaactcatcacc

SEQ ID NO: 728 - DNA, 1099 bp, Homo sapiens
gaatgtgatcgatgctaatctgtgtgtgaagggagaggatttagactcacaagtaagtgaaagtgactagtgccaaatgcagagtgttttcagtttgcacagttcctccttgatcaggtgtcatttgaagttgtaaacaggactgttaaacactaaaggaatattaagagtaacattcagtaaaggtacttctgataaagtattttctcccctttaaattaaaaaaaactttatttacttcaggttggagtgattgatttttctatgtatttaaagaatgaagaagatattggaaataaagaaaggtatgattttcataagttatttcacatattgggttttttatatagctctttacaaatcattataagatccatctatttacagtgtggttttattttgttgttttcccccctgtgacttcttcatttcattttcacttccattacaagctttacaaagcagattatggaaaatcacttaggagaaggaggttttattaatagtatgaagtgggacctttggttatacctgtagttactgagacccattttaatagtggttttttggaataaaagagatgaaagcttattattcacaagtttgcaaatactggtttacttcaagatcgaactatgtttttttttttttgagacacagtcttgctctgttgcccaggctggagtgcagtggttctatcttggctcactgcaacctccgcctcctgggttcaagcgattcttctgcctcagtctccccagtagctggaattacaggcacccgccaccatgcctggctaatttttgttatttttagtagagacagggtttcaccacgttggccagactggttttgaactcctggactcaagtgacctgcctgcctcggcctcccagagtgctgggattacaggaatgagccactgtgcccggccctaattatgtttaaatttaaaaatacactaatggtattgttaagtgtattattagcaagtaatttattcaacaaaggttatagatacttagtacacagtttactattattcttatgttttattttaaaggcaagacaatgttttattattttagttttataataa

SEQ ID NO: 729 - DNA, 1142 bp, Homo sapiens
ggtcttgaactcctgacttcaggaatccacctgcctcggcctcccaaagtgctgggattataggcatgagccaccgcgcctggcctagtttcaactagttcagtttgattttattcttgctacactggatttggcttcatgcttcaagacttatacaagctgtagatttcctaaaagtcttaagaaagagtaaattattaaaacaacccaattcataattggagctatatattacattagcaaaggttttttgatagcttttgcaatagactttactggcactaagttgttttccctttgggatttatagaagacccttgagtattctcagatgtgtttgacacatagaaaggggtagaataactaggggttgttttagaagactgtatcctgctatttgatttttttttttaaagacccagaaatttagaaatatttttttcttcttcagataaaatactcatttatttttttgaagcctccctaatacgtttacatgtaggaacctaagctatgtatttatactttaactttgctttattttcaggtgttctgttccagtagagccaggagatatcattcatttggagggagactgcacatctgacacttggataatagataaagattttggatatttgattctgtatccagacatgctgatttctggcaccagcatagccagtagtattcgatgtatgagaagagctgtcctgagtgaaacttttagggtaaataatagtaacagttaatgtttctgcagggtctgagagttttacagagcacttttacatttattatttcacttaatcctcccagcaaccctataaaataaatggtattaattagctgcattttatagatgaggaaaatgggctcagagaggtgaagtgacttgccccatagccacataactatgaggtggcagtgctaggactaaaggccaggtgcctgagtccttcgaatcttgttcagggcttaataaaataactaattataataagaaaattaatttaaatgataaacttttaaatttaaacacacctagacatttccaaagttggcttcatgtgattcccactaaactaaaaataaatgtgcaaactgcttttaaaaaatgtattttgctagaaaaattagcc

SEQ ID NO: 730 - DNA, 1137 bp, Homo sapiens
acaggcgtgagccaccgcgcccggccaggttgtgggttttaatgggaccatctcactgcctaccgtttcctttttccgtccgaacagaaggggcctgagcagtgaactgacagtggcaacgccgggtgaggcgggatggaggagtttacgagcctgggtgacgccctgttccgcgtcctggccccgcccctcccggcagagccccttggcgcgtgacacaggccccgcccttgctgtacgccatcagccggcgccgcgccgccgggtgttactttgccccgccggcggggcggtcagcctcctgtcaccgcctgttccggctatggtcccgtccggtgttctgtaagttggcaacctaggctcctgacgcgaccctggtcctgatggcggcggcgacggccgcggcagccctggcggcggccgatccccctcccgcaatgccgcaggcggcaggggccggagggcccacaacccgcagagacttctactggctgcgctcctttctggccggaggtgggtccatgccacgaagagccagccgcgctctgagtggcgggggcaggactgtgggcaagtgggatgcaagcggcctctatgacattcctggactctggctgcttcaatgttctgttagatgtctgccctgacctgctgtaacctctttctagtaatcacttgactaatgacagctaggttatggggagtgggacctttggcactccggcagaggctggggaggtggaaggtctgaatcaggcacccattcttcagggctggataacagggaaaagaggaggatcccttacagagaccctggggttttagtgagacatgctgggcactcctttcttttataaaaaccgtgagtgacccagtgtagacttggattttgctgtttgcttaaaggaaaacaaatattggagatcagctttttaatgactactggaaaattgtgcaaactgtctacagccaaaactggttccagtgattctagtaaactgtgacacagtacttgacaagccctattattgatgtgactttgggatcaaaaagttcatattgtctcttaggaatttcctgggccttcaagctccacccttccttaattacttctctgggttgtgtaggggtgggttg

SEQ ID NO: 731 - DNA, 1148 bp, Homo sapiens
tcaaactttatttttccaaactttccaggttatcttacttaaaatattcatatcacttactgcttttgcagagagcaatgccgagcctagaattagcactcaataaatttgtgttgagtgaatgaatatggagcttaaatatggctatttagaaaatgtattttagggctgggtgaggtggctcacgcctgtaatcccagcactttgggaggtcgaggcgggtggatcacctgagctcaggaatttgagaccatcctggacaatacggtgaaactccgtctctagtaaaatacaaaaaattagccagacatggtggcacgtgcctatagtcccagctactcaggaggctgaggcacgagaatcacttgaacccaggaggcggaggttgccgtcagccaagatggtgccacggcactccagcctgtgcaacatccagagtctagctccaaaaaaaaaaaaaaaaatttcccatttgggtgcggtggctcatttctgtatatctgtaatcccagcactttgggaggctgaggcgggaggaccactggagcccagtagttggagaccagcttggacaacatagtgagactctacaaaaaaaattttttttctttttttttgagagggagcctcgctctgtcgcccaggctggagtgcagtggcgtgatctcggctcactgcaagctccacctcccaagttcacgccattctcctgcctcagcctcccgagtagctaggactacaggcgcctgccaccacaactggctaatttttcgtatttttagtagagacggggtttcgccgtgttagccaggatggtctcgatctcccgacctcgtgatccgcccacctcagcctcccaaagtgcggggattacaggcgtaagccaccacgcccggccaaaaattttttaaattagccaactgtggtggtgtgcacctgtggtcccagctactctggaggctggacgattgcttgagcataggaagaggaggttgcagtgagccattattgggccactacactctagcctgagtaacggaatgagccctgcctacagagagaaaagaaagttgagtatcttgaatttgaattggtatcttgaaatagtatggctatggtattcattattagctatattctgaggcatg

SEQ ID NO: 732 - DNA, 1155 bp, Homo sapiens
gtgcttaattttctattgtacactgatggaaacttggaatatccagaaaaggcacaaatatcatcagtaaaaagctttttagcatttcctatacaaaaactttattaatataaattcattgttaattttgacaacttgaatattaaccaaaataattttggtactatatatatatataattttgcatttgagattatttgcaagcactgtgttattatttggctgtaagaggacgtataaatatagaaaaaattttaatataaataattgtgtctagggggaaggtcctaaagccaactctactcaagggatgccttggtagcaatgattgttaaccatctggagtgacagaagaaagtgatattgggtaactaacttcttaagaagtttcatctcaagttttgtaatattatagcaacaaaaaattatgctattggttgctccattctggtcacatggatgggcgttttcatcatgtcctggttatgtactgattaatgtggtcaatctctgcactttctaaatttttgatacatggaggcagttttaaatggttggatggttttatgtggtgacaacatttgtatagaattttttttttttgtagttaacactcagaccactgagcaaattttaaatactgccgaagcctttttaacatcccaataattggatgcagtattaaataaacaaataaatatttacaattaatttttctattttgcattcaccaagtcaagtagaccacattagtcttatgaataaaatgcatataatgcatccttccaataacatgtaaaaatcatagaaaccacagaggcattcctttgtgtatattaattctcgatagtaaaatgagtcacccaaaggaaaagccataacattcctcagatggccaaaattcgttgtcaagtttatttttaatgttgagagttcttggttatttccatctaactacattagatggtttttttccatcgtctacatttgttcccttgtgacatttgtggaatttcagtgcagttttctaccgggccctctcttgtctgttgtgcaaactataacagcagtgaaataaaacacagactgccttgtactacttctacaaataataaccacgtgtcacagatttttgttctgcctgttgtttgttag

SEQ ID NO: 733 - DNA, 1167 bp, Homo sapiens
agaatataaaatttgttcatttgcaaaacatgcttctgaaatattttgtttccattatttatttagccagctagtttcttatgggtactaaagaaggtctcccaaattacctaaattccacaatagggcttagatttatgaagttttatattttttcctccttataaaaagctctttttataaagaatatccatgtaatactaaaacggggaaatctcctaaataatatattttttaatattacttttttaaaaagctagggtgagcacctcacaatcaaaatttaatgtatttgtcatattgaaatgcagggttttttgaaggaaacatggtaggtaaacattttagttcccaactcctgatcgttaaaatgcaaaattgggcctggtgtggtggctcacgcctgtaatcccagcactttgggagaccaaggcgggtggatcacgaggtcaggagttcaagaccagcctggcctagatggtgaaatccccgtctctactaaaaatacaaaaattagccgggcatggtggcagacgcctgtaaccccagctacttggtaggctgaggcagagaattgcttgaacccaggaggcggaggttgcattgagccgagattgtgccactggactccagcctgggtgacagagtgagactccatctcaaaaaaaaaaaaaaagcaaaattgttggcatctctaagacagagcaagactccctctctaagagatagtagtgtctcccacttaattgaattcgttttgttttgtttgctttgctttgattcttgccacgtaaaatctgtgggtcttgacccagagatttgctcagacagttaagaaaaataataagatgtatttgtaaatttttacataatgaaaaatgagatgtatttgtaaaattttaaaataacctctttataaatacgtttataaatataaagaggtaggatgttttggctaattagcacattctgggtcatacacacacacacacaaacaggccaaacactctagatagtcaaataaattccccttttggtgattcagttcagtaatggtgattcagttcagtaactgcctatcctcatcaatgcttgtttgtgatgatgaaatagttgacaaccgggactttacaaaaatagctcctgaaaaaaattaaatattttatt

SEQ ID NO: 734 - DNA, 1245 bp, Homo sapiens
gtattacttcctatttttatttaaatttcagacatcttatatttaaagataattagtagtgcttctcattttttcacattactttagacttttgacaggattgaattatttgactataataggtaatgctgatggctagccctagtatggaagatttatatcataagtcatgtgctcttgctgaggacccacaagaacttcgagatggattccaacatcctgctagacttgttaaggtaaaaggacacatttgttttaactttagatgtattcactttgcttagctgtaactttgtacacataaaatctaaagccctacattttaatatttgttgattaatgagtaattttagtattaaggcacccagaatttaatgatgtagatgtttttctcattgcagattacaactatatcttatttgtacgctactagttcaacagtcattttgatgttttatatttgtaacatagtagaatattagtggtaataggattcagagtgtctttggatgttgttgaagtttgaattatagcttgtttctttaaaagaactctatctgaagaaatattttaaaaggatgagttatgatgtgtgtaaatcctattccattgctgaaatgcagtgtggaacacaatgaactgaactcttccttgactgacagataccagaggtagtaaaaatgatattggaaaggtttgtacctttccttctcaagtatcttattggtaatttgacagggtgcgtaatatatgtaaatgattctttgttttgaattagtttttagtgggcatgaaaggcaaggatgaagctatggccattggaggccactggtctccttcgttggatggaccagacccagaaaaagatccctctgtgttgattaagactgctattcgttgttgtaaggctctgacaggcattgatctaagtgtgtgcacacaatggtaagtactaattcatttcttgattagaagtgttttactgatagtttatgtagttgttcttatcgatcagccttttccccccggcttattttagcaaccctggtcaatgcaggtaatctcaaaggaaaatccccatttgtagctaaagtttatttggtgccaaaatgttttgggggaaaagggattaagaactaatcaaaataaactgaaaatttaaatgttttgttatgttgtactttggaagttggatgtatgttgaaaatacttttcatttcatgcatagctggagaagatcgtcaa

SEQ ID NO: 735 - DNA, 1245 bp, Homo sapiens; identical to SEQ ID NO: 734

SEQ ID NO: 736 - DNA, 1168 bp, Homo sapiens
aggcgtgagccaccgtgcccagctatttatttattttttgagatggagtttcgctcttgttgcctaggagggagtgcaatggcacgatcttggctcaccacaacctccacctcccaggttcaagcaattctcctgccttggcctcccaagtagctgggattacaggcatgcaccactacgcctggctaattttgtgtttttagtagagaaggtgtttttccatgttggtcaggctggtctcgaactcctgacctcaggtgatccgcttacctcagcctctcaaagtgctgaggttacaggcgtgagccactgtgcccggccatgcatatgcgtttattaaggtgcaatttacttattataaaattcaaccttttttgtgaacagttctgtgagtttttacaaatgcatatagttatataaccaccaccaacaccacaatgaagatacaaaacagttctaggtaaaaaggccgggagcggtggctcatgcctgtaatcccagcactttgggaggccgaggtgggcggatcacgaggtcaggagatcgagaccgtcctggctaacatggtaaaaccccgtctttactaaaattacaaaaaattagctgggcgtggttgcaggcgcctgtagtcccagctactggggaggctgaggcaggacaatggcctgaacccgggaggcggagcttgcagtgagcccagattgcgccactgcactccagcctgggcgacagagtgagactctgtctaaaaaaaaaaacaaaacaaaaaacaaacaaaaaaaaaacagttctaggtaaatggctcagaaattgagttctagtgaagtgcttattccagaatctgtctacttctaaaacagtatgtttgattgagtcaaaccttgagactcagactatttattcaagctgttttatgcttcagttttatgtccaatagaataactcccggatgcataagcctgttacttgttttctgaatttgaaatatagggatatcagaagtgtgttttagcaccagtaattggataagccacataatcagtttctaaatcttatacattgtaaagtacacatcattatttatgaagaattacttccagaaatgtttgctctaaatctgattgtgagaaaacagataaatctagaatgtgaaattttcttttttaaa

SEQ ID NO: 737 - DNA, 1235 bp, Homo sapiens
ccagctaatttttgcatttttagtagagacggggtttcaccatgttggccagcctggtctcgaactcctgacctcaggtgatctgcccgcctcagcctcccaaagtgttgagattacaggtgtgagccaccatgcccgtatctctgaaatctctttgaatgcctctttcattctttcttttttgagacggagttcactcttattgtccaggctggagtgcagtgatatgatatctgctcactgcaacctccgcctcccgggttcaagcagttctcctgcctcagcctcccgagtagctgagattacaggcatgagccaccatgcccagctaattttgtatttttagtagagacggggtttctccatgttggtcacgctggtctcgaactccaacctcaggtgatctgcccgcctcagcctcccaaagtgctgggattacaggcctgagccaccgtgtctggccctgaatgccttttcattgcttgtttttttgagtttctgttgtttttttgttgtagtctacttcttgggaaaaaatagatgatttgtcctctaactttccttacagactcacttttgctgattgcatttctgtggtatggtttatgtgttcctctgtcctctgtatttcatgtaaattgattgttggatctaaatttttaatcaagtccagttctgttttttccctaagacgctttcataagtagtgtggtatgttctttcttcaggatatccataatgtctagttgtctcttttggggatgaggtaatgctttattattttctctagaattaaaatagcatttaataccatttaaagagataaaaaatttaacttgcgtttgagttgtaagagaaaataattgtttaacttttcattattaatctattttttgtatcattattttatgtatttatttatttttgagacagtctcactttgttgcccagaatggaatacgatggcacaatctgagctcactgcaacctctgcctcccaggctcaagcgattctcctgcctcagcctcccgggtagctgagattacaggcatctgccacaatgcctggctaattttttgtatttttagtagggacagggtctcaaactcctgacctcaagtgatccaactgcctcagcttctcaaattgctgagattacaggcgtgagccaactgcacccggcctatttatttatttattgagacagagtctccctctgtcacccaggctggag

SEQ ID NO: 738 - DNA, 1229 bp, Homo sapiens
aggagttcaagaccagcctggctaacatggtgaaaccctgtctctccaaaaatacaaaaattggccaggcatgatggcgggtgcctgtaataccagctactctggaggctgaggtaggagaatcgcttgaacctgggaagtggaggttgtagtgagtcgagatcacaccactgcactccagtttgggcgacaagagcaagactctttctcaaaagaaagtgaaaattatatcatagtttttctaagagaatcaagaaatgtattttcatctctgtattttgtttacttgcatgcataacaggtaaagaagcttcttaataaagtagtgctccgtgaatcttgcttttaccggaaattaacagacacctcaaaagatgaagagaaccatgaagagtctgagtcattgcaggaagatatgctaggtctgagtaatattaagattttgctttttaataaatatactagtaattaaagaagaaaaataacttactaaaatatggtatattttatattataggaaacagattattacttccaacaccaacagtaaagcaggaatcaaaggatgtggaagaaaatgttggcctcattgtgtacaatggtgcaatggtagatgtaggaagcctcttgcaaaaattggaaaagagcgaaaaagtaagagctgaggtagaacagaagctgcagttactagaagaaaaaacaggtaagggtcagctttgaatatgttaatactttcagcaccctgctgggacacgtatatgtttatgtgtgtacatacatatatacgtacctgtgtacacatttgcatatgcataccagatattttcatcgaagtacataaggaactttttaaaattttttattatttatttgtttttaagacagggtctcactccgttacccaagtggagtgcagtggcacaatctcaacttactgcaaccactgcctcccggatccaagtgattctcccacctcagtctcccaagtagctgggattacaggcatgcgccaccatgcccagctattttttgtatttttagtagaaatggggtttcaccatgttggccaggatggtctcaaactcctgacctcaagggatcacccactttggcctcctatagtgttgggattacaggcaggagccaccatgctctgcagggacctttacttttcactatttctggttcaggttataaaattgcttagctttatctgaatcttaggtctt

SEQ ID NO: 739 - DNA, 1237 bp, Homo sapiens
tcttcattttccaagatagtgaaactattgatatatacccgtctatatatatagctaagaagcgattttagaaaaagcttactattttgatttttaccttatcacagcatgaaagtacaaatgtcgaaatgccccaaaattgtattttttaaagttgaaaatgatcttgaaataatccagaattgatgaatgttgcaaatgtataaatgccttattcagtgtttgtattttccttatgaattttttttagaaagagaaaaaagagaagccaaaatctgataagactgaagagatagcagaagaggaagaaactgttttccccaaagctaaacaagttaaaaagaaagcagagccttctgaagttgacatgaattctcctaaatccaaaaaggcaaaaaagaaagaggagccatctcaaaatgacatttctcctaaaaccaaaagtttgagaaagaaaaaggagcccattgaaaagaaagtggtttcttctaaaaccaaaaaagtgacaaaaaatgaggagccttctgaggaagaaatagatgctcctaagcccaagaagatgaagaaagaaaaggaaatgaatggagaaactagagagaaaagccccaaactgaagaatggatttcctcatcctgaaccggactgtaaccccagtgaagctgccagtgaagaaagtaacagtgagatagagcaggtacatttgcacttcattgggtagaagatatctttcattgttgtttcagataaataagtaggtaactgctatatgtactctttaatagtaggagaaaatgtgatgtgtcagcaccttgtgggttgggggataccttaggctgactgggacttcatcttaaaaattagcatacgacagggcatggtggctcagctaagagtactctgtcttttttatttttttatttttttgagacagagtctcgctctgtcacctaggctggagtacagtggcacgatctcagctcactgcaacctctgcctcctgggttcaagtgattctcctaccttagcctcctcagtaggtgggattacgggtgtgtgctatcacgcctggctaattttttgtatttttagtagaggcgggctttcaccatgttggccaggctggtctcgaactcccaaccccaggtgatctgcccgcctgggcctcccaaagtgttgggattacaggcatgagctactgttcccagcggactctgtctttaaaaaaaaaaaaaaaaaa

SEQ ID NO: 740 - DNA, 1083 bp, Homo sapiens
ttttcatgcaaagttaaaagcacattgtgcctccttttgaccacttgccaagtccctgtctctttcagacacagacaagcttcatttaaattatttcatctgatcattatcatttataactttattgttacttcttcatcagtttttccttttgaaaggtgtatgaattcattacatttttattctaatgtattatctgtagattagaagataaaatcaagcatgtatctgcctatactttgtgagttcacctgtctttatactcaaaagtgtcccttaatagtgtccttccctgaaataaatacctaagggagtgtaacagtctctggaggaccactttgagcctttggaagttaaggtttcctcagccacctgccgaacagtttctcatgtggtcctattatttgtctactgagacttaatactgagcaatgttttgaaacaagatttcaaactaatctgggttgtaatacagtttataccagtgtatgctctagacttggaagatgtagtatgtttgatgtggattacctatacttatgttcgttttgatacatttttagcttctcattataaggtgattcatgctttagtgaattcttcatagatagtatatataaaagtacattttaatagaaagccagggttttaaggaatttcacatgtataaggtggctccatagctttatttgtaagtaggctggataaatggtgcttaaatggtaatgtactccacttcttcctattggaagattaacattatttaccaagaaggacttaagggagtagggggcgcagattagcattgctcaagagtatgtaaaaaaaaaaaaaaaaaaaaagaaccaaaccactggaaataatcaaatgcaaaaaggtaacaaattcataactggaaagcaaagagaagaacaagtatgatttggatgataaagcattgttttaatggtgaaaacttcacagatcactaatgtttctagaggttaacttcaagtgggcaagctggggtttttaggtagtcagtggcctagttcctaaagccacagtataggatctgttaaactgaatgtctgttgaaagttt

SEQ ID NO: 741 - DNA, 1233 bp, Homo sapiens
tgccaagaactcagccacctgccaactctgccagagcagctccaggtgccagagtttgactgcagggcagggcccagtgtgagtaagtaatctgtcctggaccaggtttactgttatttggaaaccatttacaggaaagcctattatctctggtgccatctctggtgccatctctggggttgagggaagggttacttgctttgtaagtccaaactgctagcaatttgcatctcagtttttaggtctggagggccataagttttatgacagccttgtaccttctgtaagactttttgcttactttaaaaattactactggggccgggcccggtggctcatgcttgtaatcccagcattttgggagactgaggcgggaggatcacccgaggtctggagtttgagaccagcctggctaacatggtgaaacctcatctctactaaaaatacaaaaattagccaggcgtggtggtgtgtgcctgtaatcccagctactcgggaggctgaagcatgagaattgtttgaacccaggaggtggaggttgcagtgagctgacatcgtgccacggcactgtagttgggtgacagtgtaagactcggtttaaaaaaaaaaattactattgaccaggcattgtggctcatgcctgtaatcctagcactttggaaggccaagatgggcagattgcttgaacctgggagttcgagaccagcctgggcaacatgatgaaactctgtctctactaaaaatacaaaaattagctgggcgtggtggcatgcacctgtagtcacagctacttgggaggctgaggtaggaggatcacctgagctcaggagacggaggttgaagtgagttgagattgtgccactgcactccagcctgcatgagactctgttgcagaaaataaaaaataaaaaataaattactactgatagaaatgcatgcatgggcttgttacaaaatttagaagtagaaaagggtaaggccgggtgaggtgtaatcccagcactttgggaggctgaggcgggcggatcgtgaggttaagagatcaagaccgtcctggccaacatggcggaaccccgtctttactaaaaatacaaaaattagctgggtatggtggcgtgtgcctgtagtttcagctacagcgagggctgaggtggagaaacgctagaacccgggaagcggaggttgcagtgagcctagatagcgccactgcattccagcctggtgacagtctca

SEQ ID NO: 742 - DNA, 1105 bp, Homo sapiens
tgtggaggtcaaggctgcagtgagccttgttcgggccactgcattccagcgtgggtgacagagcgagaccttgtctctgaaaaaaaaaaaaagataacctctgtctttttcagtatcttgtacacttctcataggaattatctacatttgccaaactggttgtttcattatgtagccaccagctgtttgcccttacctaacagagattactattgtactgattgttctctgtacttagtgtcagagctattcagagatactagatgattttctttcaatgtatatgtgtatggcttctcttctcaacaaggggcttcgctccaatgttatcttgaacttccgtgataagtcattccacagctctttcaaaataagtacttggaatttttgttgagtgtataattatttgtgcatcttgaaatctgcttattctcttctttctttttaaaaaaatcattctcactgtcatcttatgcttcttctcttcttagatatcaatgatgtcaaacggctgaaacctggctacttagaagctactgtggactggtttagaaggtataaggttcctgatggaaaaccagaaaatgagtttgcgtttaatgcagaatttaaagataaggtaatatgtcattcagaactgtagctttaggctcatttgtattgagactcataatttaaccatattgttaccatctaaagattcacaaaacagaagtctggaaacataacacagtcttggtgtttatttattcactttaatattctcttccatttttagaataaggaaatgattcagaagagacaaagtatcaggctttggggaaatgttgataataggaaaataatacctttttatcattgtaatgcaaacctcttcaaattataggactttgccattgatattattaaaagcactcatgaccattggaaagcattagtgactaagaaaacgaatggaaaaggaatcagttggtaagtgtaaacactttgcatgtttaacacacaaagcagaccagcttgcagaaaaggttttaataatcataagacactgtactgttactttcacttagaaaagagatacaaggctgggtgcggtggctcacac

SEQ ID NO: 743 - DNA, 1140 bp, Homo sapiens
agaagcaaagccagacgtggctgtggctgtgttgggctggaagcccaacacactggccgatcccgtggctggggctttggccacacttttattcttcctctgaactggaaacaacagagaaaaccttaaatgcctggtttggggccatataagagataaaaagaaagccaaggcatcagcagccttgctggccccagttggccttcgtggcctcagtttccttatctgagaaatggggaaacatctactccatagtgattttgtgaggttggagatattgcttataaggtgccctgtgtagggtttggtgcatgcaagattcttgatgagtgatgcttctgatacagtgatggtgaagacactggggggcttagttgtagacaagagaggtctctggccaagtagtcaggatgatggtccagtcataggaatctctctccacaaggaatttcagtgagaacagaactggagagatccccaagtccacgtcttcacggatggggaccctgaggctcagaagggagaagtggcttttctgacctgcctccaggaagatgtagggcgagacctcagttcagggtccccgggtccccggtcaggctctttgccatggaagcaggtggtgtggtcacctgcttctcagctaatgctaagaggctgtttttaactggttgtgtatatatacctcaccttaccgcacagaggatttgtggagcttgtgacgcaggcagcttgggtagagcagtggaaaccacagtgggagcagaagcaactcagagaccctgctgggccgtggcttctgagaagtgaagctggatggctgggaagaacttgctctcttgccggtgcctccccaccccatcaggatgcatgccccattctgtctaattcaaggcctttctgtggaatgcttccttcccatggagctcagatttggctacctggagatttactctaacaattttggtggaatttggcacatacattgacattcataaagccctaggggttggacaagtgggtgactgacaggggtgggacatccatccccaggaacctgctgtctttgccctcccttggggagggggcctagaagcagctccatggtttggttcccactcaaaacctaccaggtttatt

SEQ ID NO: 744 - DNA, 1231 bp, Homo sapiens
ctttaaaaggggctgtttattttttctcatacttgtttattctttcatttaaaactttttttttcttaaagatgttaatgttagggcctaggtcacatataaataagacatagccctgacataagaaactcagagtctataaagagagacagatggataaacaggagtcctgtaatacatgatgtgtgtaagatggagaggaagaaccttttaaaaaagtgaggggtgggggtggcttcataaaggaagtgatggttggagctgagtcttgaaggatcaacaggagtgtccctggcagaagagaaagggcattccagatggcagaagagcctgtttacaggcagagaggttagagattatgctttcaacttgaattgtaaaatccttaaaagttaggattacatgggatttaaattaaattcctgggtggtattatatgttgataaccccttaaattgtttcaaactctttttaaccctgttttccaggaactcgaatcatttatgacagaaagtttctgttggatcgtcgcaattctcccatggctcagaccccaccctgccacctgcccaatatcccaggagtcactagccctggcaccttaattgaagactccaaagtagaagtaaacaatttgaacaacttgaacaatcacgacaggaaacatgcagttggtaagagaatggcgatgttggagacctagagcgtggctcttggaatttgaatgtctgtttgctgtaggttgagaagctattgattcttcagttttgttttttgttttttgttttttttgagacacagtctcattctgtcactgaggctggagtgcagtggcacaatctcagcacactgcaacctccgcctcctgggttcaagcgtttctcctgcctcagcctcccgagtagcggggattacaggcgcctgccaccacgcctggcaaatttttgtattttttagtagagacggggtttcgccatgttgcttaggctgttcttgaactcctgacctcaggtgatccacctgcctcagcctcccaaagtgctaggattacaggtgtgagccactgtgcctggccaattcttcagttaataactaatgttcagttatatgtctctaaggtttccctcctcccccaaaggtttcttgaaatactctgaaaaccctgaattctaaatcataaatctgatgtagttggtgggagaaaagaatccagaatcaggatgataaaccc

SEQ ID NO: 745 - DNA, 1161 bp, Homo sapiens
gcaactctggtagcgttaccctgtgacactgttttgaggtccacttcctttctttcctctgggaggaatgtcttctgtctttggtattatagttcatcttcccattcttttacttagtgcatttgtgcagatatttttaactctgtacatcagaagagagcccttggtaaccagttttgctcttcttctgccactcctccctgcttgcatctcgttgctggcagagtcctcttgtacttcaagaaagcaaagtgattttgtctgctcctagagcaggtccataccaagtaatagaggcactttagcttccacttggtgggtaaggcctgatcatagtattctgtcagataatgcctaagaatgaccgctgaagaacgttgacccatttgagtacccggtctcagtcgtcatttttaagtccagtgagcattgtggtagttgttcttagattgcagtttcttatgttttgagtttgaagttgattttcagaatgttcttagaaaagaactgcatttttttcctttgtggatctgctttgtttggctgctgggatagataagcatgggcttaaaaaatgtgttcctcccagttttcttgcctttcctgttgtactctgaatttctctccctacctccctcactttcttcctctctccttcctttccttcctttttctctaccaggccatttttcaaatttacatcaaagatacctgaagtgttggtatctgagaatatctgtcactcctcttatctgagaagtgaccttttatttttaagatgactacagacctatttttagatatgttttcagtacaattttgaacagcaactttttaattaaacatcttccagtgttaggaagttgagaaacgttcataggcaagtctgctgttctatgtcaccatcttttgtctcccctagtcccccaggagctctttcctttcccctctagttttgggtgtgcatgtttggagtttgtagtgggtggtttgtaaaactggaccattctgccttgctatgggttgttcaagaaagcctcattcttttctgtgaccctttcgcttttgcattcaccctccttcccacctacctgtcctggggctgttgagcagcataataatcccgggagaatgattcccctcatagaaagacaaaagcat

SEQ ID NO: 746 - DNA, 1947 bp, Homo sapiens
tcttgtttggatttatgctctgcctcttcccagcattttcttatctgtagccctgcttgcttgagagtatacttggataagaagtattgctgttgagggagctataagaaaaggattcttcttccagaagtaaagaactcatctttagagtacctttaaatgaattttgtttttctttcttattttgaggtggattggtcttctctttttttgggtttccagctcactgggactctcagaccttacctttccagctcaaacaccattagttaaattccttcattctcattagaatgcagcctgctgagtatgtgggtttcactgccggagtccatcatttagccagtatacatagaggaactgcttcgaatcaaggcaactggtgaagggcttagcatgttggcagcaatatcccagagattgaatctgtttgcattttcctcatctaggataacagctgcttgaagccagggctcttagccctttgcattccccttgagcgaggaagccacactgcctttctgtgtctggttcagagctcttccttcttggcatgttttctggactacatgcacatgggcagctatagattaatctgcaaaacctagtcacttacctacccataatatctgggaaggtgtggtatttgttttaaagaaacattgtttctttgggagggcagtttctgtctggactttgaggtggacttagttatccctacagttctttaactctcagcttttaataaaagatgaaatcagatattgatgcagttgggtcacaattctttagaatgcttctaccccagggccgcttcctgttcctagtcatggttttccagtttagtagtggagtttcttgaggctaacttacagaaatttctaactgaaaactttaagagttattgatacttgttttttcagtcagtcacttacatcacctagcctactctctggaatttaaatttatttctctaggctggtcctggaagttgataaccttttggcaaagcttagatttaggagaaggcttgagtccctgttcagcgggtctgtggattctctttgcttatggctctctgcctgcagccctggcagaccatactgtatgtcatggatacccagtggaaatattactgagatgaaacacatttccaagggtatttaaactctcactctgccacctttctaagggtgggaggctggcagagatgctgcaatgcttgataatcatttggccacactgaaatttccaaagggagctcttgccggtgcttaaaaccaaaactcctggacacttagaaaattccatgaatctagcacaaaatatccattcttgcccaagtgtatcccctttctctccagcttaatcttttttttttttttttttttaaagcccaggccaagggtacttttaactggaaactggggaggagggaagaacactagcagggagctaagaggcaggttgctgggtaagccatcctgctcctacctggtgcctgtatctacattgctgagtgctgtgcgccagtgcctttccttcatctgcagatggagcccatctctttccacctgggtgaggagaccctctgctactccaggggtaaaccttaaagaaggtgtcttgaagagcccagaggacactcacgtgctaaggtgtccattttatgcatctttaaaatattttatttaaaaaaaaaaatagccctgccctgtcttagtgccactaacggcccagttccatccattctgaatggaaaagcggagactgccagcactttccttggtcttccctttgtctcccatgatgtgttgttccctcatccctcccatccatttcactgtgtgtggatggatagcagagggtaccacgcagtccttgaggcagtcctgtgtgattccatgatcagttgtttttgtattttaactattcttccaaaccagc

SEQ ID NO: 747 - DNA, 1239 bp, Homo sapiens
tcagcttcccaaagtgtcgggattacaggtgtgagccaccgcgcccagccattttaacgatttttaattaaacactacagtggcattaagtacattcttgtagctgtgcaaccatcagcaccatccatctccagaagctttacatcttctcaggctggaactccttacccattaaacaatcaccgaggcttttaaaatagtggtttttggagatggcaggcagccctccttgagaagcgtgagggaagttgtaagagaacgtgagagaatgtggaacactctggggagaaggggcaggaatttgaggggagaaagcaagggccccggggcaggcaggcttagcaagctcacctccgggatgctgccagggctccgagagtcccctgcatgggctctttccttccttccacagccaccccagccccaccgtcctggcctcaccctctctccctgtaaggaaatggtgggcattttaacaatttcgctgcctcctgccagcagcagcccactcctgcaccctcttcagagacttgaagtgggtgacaactcctgacgggcgggcctgggggtgcagaaagggacttgtccatgggtctctaagtgtcaaatgtcaggtaggtgtgaagtcagagccaggagaccagcttctggggggtatgggaggtgttgagtgttgagagaaagcagggtttcattctcttcttgacccccttgggaaagaggccccctggggagctggagttagaatcacagttaaggcctcttctggtcctagaggttcccaccagcctttgaaagtcctggaatgtttagctggagaagcctgggggtgggggtatgagatggtgtttctcaaatatttgaggggcagtcccccgggaggaggtacctgtgctctggtggtcccagtggtggaggtggggggtgggaggtgaggggaagtaaaagaatagctggagagtgaggggagccactgagaagtggatgtcgggttcatgtgtggagaagggtgaaggacgtcctaacaccccgcacagttcgcggggaagcggatggcgtctgaaggagtgagatccccgtcactgggaggattcaagttaggcagcagtttagtagccgtatacaagagctctggagtcagagagggctggggaacactgggcaagttcctcaattgctgtgtgcctgaatttcttcatttgtaaaatgaggatagcaatggaacctgctctaagggtt

SEQ ID NO: 748 - DNA, 1325 bp, Homo sapiens
tggcaggatggtggaggtttctcaaggagctggagacttcagggagcccctctcatggggaggaaagagcttccagggggcgaacgcagcacagaggaagaggcctgctccacttgtctgggaacctgggcaggaggcacagaggaagccaaggcctggagctgcaggtcccccggcatctctctctgtcccggcagcccaggatggcctggtgcccccacctgctgcagcaggagccccaaggagtgctagctgagggtggttgctggggtggtcctcatggacagtgaggtgtgcaagggtgcactgagggtggtgggaggggatcacctgggttccaggccatccttgctgagcatctttgagcctgccttccggtgggagcagaaaaggccagaccctgctgagttagaggctgctgggatccactgtttccacacagcgggaaggctgctgggaacaggtggcagagaagtgccatgtttgcgttgagccttgcagctcttccagctggggactggtgcttgctgaaacccaggagctgaacagtgaggaggctgtccaccttgcttggctcactgggaccaggaaagcctgtctttggttaggctcgtgtacttctgcaggaaaaaaaaaaaaggatgtgtcattggtcatgatatttgaaaaggggaggaggccgaagttgttcccatttatccagtattggaaaatatttgacccccttggctgaattcttttgcagaactactgtgtgtctgttcactaccttttcaggtttattgtttttatttttgcatgaattaagacgttttaatttctttgcagacaaggtctagatgcggagtcagagatgggactgaatggggagggatcctttgtgttctcatggttggctctgactttcagctgtgttgggaccactggctgatcacatcacctctctgcctcagtttccccatctgtaaaatgggagaataatacttgcctacctacctcacaggggtgttgtgaggattcatttgtgattttttttttttttgtacagagcttttaagcattaaaaacagctaaatgtgagtgcacctggctgctaatatgtctttagtgtcagacagacgttctagaactggtacaacaggctgaggtccctgccccttcagagtaagggtgggcaggcagagtgagttgagagcacctgttcttggcacttccagctctagagcaggcgggtttttgcagacacgcatccccagttttgcctcaccctcttacactggatgtcaggctgagctcctccttgaagaaagcaacggaaccagcga

SEQ ID NO: 749 - DNA, 1131 bp, Homo sapiens
atttagtatcaagctcattacagaaccagtttgctgactactggggtagagaataggaaagattcaaatagagaagagaaatgacattgatattgggggtattagtgtgagttaagagagtgggacagtgattctagcagtcatatagaaattttagggctgaagtgacgatctagcttaaccctcttactgtataaaataggcacaagattgaaaatagtctcaaagtccactagctgttaagtggcagtggagtgctgctggagtgactggtacagaagccttgagggctgtagatgataataagattattgctgaagaagggcaagatccggaatgaccttgcccttgaaaaatgagagttgaagtacaaactaagaacagacttcttttctctctctaaatgtaatgtttttatttttcacttgtatttctagaaggcctttgagccctacttagagattttggaagtatactccacaaaagccaagaattatgtaaatggacattgcaccaagtatgagccctggcagctaattgcatggagtgtcgtgtggaccctgctgatagtctggggatatgagtttgtcttccagccagagagtaagtatgctgtctcctctgtaaaggtatagtggtgtgtcactagcctcaaactaattgctgagagataggactaatttattgccttttggttgtttttttgtttgtttgtttgtttttgagacggagtctccatctgttgctaggctggagtgcactggcctgatcttggctcactgcaacctctgcctcccaggttcaagtgattctcctacctcggcctcccgagtagctgggactacaggcacacgccaccacgcccagctaatttttgtatttttagtggagatggggtttcaccatgttggtcaggatggtcttgatctcttgacctcgtgatccacccacctcggcctcccaaagtgctgggattacaagcgtgagccaccgtgcccggccctggtttggttcttatttttaaaatctgtttaaatgtaaagcagtactttgtcttctgattggtcaagttataacaggactcttgtataactaatactccttacattgattttttttggatttgtagtt

SEQ ID NO: 750 - DNA, 1234 bp, Homo sapiens
tctctattagtgtgttcttctgcctcttcccccttgattcagctttcagaggtactatggcagttttgcctcaggtgctgaacatttctcagccctggctaaaagggagcagcacagggagagaaacaggataggaaagcagaatggcgagcagcctatggcccagggcctgtaatcccttcccaagactagctgctcagggtggtgcagggacaggaccagaccctgcgcctatttcctgccttctttcccctatagggaactctgtaggctgagccactgtcctgctcttatgacattatatcttgtgcctttctcctcagcagtgagcagtgagctactcctggcccaggccctaggggaaatggatcagtctttgaggtttctatttggggaggggagtacttaagatgagtcaaaagacactttcctctgttccattccccatctcagggactcctgaatattcagcctctccaggctggtgtcttctagtttcccccactgggaatgctggctgggagagccatgactaccagacttttcctcaggctccttggcatgttagtctgaattgttcttgagcactgtactactgacccaacaactgtgactagctggccacgccattcagggctggtgtggcatttatgtgtgtgtgtgtgtgtgtgtgtgtttttcctgtttgcccagcagtgcattgtgggttccaagagtgggtagtgtgtgtatgtgtgtgtgtcagagggagacctggcaggcacctctttgagagtagctgtggtcagagctgtttggtcagtgcattatgttgaatgaggtccaggaacccagagccacccagcagacaccactgtggcttgccagctgccaagatggagaagcatgtgcccctgtagagcgtctccccagaaccagaccccgagccactcgcttcctctgtgctgtgacaacattggtgccaggggagatggtgtttttcaaagggacctactgtagccactttaatttacaattaagagccttagtttgacttaacacttttgtaggcttttcattgtgtatttttgtgtatgtgtgcatatagcagctactctgtagcagaggtgggtagagacacttaatagtatcatgtcgcatgcagatgtcacatcggcctctgcaaaaactgtactgtcttgtttctgcattagacttaagtagtcatgtgaatatactgctatgtcacttttaa

SEQ ID NO: 751 - DNA, 1470 bp, Homo sapiens
aaagcaaaaaggcaaaggaaagaaagaaagcttcagaccgctagtaaggctcaaagaagaagaaaaacaccaaaaccacaagggaaaagaaaaacccagtttcttaggaaacgcaaacgatttattatccagattatttggataagtcctttttaagaaaaaaaaagaaaatgaaaaacaacacaaaaaaaatagaaaactcttttcttgagtgtggatgagaatgggcacgctcacacttctggccaggagtgaatgtgcctgtgtgtgtgtgtgtgtgtgtgtgtgtgtgtgtacatgtacgcgtgtgcattgaggagagagagactgaacagagagtactttgctgctaacgaatccatcttggactaaattctgacaaggcctcagtttccccagttgtgcagggagtaggtcagacagggttttcactgtctagatttagctggttagattttcctctaaaatcttaagcagatgctgaatccataaagccaaggagtgctgagggctggagtgggtgggccctccctcccacagccccagggagatacatctggactcctgggaatctggattaagaaagttgggatgaaagaggaggactgctcaggccagttgtgagccagggagaatgttccagtctggttttggtctggtggctcctagaaagggatgtggcccagaagtgggactcaaacagagagatgaagtaggggaggggagtcctccacgggcatctctctcctggcggctggatagctttaccctagggtggggccagccctgacaccctcatcccctcctcagcccagcagcctctagagcagcgtggtgctctcttgatggccaggaatccagaatctgcccttccccaaccttggtttctccttctgtaaagcagagtgatggctgagaagtcctctctagctgcagaagcctgagcttcccggtgtcagtcagctctgcaacgtgggagccttggaggcgggtggcctggctgtgcttcatatgcccaggagtggagaaggaggctgagaagctggtttcccagctctgatctccacaggcacctcctataaccctcctctcacccaccccgctacggtctgagagatctgaaataacctttcccagtgggcagggttgccagggttgaggggacagcacataccacccccacccaacctgttcgaggggccctgcatggcacgggatgagtccctgccctgtgcagctgcctggcagtggctgggacaaggatcttgcagccagcacagaggcctcttcaaaggcctctccctcttggcactccaggcaaggcaggtgcccgcttccccaacacctccaggcagtgaccctagggcatgccccagcaggtctccgagcagccactgggacccgtctcagcacatcctggcctttgaaagtctgatatcctgagaggagggcaggttttagggccgcagt

SEQ ID NO: 752 - DNA, 2059 bp, Homo sapiens
tctggccatgtccagctctttcctccagctaggctccagcccatctccaccgccagccccaccccacagctggttctgctgctgtcctggggaaatgtgggcctgcttctcaaggcccgagctggtgtgtagcctaactcaggcaaggaggttctgcctgggagttagtgtgcaggctgctagcaggacgctgggtgccgggtgcaggtagatgaagggtcctgagccctgcctgcgtgggtactcatctgcaaactgctgcaggcatctgctgctctggactcgtgccttagaagttcccaaaactctgatggccacgtgttccctgtttttaagtgagatcctgtcctgggtcttcagcatctggtgccatccagctgacctaggacaagagaacaggtcctgttttggggtgatatctgatacattgatgggccgggaacggagtttttcatccgaagactaaactcagcttcctctctcctaccaggctgtcgagcattgcaaacgccatgtgtggaactaggaggaggaatattccatcttggcagaaaccacagcattggtttttttctacttgtgtgtctgggggaatgaacgcacagatctgtttgactttgttataaaaatagggctcccccacctcccccatttctgtgtcctttattgtagcattgctgtctgcaagggagcccctagcccctggcagacatagctgcttcagtgccccttttctctctgctagatggatgttgatgcactggaggtcttttagcctgcccttgcatggcgcctgctggaggaggagagagctctgctggcatgagccacagtttcttgactggaggccatcaaccctcttggttgaggccttgttctgagccctgacatgtgcttgggcactggtgggcctgggcttctgaggtggcctcctgccctgatcagggaccctccccgctttcctgggcctctcagttgaacaaagcagcaaaacaaaggcagttttatatgaaagattagaagcctggaataatcaggctttttaaatgatgtaattcccactgtaatagcatagggattttggaagcagctgctggtggcttgggacatcagtggggccaagggttctctgtccctggttcaactgtgatttggctttcccgtgtctttcctggtgatgccttgtttggggttctgtgggtttgggtgggaagagggccatctgcctgaatgtaacctgctagctctccgaaggccctgcgggcctggcttgtgtgagcgtgtggacagtggtggccgcgctgtgcctgctcgtgttgcctacatgtccctggctgttgaggcgctgcttcagcctgcacccctcccttgtctcatagatgctccttttgaccttttcaaataaatatggatggcgagctcctaggcctctggcttcctggtagagggcggcatgccgaagggtctgctgggtgtggattggatgctggggtgtgggggttggaagctgtctgtggcccacttgggcacccacgcttctgtccacttctggttgccaggagacagcaagcaaagccagcaggacatgaagttgctattaaatggacttcgtgatttttgttttgcactaaagtttctgtgatttaacaataaaattctgttagccagatctgggcctaatgtttctgtgacccttcagctggaagagtttgttcctctctgatgagctctgagcccatgacacctttggggcccagcactcccatgacccatcttggccagagaatgaaagcaaagtggataaaggaagatcccacctcatcctccccaagactcagggccagcagtaggtcaggcgcacctgaaggtcggctctgctcttcacctgcccctgtccctgctccctagaggccagagtcagagcacgttgccagttccttgagagttgccttgatttttaaacaaaccattccagaaacttgtagtgagtaccagttaaacaaaaccaaggggaaactattgagggaataacttaatttaaaaaaggaacacacacaaa

SEQ ID NO: 753 - DNA, 1099 bp, Homo sapiens
ggccttccccactcccacctcaaacccaggagcagaactcagtatccagagcttacaaggagctgcaagggtttgccgagggctgcccagctctgcttctggtttcctggacaatttctctgtcagatacggcccattgtaaacccagagggctgcattttgggttgagtaatatggacaccatggaagtacaggatctgagtccaacattgccatgggggagggaagagtgtgtcctggcaggaagccaccattggagaaggtgaggccagtaaccatctcatgggattcgctataatcagcctatttgagctgctgggtctctgtcactgtggactccagtcattcaaggaggtctccactcttgggttttttttattttcttttcttttgctattttgcctgaacaccccaacactcttggttttagagtccaagagtaagttgtgcagagacatggttctaatttggagttcaaaggaacaccagctctgaaaacatgaccgtggggccaggatgtttctggcaggcccagaagtgctggccgttcttccccagcctccccactgctccctcctctgttccccatgtggaggtcggaggggctgggactggggagggggcagccacctccatccaaggctcttcctaggggccctgctaatgtggacagtagactttatccctccttcttactctgggccaagacctcccactccgccctctgaggatggtaccaagaatgggcctttgggacttctcaggacattgacaatgtgcacactgcaggttgacttaatttatttattttttgaaaagaagagacagaaaataccttattatctgcagggactcaaagctgtacccaaatcaagaaagacaaaataacaatagaaaccattcacacactccgttcatgcatggacaccagaagacgattcagaacacaagaggagaatgagctggagcgccagcaccacgatggccccaggacgttgtttaagatctgagatcccttggtttctctcttgttgatctgagatgctacatcagggcccttgctgctgtattacctctgcccgggtgtttgagacaggtc

SEQ ID NO: 754 - DNA, 2149 bp, Homo sapiens
tcccctcgggacctgtttataaattgaggaatggatgagggccctggagggtccttgggagtagttagtggagggcaggattctcaggtccccatagagagggaaagagaagaccagatgtgcatagaagccagtctctgtcacatacaccgcaggtggtcaccgagttattttccaaaagctgaggaacataaagcaaatttaggcttttgtccttctgcaatacatgcacttgaaaataaacagaaaagagatgtttaataacaagtttacttccggtctgctagcaccctcagcctgggagctactgccagaggctggcgtagtggggcagctgctgaccaaaccccacagaacagagggcaccaggcatcacacgacatctttccctcccatctctgccatctgtctgtctggcaatggaaggagcttcagcaggaggtccttcccagaaggttgattcttggcctgggtggtagaggagatatcctgaccctaaagtcttccagccccgggtcatcctctcctatactagggcctattgaccgtagaggccaggtgcggtggctcatacctgtaatcccagcagttggggaggccaaggtgggaggattgcttgagcccaagagttggagaccagcctgggcaacatggtgagaccaattgactgtagggcttgtcccttgctaagacaggagcagaagactggatggctgtgtcctcaaggcagtcccctcccatccccattcccaaagtcagaaagtgaagccagatctcaagggctgatacctgaggcaaggagagctaaggggagagaaattggggctgagtggaagcagatgcctgcacaagccaagtgtgtcttattgatctgtacaagctgatagaaggaccatctgctgaaatccagggctcctgagttggtgggtttgcttgtgaagcttctaggacaaggcgcagccagatggaagggagagggtccagggcttcctaaatgcagccgcatcacctgtcaactcgctgcagtttcagagacagtggaagctgctctttacctcaaaagcacaaagcagaattggcaacttcacttgtctcaagagctccaagatcctttggtctcgtgtcctttggcaccccgtaactggactggggacaaatttgttacgtgtttccaaggctacagacatggcgccatcctcacaggcctagctcatgtcatggatcaggtgctttgctggggggatacaatgacccatgtggtctgcgtcttctgccattggcttgaactgggcaccccctgaagtctccatctcagctgtatattctagtccaaattttcctggctcccctgctccctcccaggtcctgcacactgtctttttgccaacacctcagccctgtttgctatttcatgtctgcatggtacgagacaccccttcacggcatacactgccatggtatgtacatatgcatccacgtgtgtgtatgtgtagcatgtagctcattctgctcagcctctggcgccgttccacattgctcccagccccattgctgtcactgtcgtcccagatgtccttgccatggccacagacaatctgccgtctcctggaaacgctggggctgcccttcagagagctggcagccccagcagtcagggcctgctttgcagaatagaatgtgaacccaactcctgatggcctacttgacttatttaattaaagatgaaatcatgcaatgagcaaaacctgcagcgtgtctctgccttttcctttgcatttgttctcagcagcaattgggtcataatttttttttttttttaattaacagtggtagaaaggaggtgacttccagcatgaagcaggacagagaatccccctgcccattcccaagggaccaaaggcactaggggaatatggggcaggatgaatgtaccttgcgtcaccaggctggcagagctgatggggactgcgctgagcggagagagagaaaacccaggtatttgggggcagagacaggagtgttgggccagcggtcagggggcctggggatgagtcccagctttgccactgtctggctgtgtgaccttgcataagtcacttcccttacttggacaccagtttccttttagaatgaaggtgtaatcagttgt

SEQ ID NO: 755 - DNA, 1192 bp, Homo sapiens
aagtaggatgtcagtcaaaactgaaaggtattagaaaattatttgaaaggttatggttaattttaatttgagaggggtaaggggggaaaggagctgtcatatcaaaaaaaaaaaaaaaagcaaaaactaatttgtagaagaaagaagcaaccaactccagaatataagacaaggacactgaaaaggtattatctaatagaattccagtctgtagcatgatcttgcttataagctgggattcacgtgcttagcaaataaccaataaaattgttacattttggcccggcacgatggctcatgcctgtaatcccagcactttaagaggccaaggcaggcagataacctgaggtcaggagtttgagaccagcctggtcaacatggcaataccccgtctctactaaaaatacaaaattagccgaatgtagaggcccatgcctataatcccagctacttgggaggctgaggcaggagaatcacttgaacccaggaggcagaggttgcagtgagccgagatcatgccattgcactccagtctcatgccattgcactccagggcgacaagagcgaaactctgtctcaaaaaaaaaaaaaaaaattgttacgttttaagaagcacgagtgtcaattatctaaaggtaaattaggtatgattcagaggataacagtaactgatttatatttcagtcttcaagaaaaaatattgaggttaaactagatttgttcaatcagaaagaaaaagagagatataaagaactatgttaattattctcatctgtcaataagaatagagacaaggccgggtgcagtggctcacatctgtaatcccagcactttgggaggatgaggcaggcggatcacctgaggtcaggagttcgaaaccagcctggccaacatggcgaatccccgtttctattaaaaatacagaaaattaggccgggagtggtggctcatgcctataatcccagcactttgggaggaagagtgggtggatcacctgaggtcaggagtatgagactaggctgaccaagatggcaaaaccccatctatactaaaaatacagaaatcagccgggtgtggtggcatgtccctgtaatcccagctgcttgggaagctgaggcatgagaattgcttgagcccgggaggcggaagttgcagtgagccaagattgcaccattgtactccagtctgggca

SEQ ID NO: 756 - DNA, 1197 bp, Homo sapiens
actagccagttttctcaccttttgtttctattttaggcagaaatggaccttaagagactgagagacccattacaagtacatctgcctctccgacaaattggtgaaaaagattgatctgcaaaaagcctctgaatcctggcagaaggaacacctgtttgcctttttaattaaagcattgcaggtggaagctgggagccatgtggggggtagagcgtttttacctttaattataaaacaaaaacagaaaggatctgagggaagaagggaatgttaaaacctgaggatcaggcattgtggaatataagctcaaagggcttagtgaatattgtcttaaccaagtatctcagtttctggatgaaaatgatgcagttatatagttgagagattcataaagagaaaacaatgctgggggtgttcgtttcttgcatcttctttgcagagtcagcaaaagagtaacacaccagcaccccactcgactctatttgtttttaatttaactgtccctatttttgacataggagtaaataaatatactagaaaagcaaattctcatgatatgctaaaatatcattagcatttattttaaattggacccagtctctgcagagttaccaggaatctttccttccagcatccctttactgaccacctacctgtacctcttggttacactcattttttccatttgataattggaaccaacttataactgtttaataattgacactttagattatctcttaataccttcttaaatgtctatatatcccagtgctctggatcagtgtctaaaaatcactggcaacactgcatgaggttgttggttttgttttgttttattaattagtctttcacaggaggaataattgccctcctttatatacttatctattgataatcccctctccctccagaacacaaatcagagggaaagggggtgttcagctgtactaccaaatcaggaagatgtaaggtttacaaattggctaagaatcatggctctgtagccatttcaaccagaataattttattgctaatctgctttgtgtgacagcattccaggccagccagatgggactgccttgtctggaggctttgttcatctcgaaggacacacacttccacactgtttgtgagccctcccacctccacaacttcagttgtaaatcaagtgtgtggatctcaaagggtgcaatt

SEQ ID NO: 757 - DNA, 1165 bp, Homo sapiens
cttactaaaaataatcagtgctatctttcccacgttcttttcttatttctgcaactatggagaaaatagtccatgaaaagttcaagtaaggtaatattaaaagtgctctgaaacagtgctagtcagtgtggcttatagatgagctgccgtggggtttcttgtccacaaaggcatttacatcaaaataaaaataaactacatcagtaagtacctccttcatttaattcagttgactttttgtagcaagtctttctagatgaagaaagcagtgttatttacattatagtataaacttctaatctcagtgtaaaccagaacttttcagtagtgttgctcatttccctcccttgaacgggagggaatagagcagaacttatttccagcattctaactcatctgggggcttcttgaaagagtgtgtttcacttaacagagggctcacatggggaaaggcagcatgtctgggaaaagctgcacaacttgaagctgtcaccccaggctgctcccaaggctcagaacacgcctgctaattagtgaaggaaggttgtcctcatcatgaaaccagtctgcaaaaactgggagagatgatttttttttttaattcccatttttccagcagaaaaccacaaggcaaaaacaggaaaacacccattcaaagggagaaaaggtgacagaaactgtctctgaagaaacacagttattaaatacttagaacacctgtcttaagtatgctgaacaagctaaaagaaaacatggacatagaaccagaagtagtcaggaaaatatatgaacaaaatgagaatatcaacaaagagatagaaaaggagcaaaacgaattctggagctgaaatgtacaatacctgagttgaaaaattcacttcaacatcaggctagaattcagattgttccaacattaagatgtaatcctcataactgcaaagaaaatatgtatagaatatagacaaaaggaaaagggtatcaaaaatacgttactaaaaaaaaaaaaaaagggggtagggggagccagtaatgaggccaaaaaaaaaaaaaaaaaagaagctgccaggggcagcagcttacacctgatatcaacactttgggaagctgaggcaggaagattgcttgagaccaggaattcgagactagcctgggcaacatagatgcc

SEQ ID NO: 758 - DNA, 1264 bp, Homo sapiens
tttaggtttagacgtagcttatgaatgaggctagtcttttcctaaaataatcagatgaagaattcagtctgcatagcaggaacgttggaagttaatttaaaaaacattttaaagggatttttagaatcaagtttctatggagaaaatcggtatcctaagacgatatattcaagaagctgaaagtgaacaacctcaactatattttgtcttcatgtgaaatgtgaatacacaccccgtgatttttttttttttttttttttttttttagcttgtgagcgtaatttaagaatctgaaatgtgaacttcaaattttacttttttctttatgtgggaaaagagactttatcacttacctttaataaaattcatagtcagttttggttttgggacattgtgccttaagtcctgccattgtttttgatagctgatgacaaatgtttcttagatttacatagactaactaggaaaaggactatttctgtctcttttaaatgggtagtgctgtttttattgacattttgaaatgagttttattttgaagtactgaaaatcaggactttggtaggcggataattacattggccattttgtgttttggtaacttagatggtaaaacagttgaaaaatgtgtacaacttttaattatgccaaaaaaattagtgcaaaagactattgaaaaaaagttttatattgccttgtagtctgggttgttgcagatgaatcttggctttttggcaaggagctgttaaccttttctattagtgcagaataagttgtatactgaaaagcagtgtttttcagtagggcaattaagttcaaacggcatttattccagagatgcagcaagagctgggacagccataaagcttgtgagccttcctttctgtggaaggaatgctttattttacttagcaaccagttatcaactaggatataattattgctcttgaattgacctgtgagatacataatagtggttctcaaactattttaaggtcatgaaatcctttgagaatctgatgaaaggtgtggtcctatgtcagaaaatgcaaatacaccctacatggaattttgtatgtcacttcctgcccccccactcaagtccattcatgaactttattataagaacccctaaaaagtaagagatgtgaagttactctctaagggtatctaggtgtcttgaggcagtattgaatgtttctgaaaatcgagctgggcatgtaagtctgactggacttgtatatgtgggtgaccctaatacatt

SEQ ID NO: 759 - DNA, 1343 bp, Homo sapiens
ggggtttcaccatgttatccaggatggttttgatctcctgacctcgtgatccgcccgccttggcctcccaaaagtgctgggattataggcgtgagccaccgcccgggcaaatttttgtatttttagtagagatggggtttcaccgtgttggccaggatggtctcaatctgaccttgtgatctgcccacctcggcctcccaaagtgctaggattactggcgtgagccaccactcctagccttaatgcatattcttaaatatacaaaggtagatttgttatgaaaattgctttggggctctaataacctaccttttaagaatgagaaactgctgggcttaagggagttcagtatgaatcaagattgaaccattcaaatgtggctgtgatttctgcatatatcatagatgggatccttctgagaatactggaatagggaattaggacaccaagccaattcagctgtgaaccttattcttgtacttttctttcttgctggtaattttatggagcaggttaagaaggctgctctgtgttaggataaactgtataccaataatgttgacaacctgtaatgagtgttgcattttacttcttgtatcttttccttcctaccttgatgccagtaatctataagggatctttatagtttgaatgtatttgaataacttcagtatactttagttctacttttttatttgactcacaaccattcttaggtctcaagtattcccatgtgttttaaaagcctgaagtcagtgagatgaaattcaacatcaagaatttgaagtaacttgtaaggaaaaataatataaagataccattggggcagtggctcacacctgtaatctcagcactttgggaggctgaggtggaaggatcacttgaagccagagtttgagaccagcctgtgcaacacagcaagaccccgtctctacaaaaacttaaaaaattagctggctgtggtgttgctcacccatagttccagctactcgggaagctgaggcagtaagatcacttgagcccaggaggccgatgctgcagtgaactgtgattgttccactacagtccagcctgggtgacagagaaaagaaaaagaaaacattacataatttggctagagcataataatttgattttctggtttttgaaaatttgagttgcaataaaaggatatttcagtgtgcgatttcaattttccgtagcaaatgtatatatagaaaaatgttaaaatagatgtatttgaataccttaaaaaatacaagaaactggaagaaagataatattgcaaagcatctacatatatcctaggccttttgtgtacaaggttatttgtgacaattgta

SEQ ID NO: 760 - DNA, 1176 bp, Homo sapiens
gtgttcatcacagtagaggtcagggtacaaagtaccagtgcattgaaggttgtccactaggtcagttcaggaaaaatgtaaaaacagattttaaatacatggtacaaaaataaaaaggtataaaagcatatatggtgaaaaccaagtctgtcttctaccagcccttcagattcagtttccctcctaagaggtactcatttttccaatttttaaaaatcagccgaggccaggcgtggtggctcatgcctgtaatcccagcactttgggaggccaaggatggtggatcacctgaggtcaggagttcgagaccagcctggccaacatggcaaaaatataaaaattagccaggcatggtggggggtgcttgtagtcctagctactcgggaggctgaggcaggagaatcgcttgaatccgggtggcagaggttgcagtgagctgagattgagccactgcactccagcctgggtaacagagcaagactctgtctcaaaaacaaaacaaaacaaacaaaaaaacccagccgaatttatagtaagtttcattcaatttatcgttcataaattcctaagcaattctgatcaggctgccattcttttttggaaaaggtggactctcctgcctagcatttgttctcatgtactttcaattcatttaatggcaaattgttcttttcctaggagagttggcttcctttcttctgacttctgtatcattcattgattcattcttttaaataaatgcttattgattctgtacaagattcctagcacaaaaataaacaaataaataagtgcttattgagtgtgttctaggtattgtgctaggtgctggagctacaatggtgagttagatatagtccctgcttttatggagcttacagtctacagtgagggacggataaataaacaaacagttataatgtgttaaggatttgatcctatgggaacataatagaagggatatttaaatcaggcttgaggtatcatggaaggcttcctggaggaagcaaaaagaatatagcaagtaaaagggacctgagcaaatattaactgaattaaaagaagcttatttagtatggcaggattagaaagtctggcaaggggagatgatggagagtgttgacaagagaggatacaaagaatattatggaccacagacagccctgtatgtcacag

SEQ ID NO: 761 - DNA, 1220 bp, Homo sapiens
agcgggatgcctgggtccaagccatccagagccagatcctggccagcctgcagtcatgcgagagcagtaaaagcaagtcccagctgaccagccagagcgaggccatggccctgcagtcgatccaaaacatgcgtgggaacgcccactgtgtggactatgagacccagaatcctaagtgggccagtttgaacttgggagtcctcatgtgtattgaatgctcaggaatccaccgcagtcttggcacccgcctttcccgtgtgcgatctctggagctggatgactggccagttgagctcaggaaggttatgtcatctattggcaatgacctagccaacagcatctgggaagggagcagccaggggcagacaaaaccctcagtaaagtccacgagggaagagaaggaacggtggatccgttccaaatatgaggagaagctctttctggccccactaccctgcactgagctgtccctgggccagcacctgctgcgggccaccgctgatgaggacctgcagacagccatcctgctgctggcacatggctcccgtgaggaggtgaacgagacctgtggggagggagacggctgcacggcgctccatctggcctgccgcaaggggaatgtggtcctggcacagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcataaactaagtaaatacacaaaatgttgatttttctgaccataagacatattttatgtccttttgccaaggtggatgtgttagtctcaggccctcctggccacattgcccaagtcacacaggcttctgtattatgtatttagataaaatgtgtgaaaatatatttgaaaaaaaagttcataaatatgcattgatttttgtacacatggcacctctttttcatttttatttttattttttttttggacgatgttttgctctgttgccccagctggagtgcagtggcatgatatctgctcactgcaagctctgcctcccggattcaca

SEQ ID NO: 762 - DNA, 1204 bp, Homo sapiens
tgtgaagtgtggggtggggcattctgtgccacatgcctgggctcccacctggggccagtgggcttcagtctgtaggtgactacagaaggaggaggagctccgtctgttctctcttcaggcagttgttgtgtctctcagcgcttgttgggttcacaacctattaaataagccagctggtcttcaccctcccagacaagtcaactcaggggaggcagcagggtgtgggccttgacccgcagccctagccggggccggggccggggccagggatggtgcccggggccgcgctgtgaggtgggcaggcgaggagcgggaagaccatctctgcaagtgcagcatagcctcggcctaggacagtgggagtgtgtggccaaagctgtgagcagaggcacaggtggtggcagacagtagaggcgccccatggggaacatactgacctgttgtgtgcaccctagcgtcagcctcgagtttgaccagcaacaggggtcggtgtgtccctctgaatctgagatctatgaggcaggagctggggacaggatggcaggagcgcccatggctgctgctgtgcagcctgctgaggtgaccgttgaagttggtgaggacctccacatgcaccacattcgtgaccaggagatgcctgaaggtaaggaggtgataggtgccatctaccctcggtttgcctctggctgctgctgtccccaaggttccctttacggcatcccccactttgagctcctttctgcttgtagccagctttcccgggggctggccaggaacaaaagctggctctgccttgaattcccaccccttagtctttcctcaccgagtccagtcagtttcttttcgcctcccctcccaatcgcccagttcttgctctctcatctcattctcccaggctggcatgggaccatttatttatggctcttgtcaaataagcagcagttgaataaatgagttgataaatttttataaatgattacatcttttttcttttctccctctatacatatagctttggagtttagcctttctgccaatccagaggcaagcacaatattccagaggaactctcaaacagatggtgagacaacagtgtctgtagctctgtttattatcctgtgggactttgtttaggcttctttgagctattctcttccttttctcaataaaaactcaaatatcccaacttttcagtacccatctt

SEQ ID NO: 763 - DNA, 1191 bp, Homo sapiens
aaggatagtctcgatttcttgacttcgtgatccgcccgccttggcctcccaaagtgctgggattacaggtgtcagccaccgcacccggcctcaaatacatttttttaatggccttgtctttcctggttttaggcccttttccacaatttctgatggaaatacagaaaccttgccatcattcttactgctggtttgcatctcatttatggtgtatctgggatttcttctcatgaacagaaagattcagtggctgttatatgccttgtcaatttaatgtattgccctatcctctttttgatcaaagatagagactaagactgggaattatgacagaaaaagtcatatttttctttaaatgattttgaaatgttaaaataggccaatatgagtcaaagtgcaaattttttggtgagtaggttgacaaaaaaaaaaaaaaatccaggaaaaaaagtgcaaatttttataggtcctaattcttttgtttgcctaatgaagtgttccctctattttattgtttttatatgctacaaagtcccatcttctgcagttatggaaacagtgtggctgtatgttttagtaattatttcataatctgtagcacttttcactttaagtgcaatgaatagtccagcttcattcactgtattactaatacgcttccctatgactttttttttttttttgagatggagtttcgctcttgttgcccaggctggagtgcagtggcgcgatctcagcttactagaatctctgcattcccagttcaagtgattctcctgcctcagcctccctagtagtggggattacaggcgcccgtcaccacatctagctaatttttgtatttttagtagagatggggtttcaccatgttggccagtctggtgtcgaactcctgagctcaggtgattcacttgccttggcctcccaaagtcctgggattacaggcgtgagccaccgtgcccaggtgcccccaccttttttttttttttgaggcagagtctcactccatcaccaaggctagagtgcagtggcgtgattttggctcactgcagcctctgcctcccaggttcaagcaattctcgtgtctcagcctccagagtggtgggattacaggcacgcactaccatgcctggctaatttttttgtatttgttttagtagaaacagggttttgccatgttggccaggctgg

SEQ ID NO: 764 - DNA, 1188 bp, Homo sapiens
ccgatccggatcccgagcgcgcgagggcggaagtggtggtggcccgcgcggccggaagtccagatcagctgatgggggaggcggctccgcagccgcctagaggccccagccgccgagcgcttcgtcccggccctaagtctcggagactggccaagatcaccgcttgcaccgcgctgttgggcgaggcccggtcccgtctctttcccaggcctgagattctcgcccggcacggccgccctgagcgccccggccacccccagccccggctcgcccctcaggccccgggcctcccctcaacccccggccggcggcccaggccccggatccgcggggggggacccggccccggggggtgcgggccccatggagctgatgtttgcagagtgggaggacggagagcgcttctcattcgaggattcggaccgttttgaggaggattcactctgttccttcatctccgaggccgagagcctctgccagaactggcggggatggcgcaaacagtcagcggggcccaattcccccactggcggcggtggcggaggtggcagtggcggtaccagaatgcgaggtgagagtgagctggggggaagaggagcggcaggccctgcttgggcctcgctcgggagctgtccgggaccaggagctgtccccgaccaagagctctcttcaaccaggggaagaaaggggagctgtccccggccgggagctgtccccgactgggagctgtcccaagcttagaacagacttcagaactcgcttttccggccttcctggggtgggctggcttctccacacctgtgtgtgtgtgggtgtgtgtgtgtgtgtgtgcgcgcgcgcgcgtgcgcgcgctgtgacagggagatcctgtggacagaaagtaaatctttcgtcactcctttgccttagagaggggataagggagaagaatcttgtctttgacttgggaatacttaagtgagttcagtctgaggcataccggaaagtagaggaagagaatgtgggtagggggctgattgtgaagaagtgaccacttgtggcttgtcaccgcattgcaaagtgcattgggagcttcttgcttcggggtgatgatctctgatcccagaagcaccaagaagggatcctacccagaggaaaatagaggtgaactggcctgccagagagtccatagttcataggtttagatca

SEQ ID NO: 765 - DNA, 1216 bp, Homo sapiens
ttctggggcatctgggcagggaggttgggcatgggaaagctaagggcccagctcttgattcccgtatcctggagtttacagatgattgttggtcctctcatggcaacattttacccattaatgtgctttcacacccatctttcctttaccttacaactcaaaggttaggtttatttctattttacagataaggaaatggaggcctacggtttagggaccaagatgatcactcaggatagaaaacttagggaaggcctcatacatctaagacttgaatgggagggggctgttaaattagtttggaactgggactataacctgggtcttgactcattttggtcagtatttactcagtgtgtgaagcactcactgctctgataatggactctaagcattgacactgacctctgatgattccctgggaatgagacagctctgagggagacattggaatctcatctaacaccttccatgtggtaaaggcctttcccccttaacactctgtgcccctctcttccaggacaacctgatgttggagaaggcctgcatggcagtggaagaggcagctaagggtgggggcgtgtaccctgaagtgttgtttgaggttgctcaccagtggttctggctgtatgagcaaactgcaggtggctcatccacagcccgtgaaggggctacaagctgtagtgccagtgggatcagggcaggtggggaagctgggcggggtatgcctgagggtagagggggcccagggactgagccggttacagtggcagcggcagcagtgacagcagcagccacagtggtgcccgtcatatcggtggggtctagtttatacccgggtccaggactggggcatggccactcccctggcctgcacccctacactgctctacagccccacctgccctgtagccctcagtatctcactcacccagctcaccctgcccaccccatgcctcacatgccccggcctgccgtcttccctgtgcccagctctgcatacccacaggtgagaccagtgttctgctggggggtaaggcatgggaaaatactgggaattcatagggggttggagtgggtactctgggagtataattggtcagtcggagagtcctggtgaggtggtgggagtctgggggacccagcccaactaaaataagaaatgacggccgggcatggtggctcatgcctgtaatcccagcactttgagaggccg

SEQ ID NO: 766 - DNA, 1223 bp, Homo sapiens
agaccctgtcaagcttctcactgggcccttggaaaggagctatatgccagaccttatgcaaaactcttgacctgtaccacctcagttaaacctcagatcttgctgtctctattttagaagtgaggaacctcttggccgggtgccgtggctcacgcctgtaatcccagcactttgggaggccgaggcaggcggatcataaggtcaggagatcgagaccatcctggctaacacagtgaaaccccgtctctactgaaaaatacaaaaaaattagccgggcatggtgatgggcgcctgcagtcccagctactcgggaggctgaggcaggagaagggcgtgaacctgggaggcggagcttgcagtgagccgagatcatgccactgcactccagcctgggcaacagagtaagactccatctcaaaaaaaagcaaaaaaaacaaacaaaagaagtgaggaacctctttcccaagataatgtgcctggctcactgtctcacctactttgggtcctaatcaaatgtcacctccttactgaggctttcttggactgccctactcaaatctgcactccccactttctctgctttttctacgcagcacttgccgtgacatctaacgtgctgttgagttttcttactgtccatccctcccccatacacaacccactagagtgtcagctccatgagggcagggatttttgtctgttttgttcgccactgtcttcctagcatcttgaatactgtctgtcacatagtaggcctcagtaaatatttcttttttttttttgacttgctctgtcaccccaagctggagtgtagtggcccaatcttggctcactgcagcctccacctcctgggttctagtgagcacatttggctaaattttgtatttttagtagagatggggttttgccatgttggccaggctggtcttgaactcctgacctcaagtgatccacccaccttggcctcccaaagtactggactgggattacaggcgtgacccaccgcgcccagccacgataaatatttcttgaaggaatgaatgaagctcgggtgggtttaatagcttgctggatgtggcagtgttgggctcaatccagggctgtctgacttcaaaaccgatgtgttgttaattgccatactccacagcttagaatcagaatgaggatcaaggtatagtcctggggttcagagaagacctgggccttgccgggaacacagggct

SEQ ID NO: 767 - DNA, 1244 bp, Homo sapiens
tccccagtagctgggattacaggcccctgccaccatgcctggctaatttttgtacttttggtagagatagagtttcaccatgttggccaggctgatctcgaaatcctgacctaaagtaatccacctgccttggcctcccaaagtgctgggattacacgtgtgagccaccatgcgcggccctctttatgtacttttaatagaacaacacataaatgtaaaaagcagaatgcagcgagtgaccatatatgatcctatttgtgtaaaaaagtggggaaatgtacatttttgcttctttgaggcctgaaatgttttatgaagacatttacatacagaggaaatacaacattggaggaaactcagtattggttgcaagtgggatggaatgagtgcatggaagatagtgaagggaaagagatttctcattgtatgcccttttggttttaaatatgtgtatatgcttgtgtaatatgtatgaatatatattatatatttaaaataaaattaaaaagaacaaaatatccagtcctttaagcctgatcaaaagccacatcaaacaggtcttgcccttcactgatatttattatatactgccttatgtttttttttttgtttgtttgttcgtttgttttggagacagagtctaactctgtcacccaggctggagtgcagtggcatgatctcggctcactgcaacctccacctctgattctcctgcctctgagtagctgggattacagatgtccaccactatgcctggctaatttttgtatttttagtagagacgggctttcactatgttggccaggctggtctcgaactcccaacctcaagtgatctgcccaccttggcctctcaaagtgctgggattacaggcatgagccaactgcgcccggccatgtattggcttattctgccaatgtttgtgtcttgccttagtaaagtatgctcctcgagagttagaatagtgctttttacatctttatatacatacctacagtgtccacagcccagtgctttttatgtagttgaaattcataagttggtttaattctacttgttaacaatgtaatactgctttaaacttgtggagtttctgtattacttcatttatcctcaaaagaacctggtgagataggcttttatttgcaggtgacattttctatgttttcaaatgagactgtataattctggctaagcattttaactttaagcagtttgttccttatctttgtaagttagtcagt

SEQ ID NO: 768 - DNA, 1150 bp, Homo sapiens
taataaaattttccatgaatgtgggatgtttttccatttatttggatcatctttaatttgttgcaacaatgttttgtagttttcagagtataaattttacactgtaaagaaaacttattcccaaatattattttctttttgatgctattgtaagtggaattcttttcttaattttatgttcagattattcattgcagatggcttagagatacaattgtgtgtggtttttgttgttttgtttttgagacaggctcatgctctgttgcccaggctgaagtgcagtggcacaaacatggctcactgcagccacaatctcctaggcccacctgattctcctccctcagcctcccaagtagctgagaccactagacatgcaccaccatgcctggctaatttttaattttttttgtagagacagagtcttgccatgttgcccaggctggtctcgaactcttgggctcaagcaatcctctggccttagcctcccaaagttttgggattataggcatgagccgctgtgcctagctcagtttgtgtgtgtgtgtgtgtgtgtgtgtgtgtgtgtgtgttttaatattgatcttgtatcctacagcctttctgaacttacttagctctaatattttttagtgggttctttatgattttctataaacaaaaccatgtcatctgtgactatagttgtgtttccttctttctttctaatttggaagcctttaactattttcccccttccttaattgctgtgactagtagttgtaatgtaacagtgaacagaagtggcaagaagagatgtccctagtcttgtttctcatatagggggaaaatatctaatcattcaccattaagtttgatgtttctctgcagttttcttagatgccctttatcagattgaggaagttactttctatttctgtttttttttagcgtttttatcttgaaacagtacagttgacccttgcacaacatggcgattgtgggtgctgacccactgcatagtctaaaatccatgtataacttttgattctcccaaaacttgtcaattaatagcctactgttaaccagaagccttaccagtaacataaagtcaattaccacatattttatatatgtatcatataaagaatatattattaagaaaatcatgaga

SEQ ID NO: 769 - DNA, 1335 bp, Homo sapiens
ctgcttttgaatctcttaaggatggatgtttgtaagatgttgcttaatacagtctggaatactctgtccatttgttgaattgtaaatgactttcaaatgtgcaagttctgttaaatacaaagagaacctctatgggtaacttttgtgttgaagaagtcatttgtcaaccatggtaaaacttgcaaacccactttatacagagtggattcttgaagctatacagaaaataaaaaagcaaaagcaaaggccctctgaagagagaatctgccatgcggtcagtacttcccatgggttggataagaagacagtctctgaacagctggaactcagtgttcaggatggctcagttctcaaagtcaccaacaaaggccttgcctcctataaggacccagacaaccctgggcgcttttcatcagttaaaccaggcacttttcctaagtcagccaaggggtctagaggatcatgtaatgatctccgcaatgtggattggaataaacttttaaggagagcaattgaaggacttgaggagccgaatggctcctccctgaagaacatagagaagtatctcagaagtcaaagtgatctcacaagcaccaccaacaacccagcctttcagcagcggctgcgactgggggccaaacgcgctgtgaataatgggaggttactgaaagacggaccgcagtacagggtcaattatgggagcttagatggcaaaggggcacctcagtatcccagtgcattcccatcctcgctcccacctgtcagccttctaccccatgagaaagaccaggtaagcgaaggagtaatgttcgtgcattctcactactgtccttttgtcttttacggtttcacttaagttttatgtggacaaaagttctgaataaagtttgataaaattgaatgttttgccttagagcaggcttttgtattttaaaatgtatatattgtactgcattgtgtggaggacttcctcactggttggccaagaatttaatggaagagtcatgtggtttgtttttaagctctaattgctaactggttggtgtctgaagggaccaggaaggataatattgatctttcttcatccaggcagggtcatatatatttcagaaatctacgaaaaggccatcgtatatttttctctttattactattttcaaagaagaatctacagacttcttattttactattattatttttttgagacagaatctagctctgtcgcctaggctggagtgcagtggcgcagtcttgactcactgcaacctctgcctcccaggtttaagcgattctcctgcctcagcctcccaagtagctgggattacaggcacctg

SEQ ID NO: 770 - DNA, 1190 bp, Homo sapiens
aagtgctgggattacagacgtgagcctccgctcccggccttagcacaaggattaaatgagatgtttatatggcgtttggcatagacactgtcaaagagtaaatgggcaataaattataacaatgatcattgggggctggctattggagaagagctggctctctccagaggaattcggattacctccttctaggccctaaccccatttactgatcccacaggccccgccccggctccgctagccccgcttcctcctgtcgctttggcctccggcatgacgcatgcgccctcgggctcctccgcggcagcatctcggttctcctctcgggcccatctggagcctcgcgtcttttccagtgtgggccccgccccctgccggtagaaccccgtccccggccggtagggccccgcctcccgaagcagttccggttcggctccgagcagctgccggcgcggcggtgacggcggccgggacgatgcctgcgcgcagtcgccaccgcccccgcctccactccggctccccgccccgggctccgcccccgccgcttgaggcgcttcactccggcgaggcggggagggccccggactccgacggcggctcggacgccgactcggaggtgggtccggggagcccgactcggaccgcggaggtgagcgggagctgaggctgaggagaggggagcttggggggcgcctgctgccaagggtgagtggggagtctgggatggagccgggggctgccgagggaccgcgacctggaggggccccggggagacggttgagggaaccgggatagtcagctctggaatggaatctgaagcaaatggaggttgtcgaactgagggcctgaaggctgagggataagtggaggccgaggaacgagagggagagagcgagagggggaggcttgaagagcccagagcttgggggcttttgaaagctgcgcagtgggggaaaaagatcgaaggtcctgcgggaatgtggacccggaagaagagatgctctgggtttggcagcggggatgaggagtcagaggagcaagacctgggccggtgttcccttcccagggcgagggagggcgatcggggctgggactggagccctctcatggggttctcctcttacggagccctcttatccgcctcccaccccgggtggggctggtggtgatggagggcaggatttaggttt

SEQ ID NO: 771 - DNA, 1133 bp, Homo sapiens
tttcaaaaccagcaataatgaaaagactaattggatgaatactatctttctaatgaatttgtgattaaatatataatagttgttgaaaatgagtaactttgcgttctccccctaggttgttcttagatgcctggcttatgtgttgacaaagtaaagttttctgttctgagcaaagttatgattataaaaagcaagaaagaacaatcaagagtccttatgtagctatttgaacagaaagcttaagtagatgttttctgccccttctctttaggaagacttaatgttgtgattgaagtcaggctgtacccttacctgttgagtatttgcttattgaactttaaacaagtcaacttgagcagtttgctggttgaggaattttcattgatttccagtagggctctagtcaagaaataatatgttttgaagctccttattacctttagaagaagaaaccctaacaagtgacagtacttgttctttggactaatctttgtttcattttaaaaaatgcaaccctgggacatgatctgttttactgacaaagagtttttgccttctgaaccatctttaaatatactgagcataccaggatgcctgaaataagaagagaatgaaagaggccatagatgacgtgacagagtactggctaggatgccattggtctcctcattaatgcaaatgtagggctggcatatttcaccaaagatgcaacaaaagatgcagtgccagtgtgaccctcagtgagtattcatgagggaaaaatggctgcatccataaaaataaatgggcttaatgttagtggtataggtacccagaataacttctttgtgctatagttgttagatgacagttcaattttatgcttttttaatggtgttattaaatgagccaaataggagtgttttaccagatgttagataaagttcttaatgccgttaagtagggaggtatgcatgcaaagaattgttttctcctgaaaagaaacttacagcacgcaaaatataactttttggtttttgaaatttatcattcttggctgttggaagtaaacagtctcagacatacttggatatgaaaaagtttcgttgttttttacttttaaatataatggtgtatatacattctttctattt

SEQ ID NO: 772 - DNA, 1096 bp, Homo sapiens
gcagcttgggacccctgtgtcatttaatgactcctgggaattagtttggaaatgtacctagcctttcccacttcagtaatgttagctgccactccaattcagcagtacccagaagcattgcttaatgctccttgtgatattaggaagtatatatttggttctccttccctctcctggcatagaactcctaaaaaatccttggaatcccgaaagtattaagtatctttttgtatgctaatgagttttgactggtggctggccacctttaggtagcttcgggctggaggctagtcagtggagagaccaaggtgtgattagagggggtggggagaggggctgtaggtttaattgttcaccaatggctagtggtttaatcagtcatgcctgtataatgaagcctcatgaaaacccacaaggacagaggtcagtgagctaggtagctgaggttactggaaggtggcatgtctggagagggcattgaagctgtgtcccttcctatgttttgcactgtacatctcttcatctgtatcctttgtaatatcctttattaaaactggtaaatgtaaataaagtgtttcttgagttctgtgacctgctctaggagattaattgaacccaagaaggggcttgtgggaacctctgtttagaggtgccaggtcagaagcagagttaaaacaacctggggcttgcagttggcatctgaagtgggaggagggcagtcttgtgggactaagcccttaacctgtggcatctgatgtctccaggtagaattagaggacatttagccagtgtctgctgcagaaattattgcttgcttggtgtgtgaggaaagccctcacacatgtggtcacagaagcattctgtgttgtgagagaatagtaggagaaactgagttggtttttttctgtatcctcagaattgatgtcaggattgggatttgctagagtggctctagctagagtggctcatcgaagcatggtttaggaagaaaaaggataaatggatgggaaatgaggaacttttgactcctgggtggtcagatggtcacccctgctatggagccacaactgtgctgtgctcaggtacttaaaaatta

SEQ ID NO: 773 - DNA, 1200 bp, Homo sapiens
aggcggtgccccccatggcgaggccggcgagagcagtgcctgcttccccccgaggacagccgcctgtggcagtatcttctgagccgctccatgcgggagcacccggcgctgcgaagcctgaggctggtcagcagggcgcgggacggaaacgggcgtccctctcgacccctgcgggtcccacgtggctgtgtgaccttgggctgggccctggccctccctgggcttccggcttccctgggccgggtgcggtgggcgttccgaagggccagtcccccaggccacgcccagaaccgcgcccctggggcttgggacccccagggcgaaggtgggtgacctgcatggctggtgccaccctctcctttcacgcagctgaccctggagcagccgcagggggattctatgatgacctgcgagcaggcccagctcttggccaacctggcgcggctcatccaggccaagaaggcgctggacctgggtaggggcacgcggccgggatcccggagggccgaggtttccgggccgacccccactctgggctgagcccgtctgtgtcctggtcccaggcaccttcacgggctactccgccctggccctggccctggcgctgcccgcggacgggcgcgtggtgacctgcgaggtggacgcgcagcccccggagctgggacggcccctgtggaggcaggtgagcgcccgcgcctagctctgcagccccaggcgggggcgcaacggctgacccgctccctccgcaggccgaggcggagcacaagatcgacctccggctgaagcccgccttggagaccctgggtgagcaccgaagcgggaagggctttgaagccattcattgcaaacgaggctgctgtgtggccgagctgtgactgggcctgccgggcaggttaagggcagggccggttgtcacagagcccgggccggcctgggaggggcctcagggccgccggggccgcggactcagccgcacctgccctccctccccccgcaagacgagctgctggcggcgggcgaggccggcaccttcgacgtggccgtggtggatgcggacaaggagaactgctccgcctactacgagcgctgcctgcagctgctgcgacccggaggcatcctcgccgtcctcagagtaagggatccactgcgggggaggagaaagcaccctgtcgggccgggtccccatcttttcccttgact

SEQ ID NO: 774 - DNA, 1157 bp, Homo sapiens
gtcacccaccttcgccctgggggtcccaagccccaggggcgcggttctgggcgtggcctgggggactggcccttcggaacgcccaccgcacccggcccagggaagccggaagcccagggagggccagggcccagcccaaggtcacacagccacgtgggacccgcaggggtcgagagggacgcccgtttccgtcccgcgccctgctgaccagcctcaggcttcgcagcgccgggtgctcccgcatggagcggctcagaagatactgccacaggcggctgtcctcggggggaagcaggcactgctctcgccggcctcgccatggggggcaccgcctccctgacggggagagggtgttggattaacctgagccacgccgcgccctactctgcgcccgcccacccgcccgccgggaccaggtcctgctcacccaggaagaggccagtggcgaaggcggcgcccagtgcggctgagcccagggccagcgcggcgggcacggagagccggggcaccggctgggtcatggcgcgggcaggaggcggcgggaggcagtgacaggtcacgtgagctggagctcctgggacaggtctcggactcgcgggcccgccgggctccaccttgtcggggcactacccgcggagccgcggtctcgggcatcatctggcggccacacagccttactgcaagccccgcccgagagagccgggcgcgatctggtggccgcgccgggaactgcgcccctgcggggagcaggccaagcgcctagatctgaattttcccgcctgtgcccgcagtccaggtgcctgcctccattcccctcctgccaatgcttttttctcctcgccaccatttattctgaggccccttgggggcatatgtgaattgtgtatggagggcgccagtgtaagttacaagatagtcacaagtacaagagatagagattaaagggggaaggcctcctggacaagatgccccaaagcatcaggctgaaggagtgagggaactggtttgagggcatgcagcctcgaattggggttcaggagccctggggtgggcctgtggaactgagaccatattcttagctgttaaaatcctgcttttgggggccagatggatacgagtgtctaatcttggtcctgccagtctctctgagcctcagt

SEQ ID NO: 775 - DNA, 1178 bp, Homo sapiens
tgattggaaggcggcaaaggctttaatctcccccttggtgcagctgcttttgaagtgagtttcctcgccagagccccggctggacacgcagcggctcgcatcgcagagcgcagcgccggcgcggggccgcgagaacgcagcgcaggggagcagcccgaggcggacaccgcgagccgcccggcactcccgcagtccagccggctcctctagcccggccacggctccgctgcgggccacccaggattactcgcgtctggctccaggcgccgagaaggcgcgctgggcgcccgtggccgccgcgccagctcctcctcctcccgctgctcctgctcccggggcgagcgcgcagccccgagcccgccccgcgcctcccggagccctcccccccgctgctcccatgcgcgcgggtgggtcatgagcacagcgccctcgctttctgccctaagaagcagtaagcacagcggcggcggcggcggcggaggcggaggcggcggtgcagaccctgcctggaccagcgcgctctctggaaatagctccggccccggcccaggctcgtccccggccggcagcaccaagccttttgtgcacgccgtgcccccctctgaccccctgcgccaggccaaccgcctgccaatcaaggtgctgaagatgctgacggcacgaactggccacattttgcaccccgagtacctgcagcccctgccttccacgccggtcagccccatcgaggtaaggaccctctctctggatcgcactgggaccactaccctggctgccaccctagggctttctttttctcgggatctgggcggaggtgggggggtcggagtgattcagctcccgaatgggggaagaggctactgcttccgtacctcaaaactagggcggaaaagggggaggaagtggaatggggcgtgcatgctagggagcaaggctgccaatacttgtttctcctttcgatatgaaagcccctaccccgacccaggccccttcactcggcaccgaaggcaggcggaggtctgaaatacggttccaaagtcgccgtccttcgtatccgcagaagccagtgtgtgcacacagcctctgaggcgccagccgcccgagcccttactctgaagaattaaggagtgtttgtggggagggggtacagttctgggtctaggaaccgaaaaccaaaa

SEQ ID NO: 776 - DNA, 1199 bp, Homo sapiens
ggattccaagaagctaagaacatgaccccaggtgggacagatgggatctgagtccaaatgtgatgttcttttccttgtattcctctccttcctaactgtatgacataaacgtaaagtatcacaagagcttatgctgctcctcttcttggtaccaagctcggccttcactttcttatgaaaaccaaaagcagttttcaaagaatcatgcacaacttatatttgggtgattgatctgatttggcatacattttgtggagaacgtgaaccagtctattccccagtggagggctgttgataaacaaagagatatgtagtctttttagcatttcaagggctgtgagtctcctgagaaaactcaaaccaggtccaagaggagttactttgagacaagctatctaagaactgcaatatcctctgtggggaaggtggctttcgttgtaatggttcttgcaaatatttcttaaaccaaatagggttttcttctggggaacactgagatcaactatttgcctatttgatcctcttgcagttaatgtaacaggtttaaaactctggtctcagcagaaggggcttcattccgagctatgggggctaattctgtgcagtgcagtgtggggacagagcatcccactttccacagtttggtgaggcactggcccttagaggagagtttttgggtatacagctaattgttctaattatgtagtagtaaaaatcataccgtcctgtagccgcatatgaatagtgcactagagtgctttcttaaaagagttgggatggggttgggagggtcaggaaatgaagggataaaattattgttaattccacccccttgttataccatcaagagaatagaaaccaataaaagaactaaatgttggcaatccataaaattccataagcagtaataaacaaaagctgaaactgtattgatatacaaccaaacaaggaaattatcattattttttaataaagccatttatcatcaataaataccaaggggaataggaaaaattacaagcacaatgccatcttccataattatacctattaacaatttaaagcataattatgtgagggagaaaaacttttaggaaagctttgtgctgttttctccacagaaaagtcaaattctcacactcccagatattcaggattttctaaacatttcagaatgattggttatgcttgtcccaact

SEQ ID NO: 777 - DNA, 1183 bp, Homo sapiens
tattcataaaatcttttcccagaccaatgtcttgaagtgtttcccctgttttattctagaagttttatcacttttggcctcatatttaggattttgaatttatttttgcataggatgagaggtagctgggcacagtggctcacacctttaatcccagcactttgggaggtcgaggcgggtggatcacaaggtcaggagtttgagaccagcctggccaacacagtgaaacctcgtctctactaaaaatacaaaaattagccaggcgtggtggcacgagactgtagtcccagctactcaggaggctgaggcaggagaattgcttgaacctgggaggcagaggttgcagtgagccgagatcatgccactgcactccagcttgggtgacagagtgagatgtcttaaaaaaaaaagatgagaggtgagggtctagtttcattctttttcatgtgaatatccaattttcctagcaccatttattgaagagactgttcttttcctaaaaagtattgttggcacctttgtcaaaaatcagttggctgttgtacactcttcacaatagtaaaggcatggaatcaacccgaatgcccatcaatgacagactggataaagaaaatatggtacatatacaccatcgactactatgcagccataaaaaggaatgagatcatgtcctctgcagggacatggatggagctagaaaccagcaaactgatgcaggaacagaaaactaaacaccacatgttctcacaagtgggagctgaacaatgagaacacatagacacagggaggggaacaatacacactggggcctgtcagggcgtgggcagcaggagggagagcatcagtaatgcatgctgggcttaatacctaggtgatgggttgataggtacagcaaacctccatgccacacgtttacctatgcaacaagcctgcacatcctgcacgtgtatactggaacttaaaataaaaaacttaaaaaaaaatcagttgactgtagatatgtggattaatttctgtgttctcaattctgttccattggtctatgtgtttttatgccagtaccatgctgttttggttattaaaggtttgtagtagattttgagttctggtagtatgatacttccagcttttttcttcgttccttgtgctcagtattgctttggctatttggagtttttgtagt

SEQ ID NO: 778 - DNA, 1412 bp, Homo sapiens
tctgtccgtctatgaacatgcgggggaaggatccggaaccaggacccagaagcacctcctttgtagacagagggccacggctgcgtgcgatccaggcccaggcccacacactctgcccgtgtcacacgtgtgctttaacacaaaacagataacactaaagacgggttcagcacccacctttctttagccagctgatcagagatgctgcaaagagaacctttcggatcactcgtttacaagccttttctaagtatttggtggtttatgtttacttgaacggctccatgttgccggtgcccagcccctgtcccctctgtcaaccccctgtcgctttggtgttggtttcgttcccgtcttcagcaaaacgaccttggaacctcaatgggggctgctttgctttgggaggttcttgttggtgggaccagagctttgacaaacctcctgctccttggtggcacctctcctggaaggacgtcacaactccaggtgctcagactgcctgtggcagcagaaccagtgcctttggcattttcctcccacaatggggaaggtgactttggcattcttacaaactcgtctctcggcctttctctcctgccttccacagcctctcgtttctcctccatctgtgcttattacttgaggactgtgtctgctccgtgagagctgcgtgggcagggctgcagtggggtccaggtggtgttcagctgtgctgatgcctgccattgggtcctccttaggctctgtaagtcgtgacagccttcatcagtgcaatgtttgcagggtaattcttaaactttttagagggtggcaggtacatcagttctttttgatatgaaaacattcatgtttcagacattgaattgagagcttttaggggaagcataatggttattgtcactatcaacagtctaaaaagaaaaactgaggtctttttaatcttgattacagcactcacggcatgcaccctactcagtgtgggtgtcttcgtttgggggctttttttttttttgcacttctgaggctagatatgtctggctgaagatttgatgtggttcctccttaagctatgcgtcctgttaataataggtactgtactgggctctgtgtaagtgtcgttggggtaggacctatattttaatactgttcctaacatttcattttactagcgagaaatctttgatttcattttattctttgtaattctagacactagattgtagtttagccataactgatgttttttaaaaagggatatattttcttgcacagttgttcaaaaaagagacaagtttcagtcctcaatgctgtcctttgttttacaggtacaagttttctagctcagacaaactatgaaaaactgtagactattctcaaggtattaactcgcagaccctctgggggtaggggct

SEQ ID NO: 779 - DNA, 1197 bp, Homo sapiens
cctcagagctcctcgtggagtggccagaacatttttgaaaatatcaaagactctgataagatgctgagttttcgagcccatggcccggaggtccaggctcataacaaacggaacttgatacagcacaataactccacgcagacagacatcttctacacggacaggctggaagacaggaaggagccaggccccccaggaggcagcagctcctttctgcataagccattccctgggggacccttgcaggtctgcccccaggcctgtcccagtgcctctgagcgtagcctgagctccttccgctcagatgcctctggggaccgtggctttgggctggtggacgtgcgtggccggcggccactgctgccctttgagaccgaggtgggcccctgtggggttggggaggcctccctggacaaggcagactctgaaggctccaacagcggcgggacctggcccaaggccatgctcagctccacggcagtgcctgagaagctctctgtttataaaaagccaaagcaaagaaagtccatctttgaccctaacactttcaaacgcccccagacaccccccaaaatagactacctgcttccaggtcctgggcctgctcactctccccagccctccaagagggcggggcctctgacacccccaaaacctcccagaaggagcgactccattaagttccagcacaggctggagactagctccgagtcagaagccactctggtgggcagctccccatccactagtcccccgagcgccctgccccctgacgtggaccccggggagcccatgcacgcatcaccccctcgcaaggccagggtccgcattgcttccagctactaccctgaaggagatggggactcctcccacctgccggccaagaaatcctgtgatgaggacctcacctcccagaaggtggatgagctggggcagaagcgtcgccggccaaaatctgctcccagttttcggccgaagcttgctccagtagtgattcctgctcagttcctggaggtatagctgagccccagggtgtggggaggggaggcctagagaggggcagttggccgaaggagggctgctaagtggccctgcaccagtgtcccaggcccctgtttagcctggtgcctttgcctttgctgttggactcaagtgggaagtggcccagctaggaggtaggtaagtggcgtggaagtg

SEQ ID NO: 780 - DNA, 1199 bp, Homo sapiens
cctggcccatatgtaattttaaatctagtattggccaggtatggtagctcacgtctgtaatcccagcactttgggaggctgaggcaggagtactgcttgaatccaggagtttgagaccatcctgagcaacatgtcaaaaccctgtctttacaaagaatacaaaacattatccaggcatggtggcacgcacttgtaatcccagctacttgggaggctgaggtgggaggatcacctgagcctagggagaaaaaatgagaaattaattttaacaatgcattttatttaacccaacgtacccaaaatgtcatttcaacatgtaatcaatataaaaatgactgagatattttacactcttattttcatactaagttttccaattccagtgtctattttacacttagcacatagcgagtttcacatgctcagtagccacatagcctaggggttggccattcagctcctccatttactctccaagaactttccagtaaatgcttcctggggcttaggctaaccagaaatgattttctatttcctgctagcctggccccaaccctgagacctgtatgaaggtggatagtccacactcagaaaagagaagcaggatggtagtcatggaagctggaatctgccaaggagtatggaacaactcaccagccaaatgaactcgtcctaaaaatatggatctaatttttttaaaaaagaaaaggccaagtgcagtggctcacacccataatcccagcatcccagcacttgggaggccgaggtagatggatcacttgaggtcaggagttcgagatcagcctggccaacatggtgacaccccatctctactaaagatacaaaaattagccaggcatggtggcatgtgcctgtagtcccagctactcgggaggctgaagcatgagaatcgcttggacctgggaggcagaggctgcggtgagccaaaattgcgccaatgcactccagcctgggtgacagaagaagaccctgtttcagggggaaaaaaaagaaaaagaaaggaaagggaaaaaacatgaagagagcccagtgtatccagacccgagtctcatcaccttctcaggaagctttttgggttgtccaggccttaagtaggcctgtgcttccaaacttcatttctgggaggagtgccagtgggctggggaagtcggaggctagaagaagcctgttcttgtacc

SEQ ID NO: 781 - DNA, 1225 bp, Homo sapiens
agccacagcagtttttaccccagagaagtgattctcaacccggagtgatttttctcctaagggaacagttggctaagtctggagacatttttgattgtcacaactgggaaaggtgggaagtgcttccggcatctagtggttagagggctgggatttttatagttattctaaaacatacagtccccacaacatatccatatggaattatccatatggaaatatcagtagtgctgaggttgagaaaccctgccccagagatacacataacctagtgaagtaagttgtacagattcatgtgtaaaaccattgtgttttcctggtattttatgtattccttaggtgtatcctgtgagtttggccttgcccagtgggttttatttactttagttcgctacatgactaatggctacaaattggactgcaacattctaggtcttggaaaatcacagcaaggccaagaaaagttggagtagttttattaaccagagtgtttatgttttcagaacgacaccgtaactatccgcactagaaagttcatgaccaaccgactacttcagaggaaacaaatggtaaggaagggcacatcaatctttgcttaattgtcctttactctaaagatgtattttatcatactgaatgctaaacttgatatctccttttaggtcattgatgtccttcaccccgggaaggcgacagtgcctaagacagaaattcgggaaaaactagccaaaatgtacaagaccacaccggatgtcatctttgtatttggattcagaactcattttggtggtggcaagacaactggctttggcatgatttatgattccctggattatgcaaagaaaaatgaacccaaacatagacttgcaagagtaggtgtcttttcatttgttgatcagctcctgaagacctattttttcaatagcgttgtgttgtgagtgtggtaaaaagggcaagaccaagcaatctgggatacaactctgaaaggattaagagaaaaagttatttcataaaatgcacaggtggagtacgggggttcaaaattgaagtctgacatttgagctgagttcagaagggcagctgaagtagtgttcttggagatgggctaggggtaaggattgttttccagaggagaagtaaggggatgtgtttggaaaggtagcctggcaccaaattcacttagtttggattaagtctgcatctgggcttaaacccataggtagtc

SEQ ID NO: 782 - DNA, 1163 bp, Homo sapiens
gtaaagatacagaaacagtcttgtaggccccaggaacagcaagtgcaaaggtgggcagagtggagatgagtagatccggaatctccatgatgtgggggttgtaaatgcttgtctgtcataagggagtaatggggagttgaaatgggaagagatcccctcagccacttcggaggtgccttgttttggtagtgcaaaagaagaaaaaatagtgatctgtgagctcaagtctggacaagaacagccagtctcccaaactccctgttgagagaatgttgagtggaccatttgtttcctgtgaggctattccatacctaaaatcccttgatgatcctttctgttccagcaaaaacatgcattaaatgtacttgaaaagttttggtttagaaagctgtgtttcttaagctcagactgggtcagtttccctaccagagtggtgggtaatgattttaatgtttacaagtcacctggatgtactcttttctcattcagcatggcctgtatgagaagaaaaagacctcaagaaagcaacgaaaggaacgcaagaacagaatgaagaaagtcagggggactgcaaaggccaatgttggtgctggcaaaaaggtatagttcattaaggaaaatatagaaacgtcattaattgtaggtctttagtttctaggaaagaagggatcttattaatttttaaaataacttttcttaatgtttcttcttttccctcttcttctggattacagaaggtaacatgttttaagaaactatgtagcatagtgtcttaacacctcagtaaagtagcttggcccaccccttgtcagctcacagcacaatctggaggccacattggttcattgatcccagctggtgggcacctttcaagcctatcacaagaagttttaattttactaattggcatagaaccttcaatgcagagcggatcccattccctgtgattttacttattaatatggacactggtttaagaagcagttggatcaatgtggcccgtgttttcctggcacactggaaaggcaactgagatctcaggattgctttcctctccagttggccaagacaagtgattttagcgataagcagctttttaccagctttgctagctgtaaatagttggacattgtaaatcattgaatagaattaaggtgttgggt

SEQ ID NO: 783 - DNA, 1173 bp, Homo sapiens
aagaacaaaatggtcatctttaaggtacctgattgcatgcacttaaatgcagattattttggagtttgaaaagggactattaatgaaatctttcttttccctcctttctctttttcccttccccgccactgattcagtgagctggagattggatcacaggtataattcaagcttttcatgtagtcatgtagatcactagactccttggtgtactgacgtagcaatttaaaagcagatcatgtgtagtacatctagaagtagatttacaaatattctgaagagttgtaaccttttaaaatactaacagtgacatggttttgtttttaaggtttagcaatatttagcccattatttttgttttattcttaacttgaatgtttgtaaattttatttcttgatgctttcattgtgttatgataacatcaaaataacttgatattctaggttactaataattgttgtgcatgagtgttactacttttggaattgaagactttaaagaattttaaaggcagttgttgactaaacttctttctcttgattcacagccgaaggagtaaaggtgctgcaatgatgttagctgtggccactgtggatttttcgcaagaacattaataaactaaaaacttcatgtgtctggttgtttgaaatgtatttgcagtttcctgggactgctaggaggttagtctgctgatttcagttgctgtccaagttcacatgctccatgaagcattcagtgaaaacttaatgtcatggggtggtgtttgtttgctgcttggtttatagcttaggtgggttcatctgggagtcaagcttgtaaatgctgtgttaagaaccatgtccgcggtggacgcagtgtagtggctcacagtcatcagcacttttgggaggtttgggtgggatgattacacttaagcccaggagctcgaggctacagtgaggtgttttttttttcgagacagggtctagctttgttacctaggctggtcttgattgaactcgggctcaagcgatcctcctaccttggccacataaagtactggcatgagcgaccacgtctggcttagagtctaaaaagtaccatgtctggataaactggagaaatctcaggaagcagtagagagctgaaagacttggttgggcatgaaggggactcaggaaaagcaataccgt

SEQ ID NO: 784 - DNA, 1176 bp, Homo sapiens
cccccaatgttgctgacagccattgtttgactatagaatgcaatcaacaccgtggatgacagagtagagagagaaagaacctgagtcccaggtagcatctgagagctgctgaatcagccagccctgaagtctaccctacctctgtttgagattttcttttcctatcactgtaattcataacatatcctggcagatacactcctaccaggtatactcttgaccagctatactcctactcattccctctgagcccagtgcaaatgccacccctctgtgagtccctccctcaggtgcccacccatagtgccctgaacctccatctattccagcactttggtccattcttcatcccgatccctgaggtgacatctcccctgtgagttgctgagctcttaaacagcaaaccatctcacggaggctagagcaagtgtatctgtttaatctaattcattccacattcattcagcaaacatttactgagtgcctttaagacagtgaatgccaagacaggatgggttttgcatacacatctgtgcagggagtaggggtgcattcatgcaggagacagagagacagcagggaagagcaggacaccaccagacgtggtgtgagtggtaggcaggacttggcttagtgcaggaatgggattgacctcgggctttggggctttgaccctctttctatataactctcctttcagggaggcagtgcaggtgaacaggggacagggaggattggaaggctctggaaggaagccagaattgctaggacatgtctaagacagaggctgcatcctcctccactgctttggaagaggagtgagctcagcggagctgagcatgcattaatttatgcattcattcattcattcattcagctcacattatgattatgaagtacctcctgtgtatcaggcaccacatttggcattcaggattaatcagtgaacacagagtaaatgggccttcttctggctcaagggtcagacatcctctctgagatctggagatattcatgttcctccttcaaggtgaagacataacatgttagaatctgctttgggggtcatgggtccaaccccaggctaggtgacatctgggtgtcagggatgtccctttatatccttgagagtctatgatcagcctgtacaaatttgtcccctgcagatggatcctg

SEQ ID NO: 785 - DNA, 1158 bp, Homo sapiens
aatgtggcatgtacatacaagggaagattatttagccataaaaagggaatgatgttctgatacatgtttacaacatgggtaaaccttgaaaacattatgctaaataaaataagccagacacaaaaggacaaacagtatatgattctacttatatgaaagatcatgaatagtcaaattcatgcagagggaatgcagattgcatgtttccagggcatggaggctggggcaaggggaatggagaattagtgcttaatggtacagaacttctgtttgatgtgatagaaaagttatgaaaacagtgttaattatagaacattgtgaatgtattcaatatcactgagttttagaattgaaaatgattaaatggtaccttttatgttatgtatatttaccactgggtaataaaattgtattaatgtagaggcaattttaacagtcgtaccactctggaggaagatactgataatgaaggaggccatgcatgtggaggcaggatatattacatatataatacaatatataatatatattatatatacacattatgtcagggggtgtgtgtgtatatatatatatatattatgtcagggtgtgtgtgtgtatatatatatatgtaatataccctgcctccacatgctttttatatatatatagtaatatatggtatattaccatatataatatatattactacatatatatggtaaatctctatgtcttcctcttaatttttctgtgaaactgaaactgccctaaaaaattcaagtcctacaaaaatgaaaatgagttaaagtacttttttttttctttgaaacggagtctcgctctgtcgctcaggctggagtgcaatggcgcgatctcggctcactgcaagctccccctcctgggttcacgccattctcctgcctcagcctctggagtagctgggactacaggcacccgccaccgcgcccggctaattttttgttttttttagtagagacgcggtttcaccgtgttagccaggatggtctcgatctcctgacctcgtgatccgctcgtctcggcttcccaaagtgctgagattacaggcttgcaggcgtgagccaccacgcccggccgagttaaagtactttttctggaacaaagaaacttagcataaatagttaaaatagtaag

SEQ ID NO: 786 - DNA, 1099 bp, Homo sapiens
tgagtttttgtgtgtgtgttattttgtagagataaggtttcaccatgttgtccaggctggtctcgaactcctgagcccaggagatccccccacctaggcctcccaaagtggtgagattacaggtatgagctactgtgcccggccctgttttcagtttttgtttcctggcaattctgtccaaagtaattgtgggctaaatatcagctacttctgaattctacaaaagacagtctgggtaaattagaatgacaaatataccttggcctcaaggtgggaacttcggatttaaattatgtctgcagaagtagagacacagcaagtataatcacaatttgcctcctgtgtctgaatgaaaacagctaccaaagcctgtgacactcgaggctcaggctcctgcctgggtctgaatcctggaattgtagggccttgtgcctgcaggacactgttttctcagagtcctacagctctgctgcttcactttatccatgtccaagccagaagatggggaatggggtaccagctgagggcccagtgttcatatctttcaaatcttcttcctgctggtgccagccagcctcccttctctgtggctgtcagagggggaccagtgccaggggtcacagtcagtccctggacttgccctctgtgtcacagcagagcctctgacctggaaggctgtttgcttgtcattatgtaactggtctgtgcttttgagcctgccaaagctcagggtttttccattctggaaagggattggttgctatcagagggcctgggctggagatgccgggaagtagattttataaaacgatgttgtcctggtaaccctgagtggctgatgggctgctgggaagaggggaggagatcagggcagtgggccatctgggaaagggtgcttacaaccctggtggccactgtgtgaggaatagacagtgtccccaactatgaacctgtggtttgtccagcaaacacaggtgtatgtttcaaaaaagctgggggcaagcagccattcattaaccaagcaaatgccttgggtgaggctagccattgccaacccacagcccagcctgccctgccctggcttatgcttgtgccacct

SEQ ID NO: 787 - DNA, 1229 bp, Homo sapiens
cccaaagtgctgggaatacaggcgtgagccactgcacccagcagaaataatgtcttttgaagcaacttggatggagttggagaccattattttaagtgacgtaactcaggaatggaaaaccaaataccatatgttctcacttataagtgagagataagctatgaggacacagagacatacagagtgatataatggactctggaaactcagaacggggaggatgggtggggagtgtggaataaaatacgacatgttgggtacgatgaacactacttgggtggtgcacgcactaaaatctcagaattcaccattatacaattcattcatgcaaccaaatataacttgtacccccaaagctactgaaattttataaaattaataacaatttaaaaagaaacagttctctttctgcctccactgccaccatggctcccgggaaaaagcttgtggtgaagaggggcaaaaaaaagaagcaggttctgaagttcagtcttgattgcacccaccccgtagaatatggaatcatagacgctgccaattttgagcagtttctgcaagagaggatcaaagtgaactgaaaagctgggaaacttggcggaggggtggtgaccatcgaaaggagcaagagaaagatcgccatgatatctgaggtgactttttccaaaaggtatttgaaatattacaccaaaaaatattcaaagaagaataatctatgtgattggttttcgtagctgctaacagcaaagagagttatggattacattatttctaaactaatcaggacgaggaagatgaggattaaatttcatttatctggaatattttgtatgagttcttgaataaaacttgggaacaaaaaaaaaaaaaagaaaaagaaacaaaaaacttcttatttttttctttttttgagatgggtctcactctgtcacccaggctggcatatgcagtaatgtaatcatagtttactgccgcctcgacttcccaagctcctgccatccttccacatcagccccctgaatagctgggactacaagtgtgtgccaccacacccggctaatttttaaattttttttgtagagacagggtatggctatgttgtccaggctggtcttgaactcctgaactcaagccaccctcctgcctcagcctcctaaagtgctaggattacaggagtgagccactacttccaacttcaaaaaaacaaatctcaacccatcaagtcgccccct

SEQ ID NO: 788 - DNA, 1463 bp, Homo sapiens
ttttcttcttttctatattaagaattcaacatcactattagaattgcatcatatataatgggcataattttcttttctaggatgctgagtatctacatggatacattaaatatatttatgcgagttgcaactatgctggcaactggaggcaacagaaagaaatgaagtgactcagcttctggcttctctgctacatcaaatatcttgtttaatggggcagatatgcattaaatagtttgtacaagcagctttcgttgaagtttagaagataagaaacatgtcatcatatttaaatgttccggtaatgtgatgcctcaggtctgcctttttttctggagaataaatgcagtaatcctctcccaaataagcacacacattttcaattctcatgtttgagtgattttaaaatgttttggtgaatgtgaaaactaaagtttgtgtcatgagaatgtaagtcttttttctactttaaaatttagtaggttcactgagtaactaaaatttagcaaacctgtgtttgcatatttttttggagtgcagaatattgtaattaatgtcataagtgatttggagctttggtaaagggaccagagagaaggagtcacctgcagtcttttgtttttttaaatacttagaacttagcacttgtgttattgattagtgaggagccagtaagaaacatctgggtatttggaaacaagtggtcattgttacattcatctgctgaacttaacaaaactgttcatcctgaaacaggcacaggtgatgcattctcctgctgttgcttctcagtgctctctttccaatatagatgtggtcatgtttgacttgtacagaatgttaatcatacagagaatccttgatggaattatatatgtgtgttttacttttgaatgttacaaaaggaaataactttaaaactattctcaagagaaaatattcaaagcatgaaatatgttgctttttccagaatacaaacagtatactcatgattgctaagtgtttttttatttttgcatatttattgaactgtctaattgaatacagcttgctcttgtcacctcttcaagctttcaagcctttatagaaaagcttctttgtggcttacactggaaattatgaaagcagtttttctcctaagacttttggtttctcgcattgcctctcagactaagcactaaaaagcaaagcaaaacagaactagttctgtcttaatgaaatatatcaacccaaaagtgtaatgaggaaaatgcttcattagtttcccctagcagacttttacttctcttacactgctacaccattactttcttgagacatttgtaagttctttgatacagaagagttatatttagaagtctttaatgaagggaaagaagtctgtatgatgactgaggtgattgctctttttgacaaatgtttattacagtaatgcagaaatactgttaatcatctcaaagtac

SEQ ID NO: 789 - DNA, 1249 bp, Homo sapiens
atttttccttttattttgttttcagcaatttgattaagatgtatgtagacatggttttctttgtgcttatactttttggagttcactgactgtcttgaatccgtaatttatatatatatatattttatcaaatttggaatgttttctataattactgctttaaatatttttgcatgaaaatgtttttctcttcttctggggctccaatggcacatcaattaaaccatttaatgtagagtcctagaggctctgatctttctttttcaatcttttcccccttcttttctcttcagattgaattgtttctattgttctattcaagttcaccaaatataaagcaatacatgagtttccatgctaactttaggtaccaatgctgccattaccaccatgctgatacacagcaagagccctcttaagttgaaagagagcaggggaatatatatatacacacatatgtgtgtgtatatatatataatatacacacagatatacacatattaatacacatacatacacatatatatgtatatatagacacacacaaatatgtagtgaaagagagagattggggggagggagagagagagagagagagagaacttctgtttgcttgtttagttttgactttcattcacaatctgcctgcattacctcacactttagagtcctcaggtaattattttctgcatttttttccagaaattatagctccaactagcagaagggctgggctgtaatggattcctaccagcctagcggaattggaattccagttatgtcttttaagtaaattaagaggtttaaaaaataataaaatgctaatcattgctatctccaagagggcttttacagccactatacatcactgccattatcacaacatatatgtcacctttgtacatacaccctgatcatcattttttgaagcacatttccacaggttatcaagttccaggtttgtaattttctttattttaatactttatgtatgtaatcttattctcatgtcatagtaaggtttgattttttttctctttctcctttgtgtatctgttctaactatgatttttgtaattttgtgtgttttcatgatggtagttatcatcttttcacttccagatgtaggactcccttaatcatttcttttaacaccagtaaagttgtgaatcattcctgtagtttttgcttatctgggaaagactttatttctccctcctttctaaataacagttttgcctagttcttg

SEQ ID NO: 790 - DNA, 1192 bp, Homo sapiens
atgcaaactgacctaattgcaagattattctatgcagcacaatttttcatagcacaagaatgggtggaatctaaatgttatcattaggaagctggttaagtaggttatggcacatctacacaataaactactgtgcacctgagaaaaataggcaagcctttctaatacggaaatacctcttaagacgtgctatggaataaaaaaaaatcaatgtgaagaaaaagtatacatagcatacctgtatttgcatacagaagtgaaggaatgtgaatttatactcttatctgcttataattattttaaaaatctagaaaatccccctctaaaaaattaataatatatttatctgagggagtggggaggggtgaaatagagtgaagcttgggagaatttttacccaatacctttttacactgttaatttttgaaacttttcaaaaattaaatgaatatgttaaagttatttcttcaaagacagatgatgtctgtggccctaccaccctgaacacgccttgtctcctctaatcttggaagttaagcagagttaggcctggttagtacttgaatgggagactgcctgggaataccaggtgctgtcggctttttaaatgaatagacagatagatacatatgtttaaaaaaaatgagataactaaatgttaatggaacagatcacagagaacacaaaaataaaagaaactctggtactacagagataaagaacaaacatagagaagaagaatgggaaagggagtcaaactctgtggaactaaagcaaagtgctagaggcagataattgggattgtgaaggaataaggcatacaattatacaccacaacatgtttgaactattcatatacattacataaaactaatatgtatgtgcacacatatgcagatttcataattcaaaacatttcaataggcaatgaatgccctttgtccccagcaattgtagatctagaaatctttttaaagaaaatcactaagaatgtgctcaaagacaggtacaaagctgtacctcacacacaaatgctcagaaacaggtgattaatttagtaagtcatggcctcccatacgatggaatgccaaggcaccaaatttatgctgcagcatatttagtgatacaaaaagatgtttaccctccgctgcaaaggtatacactaacatattcactgcagttatcccaggga

SEQ ID NO: 791 - DNA, 1216 bp, Homo sapiens
gctcatccacccgggcccggggcgaggccgagggcagcgcgaagcggggaggcgctggtcccggtgcagtcccgggccgctccccgggagagccgagcccgcccgtgcgtcttcccccgcgcgcccgcccctgcgccctgcgcccgccccagcccagcccagcccagcccagcgcggtcgggctcccgctccggctccggtggcggctgcggcggtgctggcagcttgagcccaggccggcgcggcgggggcggcccgcggctgtggcagcggcgcttcccgcggctagagcggcttcgggggaggctgaggcggtggcggcggcggccgggccggcgtggcggctctgggctggctgtgtgtctgagccccggcgaggagcgaactgcggaggacgccccctcccctccccctccccctcagctccgctccccctcccctccctgcccgcctccctcccctccgcccgcctctctaccacgtgactgcggagcctcagcctcgccgcgcggctctcgcccgctcgcggctcggagggggcgccgggtgctccacgctcccggctcgggggacgctcggagaccggcacagcggcggggaccggcctgggctgcggcgcgccgagctctgacggttcgggcctccttctccggttcgccaggggcgggagaatggaggagggccggccgctaactgccctcgaggggctcccgaagcgccctggcgacctcagcagccgcgcgtctcgggtcatgtccccggccgaaacagaccgttcctcgtggagtgggacctggggagcaagaagagagaccggggcggggcgccgggccaggccccaggacagctggggagccagagggggccggccgccgcaagcatctcagagtagagcccgggccgtgggctcgaaccctggctggccgcgcggacctcggcgggcgcccatcccccgctccatgggcagcgcgctcagccgggagtcgggcaagaggctcggactctgaagcccaattcatggccggaaaccagcgcagccgtgaccgcggcgcctggacgtgaggagccttccaagcggccggcgggctcagactccgaccctgcacggagctttcatgtgcgagcccgggcgaagagcccgctcctcgcggccacagcggaacagggctccctccgcctccggtgcctgcctcgggccggccaccaccaaagagag

SEQ ID NO: 792 - DNA, 1218 bp, Homo sapiens
tttatgatttctcttgcgggagggacaagcaggaagggagaatggcagaatgaaacttcttattctagggagtattttgtcagctctgtggtgctgtgatttcctttattcttttcttcccattttcattcattcatgtatatataatcttgataggttgtctggtaggtaatttgaaatattagtaagctagatagttttgattaccatttcagaaaacttggattttacagaggacttgcctggtgtgcctgaaagtgtgaagaagcccataaataaacaaggagataaatcaaaggaaaataccagaaagatttttagtggccccaaacgggtaagtaaagcactgtcagtgatttttattatttatttgttattggagggctcaactcttaattttttatttgaaagttactaataaacatcatagcaactgtctttcaaaggatatgtgtaagtcgttttttcagatataaccattttttaaaaaattgtaaaatatacatatttttaaaaccattctcaagtgtacaagtcagtggcattactttcacggtgttatgtaaccatcacaattatctatacccaaaacctttttatcatatccaacaaaaactctgtacccattaaccaataacttcctcccccactgcacacctagtcaatactattccactctgtctctaggaatgtgctttttctaagtatcttatataaatagaatcatacaatatccatcataaaccagatacaaaaggacgaacattgtatgaatctggtttatttcactaagcctgatttttctaaggttacatctgtcttttacggtatgtcaaaatttcattcctttttatggctgaataaaattccattgtatgtaagatatatatgtatatatataaaagaatattccattgtgtgtgagacatacacacaccaccacacctccatgccttccacattttgtttatccattcatctgttgatggacacttggattgtttttaccttttggctactgtgaataatgctgctgtgaaggttggcatacagatacatctgtttgagtctctgctttcagttcttttggatatatacctaggagtggatttcctgggtcagtatggtaggcctataactttctgaggaactgccaaactgttctctgtggttgtctgcaccattttacattgctaccagcaacatatgagggcccta

SEQ ID NO: 793 - DNA, 1193 bp, Homo sapiens
taagagaaggtggtttatagctaaaagtgtgttttcccttatcccataaaatgaccaaagaggttattactgaaagggacaaagaaaggcagggtaacttggggggtttgggggagcaggaaagagttcagatagatgttacttaaagtgggagaatgagctgtctagagacaaagtagaatttctggacattattgaggccttagttgaagttggtgtcactaaaaacacatggtcactaatctacctagtgtgtatgtttttttcctcctcctctagtaggccccattatctggaacctggacagaatacagaatattggataagattattagaattgtcctcaatagacattttgtcagtcagcatgtggaatgaagagatagagaagcaagggaatttagggtgttattgcccagagagagattgagaagatagactgtggaatttaaaatgctgagtgcccggacagggctaatgaataggagaaaggggagaaaggggttagtatactgagaatcttcttaaataaaaatgaagaatgggagtactggcacaagcaagttggatggttggtaggttgtgattaaaaaaaaaaaaacagtgggctatctgattttaatgtttatgaagtgaagcattttaggatatacggcaagcttctggatgcaactgagaactggtggctgagatggaatgcggaagattgttgatgatgagataaggttaaagaactgggaaatcagagggttggaatttggtggaattcagtgtgatagcaaaattgggatggaggagtagattataaatatggtgtaaaatccttaaatacatgaacagtgaataagaggttgaataagaggttgttggatgacaagtattaggaagattagagggtaactagcacaagccttaaaagaaggggctttaattttttttttttttttttttttttgagacagagtctcgctgacgcccaggctggagtgcagtggcacagtcttggctgactgcaacctctgcctcccgggttcaagcgattctcctgcctcatcctcccgagtagctgggattataggcgcctgtcaccacacctggctaatttttgtatttttggtagagacggggtttcactatattggccagggtggtcttggactcctgaactcaggtgatccgcccgcctcggcctc

SEQ ID NO: 794 - DNA, 1233 bp, Homo sapiens
taatgaaatacatatacacttgtctgtttggttccacctttcattcccttgagagtaacccacaaagaatggcctagctgagtcagagagaggaagtaattactagaacagtttttttagttccgttctgcttccagcctgaaagatttagtaccaaatatgacagtatctgtcactgcaggctgctagactctagtgtaagaacatagttctatttctgtgagctaactgctgcccttctataaccttcagtttctgccagcatcgtctgcattcaaaccaatgacctcgaggtgaaaatctccagataacatgattggtccccatgctctcatgatttccttacttaagcaattaaaggccaaagcaagatgcttagtaactccttttccacatagaggcacaaataaaggaaagctggtcacaagttttgaaccaaagagttaaaagaagaatcataacttgtctctatttaatgattggaaactctcacagacttctgtgaagtctctcccccttttgtacctttcttacaagtgatgactatatacttttacctggcaggggagagaccacggtcacgaaggtggttttcccagggcgaggcttattcattgcactccagatgtgctgacccctgcgatttccccaaatgtgggaaactcaactgcataattgtggtggtgggggactgcgttcatgcttttccctggttaaattaaaaaatttttaagttattttaaaaatataaaaaacaagatttgactgtattctgccttgcgccactcttgtttgtctttcactagtgcaaaaattgtgatatagctgtcttcatgtaccccgcaatacctggtgcagtaattctgtgcataataatgtatgtctgtttgttgtatgaatgaaatttatatttctaaagaaacatgctagctacaattattgtgataagaaagcttaacaactttttctcattgaaaattgtcacgaaacaatgagcttttcagaaatgatttacttacaaattccatatttgaatgcaggacagaatctggatagtatgcttcatggcactgggatgaaatcagactccgaccagaaaaagtcagaaaatggagtaaccttagcaccagaggataccttgccttttttaaagtgctattgctcagggcactgtccagatgatgctattaataacacatgcatgtaagtattttatgcagcccttcttaagag

SEQ ID NO: 795 - DNA, 1427 bp, Homo sapiens
aaatgaaaaggtgttacctttggcttactcacaagaaactgtttcattttatgaagatctgaagaaccactacaaggacatccttcagagttgtcaaaccagtgaagaatgtgaattagcaagggctaacagtacatctgatgaactatgagtaactgaagaacatttttaattctttaggaatctgcaatgagtgattacatgcttgtaataggtaggcaattccttgattacaggaagcttttatattacttgagtatttctgtcttttcacagaaaaacattgggtttctctctgggtttggacatgaaatgtaagaaaagatttttcactggagcagctctcttaaggagaaacaaatctatttagagaaacagctggccctgcaaatgtttacagaaatgaaattcttcctacttatataagaaatctcacactgagatagaattgtgatttcataataacacttgaaaagtgctggagtaacaaaatatctcagttggaccatccttaacttgattgaactgtctaggaactttacagattgttctgcagttctctcttcttttcctcaggtaggacagctctagcattttcttaatcaggaatattgtggtaagctgggagtatcactctggaagaaagtaacatctccagatgagaatttgaaacaagaaacagagtgttgtaaaaggacaccttcactgaagcaagtcggaaagtacaatgaaaataaatatttttggtatttatttatgaaatatttgaacattttttcaataattcctttttacttctaggaagtctcaaaagaccatcttaaattattatatgtttggacaattagcaacaagtcagatagttagaatcgaagtttttcaaatccattgcttagctaactttttcattctgtcacttggcttcgatttttatattttcctattatatgaaatgtatcttttggttgtttgatttttctttctttctttgtaaatagttctgagttctgtcaaatgccgtgaaagtatttgctataataaagaaaattcttgtgactttactaccaggacttttctcttccccatgtcaaaatacaatcaataattgatggtaaaagtttggaaattcaagcagatttgactcacctggcaatttttttttattttttatttttgttatacttttaagttctagggtacatgtgcacaacatgcagttttgttacatatgtatacatgcaccatgttggtatgttgcacccattaacttgtcatttacattaggtatatctcctaatgctattcctcctccctccccctaccccacgacaggccccaatgtgtgatgttccccttcctgtgtccaagtgttctcattgttcagttcccacctatgagtgaaaacatgcggtgtttggttttttgtt

SEQ ID NO: 796 - DNA, 1208 bp, Homo sapiens
aaaaaggtacagtgattcagccatttccatttgtcatttgtttcaaccttttttaagttgagtgtttttatttctgcagttattagttggatcctccacatcttgcatatatacatgggctcaattattatgtttgtcaggataatcaaatgaaaatactagttcagtgatcagcattgaatggttgttaggcagccatgtgctcaacactgatttcacctcttgagtataaactttttaaatttaaattggtttacatgaaagtggattaaaaggcctttcaaaagaatgggtttgaaaaacctcagtaccctttaatacatgtacatttctttccttttttcatttaatgtaacatgtctgttgtaactatgtttcttaaatattattttaaggttatgtgttctttaattatggtcaaatataatttggtcaccaaaaatgaaataatagtttaaaacaagtagctgttactaagtgtgctaaaaatactcattttataattaattttagttttcttagtatattattataaattgtgccctaagtcaggtacaaatgtacacatcaaaatgcccatattgtatctatctgtagtcgtttaatgtgaattatatgtgaatttttttcaaaattttactaaccagaattctgttataggcacctaaccacgcagcatgaggaaaacggcacaacacaatcttgaggtgccttctgaatcatcagattaaattatgcttcatatgtttttgcttttactgtatttctttaaaaactctaaatctttattcatgtgtcactggattaatttatctgataatgtgtctcacaagaatctgttagatcgtttattcttcagttgtactttgaatggtggggtggaagtttcaggtgaacaatggataacaaaaagcaagttatggaagattgtgaagaggatggaaaaactgaatacaagataccaaaaatgaaaaaaagtgtcccatttttaataactatattctattattttataaatgtgtaataaaggggtccctctttattggttgttctccacttaatctttggtctttttcagtaattttaagttttctgggattttttttggtttataaaacttgtgtttagactttatcttgctatggagttttcacacttctatagcacatatcctagtatctagtcatttctgttttaatatgaatttc

SEQ ID NO: 797 - DNA, 1917 bp, Homo sapiens
gacactgagcttagaacatggcatcttcctttcttctatcttacctactataaacaagattaaataaaagcagaattgaatattgggaaagttttttgtggaaggaattactattctattgattatcatataaattgaagcaaatatccccttaaaggtaataaataacatattcatttccaggtgttcttctctatgggcctccaggctgtggtaaaacgttgattgccaaggccacagccaaagaagcaggctgtcgatttattaaccttcagccttcgacactgaccgataagtggtatggagaatctcagaaattggctgctgctgtcttctcccttgccataaagctacaaccatccatcatctttatagatgaaataggtatgctatgttttctatatgagtatttttaaaggccatttttagagatatttagataaccagatttagtttttaacatttattaggccatgttaataaaacaaagaacataaccaacatcataatatgctatgtataatttctgtgttgtagaatgaaccatagactatatactcccctacttgatagataggtttttctgtcttttctctgttacaaacagtatgcagtagatatccatgtacatgttttctcatgtatatatgtttgcccgggaaagatacctagaagttgaatcatttggttgtgtgatatatctatcttcaacctcactaggattaccagttctttagttattatacctatttatgttttcctgcttggtagtaaacttgggcatcttttagcatgttgattagccatttgggttttcttatttgtgaattgtcaatatttctttggagttatttgtagttttcttttgttgatgtttattatgattacacctattttctagtctatcttttttctgatagttttttttttacagtttattatttggctatagtcagtatttttcctttgtggtttatacgttttgtatctggtttacaaataccttcactatccccataaatgttctctttttaaaaattatatataacatgagataggaatctaatttcattcttttccaaaaagacagcaaactagactatcctttgctgtatgtcatgacttttatattaatggactcttgctatattatggatcaatatttttgttctgttcctggtacgatgtatatataaatatatatagttatactaatacagtattattagtattggatatatatttatatagctttattactgtagttttgaattatattttattattgttaaatttagtatgataggctatgtaaatatgtagagagaaaaatagatacaaatatgtagtatagctttgttttggttacttgtttgctttatgtatcttttctcatcaatttactccagttattttggtgttttggtgtgcatcttgaacagaggaatatatagctagtttattttgtttttgtttttttttaagacagcatctcactctgttacccaggctggaatgcagtggcgtgatcatggctcactgcagcctcaacctccccaggctcaagtgaaccttccacctcagcctcctgagtagctgggaccacaggtgtgtgctaccacacaccactaatttttgtagagtcagggtttctccatgttgcccaggatggtctaaaactcttggggccaagcaatctgccctgccttggcctcccaaagcattgcgattacaggtgtgtccaccacacctggcctattagctatattgtctaaaaattttaatctaagcttctctttaactgggaagtgtgattagtttgattttgttatgatagctgagataattcagatttctttttttttttttcacgctctgtcatggctggattgcagtggcacaaccatgactcactgc

SEQ ID NO: 798 - DNA, 1202 bp, Homo sapiens
ggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaaaacatggcctgagagtagagtatctgtctactcatgtttaattaaggaaaaacacttatttttagggctttagtcatcacttcataaattgtataagcacatta

SEQ ID NO: 799 - DNA, 1222 bp, Homo sapiens
attttctttacctcttgaagttttgacttattcaattattaaacaggaagaataatactggctacttcgtaggctgttgtgaaaatttgataaggcctgtgaaatatatgcagtatagtaagtgcaggtgatacaatttcttttacaacatttatttatttaaaatattaatgaataaatacataaatattttaaaagtctcaccgtgtctcccaggctagaatgcagtggtacaatcatagcttactacagcttcaaatgatcctccctcagcctcccaaagggctgggataacaggcatgaaccatggtgcccagcctctgtttttaattttgaaatgtcaacatggatttgatggtggtctctgatattgacttcttcaggattaagccctccatgacagggatgtattctaaactgtgtggacaggaggaagatgcatttgtttacaatggacagaagtaagaaaagtaagaaatgtcatagaactatgtctgggggtcaggtgacaagcactgtgtcatttctagccctgtgtcccctgcaggtgctttcttctgtggaccctctgctccttctgttgagggagaattttggatgagagctggataatttcccaaaattcgctcaactgtgaagctctggaactcaagttgctgtgctgcaaagctgtctgaggacaggccgtggtggcagagaggggcagggaagacaggcaatttggcatggagatgatgggcacatttgtcacatgacctgggtttgattcccagctgcatcgtatactaattgtgtgtcctagggcaaatgatttagtctctctaagcctcagaggccccaaaggaggaagaatgatgtaaatggcccagcaccatcctgggtgcgtggaaaactctaattatgataatgtcctggaacgttctgcagtgaacaagacagaccacattactgccttcgtgttgcctggtgatcagagtgattattgctggttttggggaaaacagcattctgaggcatggaacggttttcttccctgctctgtgatgcagggtgctcttgttgtgttcactcctgcaggtcacctgctccccagcagggtgacagtgaagtgtgagtgcagtggactgcacagtggcaaaggccacatgactcctgaatgcatcctgtggacaggccaagcgctgtgccctgtgtgaatcatcaggtgaactctcatacaatt

SEQ ID NO: 800 - DNA, 1225 bp, Homo sapiens
catttttctatttgaaataaaacacaaaatacacttgtttttgaatatcactaataaaatacactccaagaatttgtgatcttagcaaagctcttaggtgtaatcttagatgtgtgattttaggtgtgatctcaggtgtgaataaatgtccagcagtgtgtttgggtcacgtagatcccttgtgattgccagcagctggacacatgtaaacaaaaatttgaatttattataaggcttggctcactgaccagcaggtcccagctacagtagggccttgggaaatagaactccagctagaatgctgtagaactcctgaaattccctcctttctaactcttgtctttgctcatttattttactcttaggttttgttgcaggtcagtgaccctggccacatggaacagaaaccttccctgtttaggtctcctttgtttgggagactgaggatgaaaactgctcattccaaaggcaaaattttaaggaaaatgattcttattgtcccagcagatgtaggtgcctaaaacagcattaataagccttggtcaatgaatgcagggatgtgttgtggaagaatagatgctcctgccgcagacacatggattgaagaggaaaaaatgaggggggtggccaggcaatagagtatgtgttataccgaagtattttgtatttcatcagactatacatttttgaaggcagcaattgggaaagactgttgtctcaatctcaaataatggaattcagaaactatgattaagtatagagtttatttgagcacaaagcttgagggtaaccactcaggaaatacagacacctaatgactggagtcagcattccaaaatggggaagttaagatttcacttacataggcagtaaacagggttgcagcattttccacataaggtcagtacacacgttatagcaatttgatcggttactacttgctatgttccaagaaagattgctttaccattccatcaggagggatgatactttcagggggtcttatgtctggtgccacaaggcctttcctgatcatttacaggaaaaagcagaagttgcagttgcatgctacataactcaggccacacagccacattcctctcaaggctcaaaataaggtaaatttccaacagctttaagtttgcattatttaatttcatagtcattctatttagttataagaccattaaatggataatggtgacctctatgttaaaatataggg

SEQ ID NO: 801 - DNA, 1105 bp, Homo sapiens
gccctgtagaagtaggtagatatagaaagaagggcccaaaaggtgagctcatcaaaaggaaataggaggtagagatggtggggcagcccagggtcctggcaggagatgcaaaaaatcacatcatcatatcacatgatcacatttgatgacatgatcaaatcagcatcataaaaaccacatatttagactcttcttacctactaatacctcttcccttcagtaggccagggacatttgataaatagataaaatttttaaatgagttaaaattttcaaacacaaatgagttttagctttaaatgatcacttaatactagatgaactaaatccgcattaaccatggtttacatggctgtgagataattttaatagcctaacaaaccaaaggaaataaacatgtctgcacaaataattattttattatttaaactaagtaattacatatcaggcactttgctagccactgggggtagagtggtaaataagataaatgtgaaatgtatacactattgagcaaacttatatgccaagaagaaatttctaacacatgtatttagatgtatgttcttttttttttcctgtgtgaactcatgtattctgagacttcagctacctgtgctgaggcctctcaaatctttatttttggcttacgcttttcttcttagctgcagaatcctactggatgtccacttggatgtcctgaagccacctgaaactcagcatatctacgaatgatcaaatgggatgccagcactcagttatccaagcaagaaatatgctccatgcttgactctttaccctcactaacaaaactgggcaaagtcctgctggtctctctctttaatacttctcaaatctgtccctttagtttcatccctctgttactgttctcattcagattcttattacatctcaccaaagccactgcagcacattcttaactgtgtccaagtggtaataattaaaaacagcttactgtctttatcattatcactcttaacccaccctaaaatttcctaaaggtatcccgttgacctcaggatacattaaagctacttagtggtgactggtttctgcctaccacttcctcccctaccacctaaca

SEQ ID NO: 802 - DNA, 1226 bp, Homo sapiens
ttcaatgtacctactccactccttagactctttaccttgcaccttacaagtgcattgtattatggtatcaatagtggacaaatacaagcaggctcctgttaattattcagctttcctgaagaatagaaagataatgactgatgaccttacagaatttattgaaagcataaggaagctattcagttttttgtgttttttaaaaaagaatttacctgtgtgattttcttttttttttttcttaaaaatcctacatatctctgttcccaggctatctatagctttagacattttatttctgtcatgatgaacagtctttctagcataagcagtgttcttttggaatgagaaaacaagcttttaagcacacttgccttttcccttacacactcttatctatccttagtcacttgtcaccagctatataaatagcaaaggaaaatctgcattgaactgagggggaacttatttaatgtgtctttaatgcattaagtaatagaatactttatgtattatttttatatttaaaatgtaacattcccattctgacaagatatgaaaggtctttaaacaactttgagactttgctggaccagacttcttgagaaaatgatttactaaaatcaagttgttaagattaccattgaacttcaaaatagtgttgctattttgcagtgctgttacagcatggagctgagccaaccatccgaaatacagatggaaggacagcattggatttagcagatccatctgccaaagcagtgcttactggtaagtctgtatactctggttattccaggaagcctgtaaagaacaaccttgccaggtaggaaatttgcctcctatgattaatgacttcagctagatttttaaaatagtgtcagttcagtagctatccttttctacgtctagatagctgacattttattctcctctaagaaaaataaagctttctttttattttctaattgctgtttaagtatgtcattgttgccttattgggggtgagggtgatagataattgtatgttgctttagtatattcaggacattttttaaatacccctgagtttttcagataacttatgcctgccctttacatgcaggttgagtatttctaacccaaacttcaaaacacttctggtcttaagcatttcagataagggatattcaagctgtactattttttttaatgtattttaattttgatggaatgctttcaaaaaacac

SEQ ID NO: 803 - DNA, 1199 bp, Homo sapiens
tcacagagctcaaaagatggatgaagatcaaatcagtagaaactctggttcaaaaatactgaagattacaggagaactgcgcttactaggctcactatatcctgctggtgattgtcaagatcctggtgggaaatttggaattaatctttgagtgacactcagttatattcctttacttacaatgtgacttattttattttgacattggaattccagacgcttgtagcaatttctctatgaaaaaaatcttattggtaaagctttctccagccttcctcagaagaaaaacataattttatattcctaatcatgagaaagttacataatattttccaaggagcaacaaaatgggcagatacttttataattgaatcataggcctggagggtcagtcttttccctcataatacagatgagaaaatggtgagccttttaaaaagttaaaatcttggtatcagtttgtttgtgaaaacatctgtcttggaaccatttcaaaatttccttaatcacttactcaggtgtaatggaacaactagatgttggtattgttccatatattgtccttttagttgttcctgtattaggaagaatgagtgatcagacagacagtgtgagattcatggccacgcagtgctttgcaacgctaattagactcatgccacttgaggtaagtcaaagatacttgctttaaagacataatgttttctataacttgatccataataattgtaaccctttttagggccaggtacaaaggctcatgcctgtaatcccagcactttctgaggctgaggtgggtggatcatctgaggtcaggagtttgagtccagcctggccaacatgggtgaaaccctgtctctactaaaaaaaatacaaaaaaaagacaaaaacagttagctgggcatggtggtgtgtgcctgtagtctcagctactcgggatgctgagacacaagaattgttggaacctggaggcagaagttgcagtgagctgagatcgtgccactgcactgtatgtatcctgggcgacagcgagactccatctcaaaaaaaaaaaaaaaagaaaagaaaagaaaagtaacacttgttaaagaacatgtcaggctaaaaaaagaaggcattatttcaaaaatgtttatattacaataattaagatttttaggcttttaattggtacttttttcctttaacacacagagttt

SEQ ID NO: 804 - DNA, 1182 bp, Homo sapiens
ttcgagaccagcctggccaacatggtgaaactccatctctactaaaaatacaaacattaaccaggcatggtggtgtgtgcctataatcccagctactcgggaggctgaggcaggagaatcacttgaacccaggaggcggaggttgcagtgagctgagattgtgccgctacactccagcctgggcaaccgagtgacactgtgtctcaaaaaataaaaataagaaagaaagaaagaaagaaactttaatgcagcagtcttgagagatgggattattaagaggtgatgaggttgtgagggctctgccctcatgaatggattaatatagttatcaagggaatgagttcattatcttgagagcaggtttgttataaaagtgagtttggtcttctcttgctctctgtcttgcactttcaccatgtgattccttctgccatattatggtgcagcaggaaggctcttaccagtttatgccccttgatcttggacttcccagcctccagaactgtgaaccaagtaaatttcttttctttataaattacctattctcaggtgttctgttatagaagcataaaatggacgaagacaactggttaaatcgggagaatagttaaaaaaccttgaatctattaattcatttaaaaaatattgattgtatgtgacaggcgctaagctagggactgaagatacaatgatgagcaaaaacaagcacagtttttaccttgtttgtggggtttatagtttattatgagaaggattatcacataaataaatgtatcaaattgcaaatgtggtacatagtgttgtgagagattataactaggatttgacttagaccaggaggtcatggaaagtttctctgaggtagtgtctgttataccgaggccccaagaaaagcaggcattaactagataaagggaagagggaagaacattccaggccaaagaacagcgtgtacaaatgccttgtgaaggaaatgatgaatagaagaaactgaaacagaaaggagatcttgaggcaagagaaaaccaaaaatatcagtgagtgaaaggctgtgaaacaaagagctttgtaggccagtttaaggaattttgccctaccctaggagaggaggaagctgcttgtgggagggtttaggcgtaagaaatagaccccattctggccgggcgtggtggctcatgcatg

SEQ ID NO: 805 - DNA, 1201 bp, Homo sapiens
gcactttgggagggcaaggcgggcggattacctgaggtcaggagttcgagatcagcctgggcatgtgaaaccacgtctctactaaaaatacaaaattagccaggcatggtgacacatgactgtaatcccagctactcgggaggctgaggcaggagaatcgcttgaacctgggaggcggaggatgcggtgagccaagatcgcaccattgcactccagcctgggcaacaagagtaaatctccgtcttgccaaaagaaaaaaaaaaaaagaaaaaaaaaattcacgtttgttggcttgggaccatataattaatacttttttttttttcccttaaaatgtccatttaacaacagattgagtcaagtactggccacagagtactgtggctaggtcctgtgccattatattccagtgccttgtagaaaaggccaaagtgccccatactgccaagtaccatgtgctgagatagctgtggcccagagggtccttgagagtgatgccaatcatcattaaaaagcattttttaagcaccgatctgtacatggttctgtcctaggcactgtacaaaacgagttaaacagacatggcccttgccccctgggagttttcagtctaagatgatgctgacatggacagacataaaggatattgagacaactgaacaaacattgaacaagaacataaagtactaacattatgcacaagcaaaggggtaagtgtattttgtggggtagtatgtaaaggaagcctcatgggacatggacagggtggggtagtcagcctctatcaagttaagttagtctttgctgagaagttggatttttatacagatttaatcaaagtaaggacaggacattccagacatgtagcaaaaagacttggagcaaggatgaaagtttatattgttaaactgtcagtggcctcaaaaatctgtacttctgggtggctctgaaaatggggttggtgtcttagctttagaaagttgccatttgagggccgggtgcagtgcctcacgcctgtaatcccatcactttgggaggccgaggcgggtggatcatttgagaccagaagttctagaccagcctgggtgacatggcaaaaccccatctccgctaaaaataaaaaaattagctaggtgtggtggcatgtacctgtaatcttagctacttgggaggctgaggtgggagaatcgcttgaacccgg

SEQ ID NO: 806 - DNA, 1215 bp, Homo sapiens
tccttatgtgtgtttaaggccagagaaccactgctgacattgcaaagataaggttgtccacaagatggagataaagcacttctcagtgaaaaatgctccacacactcaaaacccattctctggctttatgtctacaccaactccaatttatggtttcttcttttaatttttttttttagacggagtcttattctgtcacccaggctggagtgcaatggcgtggtctcggctcactgcaacctcctcctcctgggttcaagcgattctcctgcctcagactcccaagtagctgggactacaggtgcctgccaccacacccagctaatttttgtatttttagtagagacgggttttcactatgttggccaggctggtctcaaactcctgacctcgtgatccgcccacctcggtctcccaaagtgctgggattacaggcgtgagccactgtgcccagcccttaatttttttttttttttttagagacaagatctttttctgtctcccaggatggagtgcagtggttccatcatagctcactgcagcctggaactcctgggctcaagtgatcctccaggctcagcttctcgagtagctaggactataggtgctcaccaccttgcctaattttttattttttgtagaggcggggtctcactatgttgcccaggctggttttgaactcctgtcctcaagccatcctcccatcctggcctcccaaattgctgggattataggcatgagccatggaacctggctgactccaatttatgtaatgtgccaagcggggacaaacgtgggaagataggtaacattacctttggtgctgttgcttgccagtcaaagaaatttttgccacctcagaggaaaagaccaggaactaactttaaaaatgacagccagggctggatatggtggctcatgcctgaaatcccagcactttgggagactgaaacagaaggctcgctcgagcccaggagtccaagaccagcctggacgacatagggagacctcatttctataaaaaataaaaataaaaaaattagccaggcatgatggctcttacctgtagtcccagctactctggaggctgaggtgggaggatcacttgagcccaggaggtcaaggctgcagtgagccatgatcatgtcactgcactccagcctgggcgacaggcagacggagatcctgtttctaaataaataaataaataaaata

SEQ ID NO: 807 - DNA, 1202 bp, Homo sapiens
acatatggctaatttttgtatttttagtaaaaacagggtttcaccatgttggccaggttggtctcgaactcctggcctcaagtgatccgtcctcctcggcctcccaaagtgctgggattacaggcgtgagccaatgcacctggcgttggtgatattatggtgtaaacccataatttctcagtggttttcatgatgtaattttgttgttattgtttgtttgttttgtttaagagatggggtcttgctgttgtccagcctggagtgcagtggtgagatcatagctcactgctgctttgaattcctgggttcaagtgatcctcctgcctcagcctcctgagtagctgggactacaggtgcatgccactatgcctggctaattaaaaaaaaaattttttttaaagagatagcttgacatgctgcctaggctgatcatgaactcctggccttgagcaatcctctgatttcagcctcatctttactttttttgaagtgaaacttggagtcagacttttcttgagagacacttagtacaatttgacttattagtttgatcatgaggactggctttgataattagattttaggttttagggtggactttttaaaaaaaaaaaaaaacaaatgccctaagtctgcaggtcagaatttgaaccagaaagtatattattaatgggggaaaaaaaagtctcactcattctattaagatatttatttccaataaaaatgtacttttgggtttactcattatcaaaatgtatgatatacttaggccatttgcatcagtttagtactgattatgataatttcactcagaagaaaaaaaacccaccataacacctaaagccttataatctcaaagataagagtaaaacatatcatattagacaatgttttttaaaattaagttagaataaattctgtaaggataatggactggaaataagagttcaaaagaaaaatgtagactttctaaatgttaaggaataatgtgttcatgtatctctctatatttgtatattttatatttttttagatatggggtttcatggtaaaaaggaatctgaggagaaaagaaaaataaaaaaaaaaagaaagaaaaaaagagatgaggtcttactctgttgccccaactggagtgcagtggtatgatcatacctcactgtagccttgaactcccaaactcaaacgatcctcttgtctca

SEQ ID NO: 808 - DNA, 1151 bp, Homo sapiens
gggaggctgaggcaggagaatggcgtgaactcaggaggcagagcttgcagtgagctgagattgcgccattgcactccagcctgggcaatagagcgagactctgtctcaaaaaaaataaataaatgaataaaaaaagaaaattatacaccatgtgatttttttccccctacaaaattcttctgaagttatttattggtaaaataatgtcaatttattaaacactgtctatctgaagaaaattatctgaacataagtttggtgtagtggttcacaacaggaagcaaatttgtcccccagggaacattaggcaatgtcggcatacatttttgattgtgatgactgtggtggcgatagagtcttaactactggcatctagtggagaaagtccatggaggcttttaaacatcctaggacagtccccctacaacaaagaattctgttacccaaaacgtcagtagtgctaaggttgagaaacactggttaagtatgacattttatttttcagatatctgaaatgtgttgtgaagctgtgaagaaactctttaagcaagataaattaggccaagcttctcttggtgtaattaaagtgatttctggttttgtgaagggcagaaattacgaagttaggccagaggtgagcctttttttttttactttgcattttgtttttaaattacaaagttgattttcagttgttatgaggaatttattccttataagtgtatgaagtaaaaagtattcaagctccttaagtgtttaacatgtcaactcctgaaatgtttgatactattaacagttcggtatttatccttctagatgtttttctttgcagatatagtcatatatacttgcttatattttaaaataaaaaatgggcttatactttgaaaactgttctggaacagttttcattttctatattgtgaacttacatatagggttatcccattctttctaatgcctaccagagtattccattgtgtgccctaattgttgaacagctgagttttttctagatttttgctgccacagtcagtgttgagaacattttggccatattattttttcatattgtgtgaatattctgtgaattaaatttataaaatgtagatgctggatccaacagtaatcacatttacaaactcaaattg

SEQ ID NO: 809 - DNA, 1172 bp, Homo sapiens
agtgagggagtgaagacagaacacacaggtagatagaaagtggagtggtcagtggattgaaaggttacataattggttaaggaagaagtgctgtggaagtaactgaatgggagctggaaggataaaagcttgtggtcagagagaggggtgagcactagggtttggaatgtggccattagagaggctggctgaaatggaatacgaagtgaaagtaattggagatgagaaggagctgaggggctaagtcattggtttccaaacgtcctgaaaggcatttcagagtatgtggagacatttagtttttggttgttacaataacctgggaatgctattggcatttagattgcaggagtcagagatgctagcatttttccagactcagaacatcccagtacgacaaagaattgtttgcctagcatatcagtagttcttccatttagaagcactgggctcagctgtgagccatggcccactccctgtaatcccagcattttgggaggctggagtgggaggattgcttcagaaagcgtaagcttttcctgtttaaacccaaaatgcagagagttctacatctctgatacttgtttctaatttttctttgtgtgtgtgtgtgtgtggtacaggtaaaaggattgagagggaagaagaggaagaagaagaagcccttcctttagatatgatggatgaagatgacttacagttaatgaaggatttaggacaaagagtatcttttctaacaagagatctttcttctaggtaatacttcatttgggttataatcattcatatccatttagtgttaaaaacttggttctgaatttcacttaggtggttcaaggtgttcacctttgagcacaatgtttacaaagaataaagtattatttagcttatttcctaaataaaggaggttcatgtataagataagctgatttcatttaatgtacatctttcttttgagtctgaatagtcaagtagagtgaatgggggaagaatgctgttctcactttgaggtagtggcagaacagttctgagttcctacggctatgatttcacttaatcctcattaccctgctggtaggtcttattcccatttccagagaggaaactgatggttccctgcagtcacaagtatctggaatttaaagttggaccttttaaactccaaagtctat

SEQ ID NO: 810 - DNA, 1177 bp, Homo sapiens
ataaaacactaagaatcacagacttttaagtgaccaaggctgatgagaaatcattcgccatgctacaaacacggccagaatgtccgtcgaggggcaggcattacacacaaaaaataagcttctttctgccctcaggactgtatggaggaaaaagactacgaaaatcagtatctataacagcatgagataagcaacgtgaggagaggcacaaaatgcaatgaggtgaccgaaaaaaccaagtcctctcattctgagaggaggagcccgatttccccaaggttttaaaagaaataaatagggcgagagtcaaagaatcatactcagataaccttgcaaaatgcgcccctcccgcccggcttcccgcctttggcaccgacgccctcggggcttccctcgtgccagtccgcgcgcgcacgccggggggcaaccggtccagggccgcgagacagtcaccgcgagagggcgcgagcccgaacctgtctacggaagtcccgccctcacttccggcggcggaggattgggagggactgaaggccgtttccggctctggtagtgtagggacttcggcacgtgtgtcattccccgggatttctgtagtaaccctgcttctggtgaacttgtctggccggcattcatttaaggcctaaggatgaaggcggtaagtgtcctcaaaagcccggtcgccgcggcctagggccccttcgggtgatagagtcactgcctgagttagcttttaggcaggttttcacccgtgtctagggggcggtggtttagactgggggctttccattccttacaccgagctcatccttggttacccactgtgtgcgcgcaccacttcagagtatcacgaagagacaggcacggagttttgcatgcgtgggatttcatactttgaaggaatttttcaagaccgtctttcgaactcgtttttcacaaatgagaagcagggtcctaccctcagcgagtttataatgtgagtcacggtacccatgaagggtaaagagatagaaaagcaagtgatttgtcctggttctcccagaaaataagaggtagtcctggggttcaggactaactttgggatttctgaatgagtcaccagcaagagaagtggaatccaaagatccgaattcagttttgccctccttagtttatgggtcttttggcagcttcatca

SEQ ID NO: 811 - DNA, 1193 bp, Homo sapiens
ttgagtagagacggggtttcaccatggtagccaggatggtctcgatcttctgaccttgtgatctgcccgcctcggcctccgaaagtgctgggtttacaggcgtgagccaccgtacccggcctcttctccctttttaataattaattataattaaaggaagggtctagccgtttacaaatttacattatttgtctgttaatgagcaatttcataatgagcagtttcatgcagtgttacaccagtctgaagaaatatcctctgtactgcaaatttccggagccatatttcaactttaaggtattaaatccttttgtgtaagttcaaagtagttttatacacccttcatttttacctattgagatatgaaggcccttcctcttactttcagatattgttgtccatgttaaaattaaactaatttcccacaacatttgtatttgtctatagattgtcattttgtacataaaatatgccttattttgtttacatttagaacctaaggacatagctttataaactgaatttcttttaattcgttcccttttagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaaggtttgaattcaaaagtgaatttaagtattctttaaactgtgaccattttttgcatttcccatatatgcattatttgttttggtagagctgttgtggaagtgaatatccctgtagaatctgaagttaatctgaagctgcagaatataatgatgctacttcgtaaatgttgtaatcatccatatttgattgaatatcctatagaccctgttacacaagaatttaaggtgaatactgtttaattctaatttactgttttgatttccattacttttatattggtggaaagtgttactttttttgattataattattaaaaataagtatggtgctatttgtcatgaagattgtaatccttcagtaagctgagacagtcttctttccgaaatttcagagaaccttatcagggttagaaaaatggtcactttctatgagcaactagttttttaaatttttttattttttatagagacagggtcttgctatgtttctcaggctggtctcaaact

SEQ ID NO: 812 - DNA, 2140 bp, Homo sapiens
cccattacataagcatgctgacctaggcttgcttgaaactcgtgatcttgtccttagtgacccagtctttcctgttacattgtcctaaatgactggtttcatagttttactctgtcattgcacgtctcatatctcctccctctcactttgctccctattgccctgagaaaatagacgcagtcagaaaagaatctttaaaagttgtcaccgttgcatctgtaaacctagcatctgtgcccatctgtccccatctgccctttattatatactgcggatatattgtttgtcgtagcttgagccaattgcaatgtctcatttcttttataacaaagctccttgaaaaagagttctattatagcaaaactccttgcctgtattcattgtttttagtttgttctgttttttctgaacccattccaatcagatattcatttccattggagctggtatttttaaggtctcgtgacgtcagtgacctcattttacttgatctattagcagcatttcatacagttgttgactcttctccattaaaacatttactttatttggcttctaggaaacatattttcctgctttttcttcctatttctctgactcttttctcagtttcctttgctgtttccttttctatcctctaaacattgaaatatcctaagcctagtttgggattcccttgatggtcttcatttctttaatgggaactgtgctggtgactcaaatttatatctccagccagaacctttctcctgaattccagattcacatatccgactgtttactaggtgcttgataactatatctgtacttttcatcttgtttaatccaaatttacttcttttgcattttccttagttcaataaatgacaactttattcttccagttatttaaaccaaaaatcttagagtcattcttctcttccttccctcatatttcatgtctgattctaaaggaaatcttgttgcctgtactttttctttctttcctttttttcccctttttttgagtctcgcactgtcgcccaggctggagtgcagtagtgcaatctcagctgactgcaatctctgtgtcccgggttcaagcgattctcctacctcagcctcctgagcagctggggttacaggtgcatgccaccatgcctggctaatttttatatttttagtagagactgggtttcaccatgttggtaaggctggtctccaactcctgaccttgtgatctgcccgccttggcctcccaaagtgctgggattgcaggcgtgagccaccacatctggctttttttttttttttttttataaacagtttcacttcgtcacctgggctgaagtacagtggtgtgatcttggctcactgcaacatctgccccccgggtttaagtgattctcattccttggcctcccgagtagctgggactagaagtgtgcgccaccacacctggctaattttcttatttttagtagaaacgtggtttcaccatgttggccaggctggtctcgaactcctcacctcaactgatcatctgcctcggactaagtgctgggattacaggcctgagccaatgcgcccagcctactttctataaaagtcgtcatgtctctgcccccaccccccgccaccccccacatagtctgtttcatttgattttccccttagtttagtgttttattttgatgtttcttcagatgccttgggatcatttactgttcctcatatttaagagcaaatgcttaaaaattcttagaaataccttcttgaaaagcctgcattcctaccacctctcaccacttcaacatgaaataatgatcccttacatctttttagtgtagttatataacttttgattggctcaataattacttttattatggctgtgtaagtattattaaagctttagataagccatggaatatgctgtgattttattttcattcttgtgcagctttttttttctccctgaagttaatacttaactgttttttacctaccagtaatttatatctaatcactctggaaatataagcccctcagtatattaaaacagatctcatgattcagtaataaacctccccctccaaatatatcccatcacctctactccctggaacattcttctagtttggactgtagaactgattcc

SEQ ID NO: 813 - DNA, 1228 bp, Homo sapiens
aattccctatacctgtatgcattatagagcaaataagagcatcaaaaacaatcttagaaatctttcagagaaaggtcacctacaaaggaacattgatcagataatagatttttttttttttctcagatggagttctgctcttgtcgcccagactggagtgcaatggcacgatgttggctcactgcaatctccgcttcccaggttcaagcagttctccagccttagcctcccaagtagctgggattacaggctcccactaccattcccagaatttttgtattttaattagtagagacggggtttcgccatgttggccaggctagcctcgaactcctgaactcaggtgatctgcctgcctcggcctcacaaagtgctgtgattacagggtgtgagccactgcacctggccgataacagatgttttaatagtaagataaaaagtaaaatttccagtgtgtcgaaggaagaaaattacagcctagaattttatcttcatgtacattatttaagtgtgagggaatagtttcagtgacattatgtcattgaagaccttagaagatttccctcgctaaaggagataaagcgactggcacaacatgtatttctctgagtaattagaagtgttcttttctggctgtactgaagggactttcatgatttcttcgtttttgtactcttagttttataatattgcatagtagctaaggcctggctgtagcagttataaactgttctgcaagtgcgggaagtaatagttattcctatctcaaggatgtggggtttaaatgggttagtgcacaaaaggacatttattaaatttagtcataatcatctcaaggacatggtaagtgaaagagtgtacataaagtacttaatgtaatgtttgctacttaatgttcaataactcaaagagaccaccaccactactacattttacttttattagtaattaataataattaataattagtaattcagtggtaattagtatactaccaaagaaagtacttgagcagaagagccaaaattcaaaccatagaatcattttactgtgcttttattctacctcaaacactaatctccaggccttggataaagggattatttctctgaaggggaaagttatcctctttttgcccaagtcacacttgtgtcatttcttatactgtaaacatgtggttccaattctgaggtattttcccggtttgtaggacccaaaaagaagttag

SEQ ID NO: 814 - DNA, 1247 bp, Homo sapiens
taaaaattataaatgtcatacatgctacttaagaaaacacggaacattaaaaaatgaaaaatctgatcatagtttcactttcaatttattggtatatccttctgcgccaaggttttttgttgttgcttaaacgtttgccgccacttattccctccccacattttaaaaggaagataatttatgtagaattatgtagaaagtgaggtatcaattagtaggttggatttataaagaacagaagaggagccacactggcctttggggtaaagccaaccatattaactgtccagccctgttgtcaggtagaggaagtattcgtttgagggagatgtgagcctccctcattgtgaagatagtttttgatcaattattcaatatatacaggtttggagttcagtatgtcttctagaactactggcggcagcttctttcgttgacgtgggctacaatggttgctaaaacctgcgtgccagaagccagaggtggggaggcgccatttgctaaaccggaactggttaaaatctcagggtggagaccattcccagtcagcaagggcttgggaagtgcatacagttcctgctcctggtgtctactctgaagagcacagagtagacgtttgtctgccatttcaccggcagtaagatcagcagctgctggtgagcaaagaggtagtagtgggtcactggactggtgggcgccggggccgcgcgctagatggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggcaatgggtactacgacaggtattccccgtcagcgggactgcccagaccttttaggatgtcagaacttctagagggccacccagcaggcaaacggcgagtttgtggaccgtcagggtcccccaaacaggtccagggatccgcctcttgtgagaggaagcgcgagttaaatagtcccggccattcagcgcttccgcttaacttgccgcaaagtttttctggagaagtcggggtttttttgccgagcgcttttgccgactgctagagcttacccttactttcttaacctggggttgttttacttccgggctttttgaactctacactctcctac

SEQ ID NO: 815 - DNA, 1196 bp, Homo sapiens
gcaagaatagccaagaaacccttgaaaaagaaaaacaaggaatgggaagggactagccttcctagacattaaagtacagtatgaagcctctctaataaaaacagcgtggtattgctgcatgaccaatggaagtaatgagaaaatatgtagataaatagaagattataagcaaattaagtatattatgaatgtggcatatctaatggggaaaaataggcttttcaataaacagtacaattgcacagccattgggaaaagtacaaaacttagattcatacctcaaatcatttgcaagagtgaactcccaatggatcaaaaatctaaatgtaaaacatgaagccataatatacctgaagaaaacacagttaaatttctttataaacttatctatgatttaaaatctagaactaataaaagaaaatcttaataaatttaacctgagaaacataaaaattttttcatagcaaaaaacaccataagcagtatcaaaagataaaagataaattgggagtcaagagttgcatcatatatcacagaaccaaaggctaatatctccttaataggtagagatcctaaactttgagataaaaaaaaaaaaaaaccaactagacaaaaagtgggcaaaaccatgaacatgaaaggcaggaggcctttaaatggatgaaaagtatgcttaaccacactcctattaagagaaagattattataatcatgctgaagaaatatttcagataagcaaaaatctaaaagtctgatgatgctgttgttaaggctgtgaggaaaagacaccctttgcttgcaaaatgttgtactcccctaggaggggatttggcaatgaggtaggaggtggggcttggacaccagaccaaattgaggactgtataaaacaagtcaggctggaagcacctcccatgtcagtttaccattgccatggcaacacccagaagttaccacccttttctctggcaatgacctgacaacctggaagttaccacccttttcctagaaatttctgcattaaactaccccttaatttgcatctaattaaaagtggatataaatatgagtgtagctctgcctctcagccgctactctgtgcacaccgtctataagtagtcctgctctgcaaggagcagtgcttctgctgctgctgtaggctgccgcttcaatacaagttgctgtttaacactattgct

SEQ ID NO: 816 - DNA, 1172 bp, Homo sapiens
aatagtatatcttcaaatcaaagaaggcatgttttttgatttaacaaccttttgccattatcaaattattcttgctttataagagatgtattttaattctgtagttactgattatacaagaaataattgctacttgattagacttggcgtatgatggtcagactcagtgtattatggtatcaggtgatttgcaaagcaaatgatacagttttagtaagttcagagagaatactaacataaggatattttctttaaaaaagaataactttccagagcatagagtatttagtgtttttaaatgatggatactgctctgtatgtatttgtttcaaaacatcttattttatctttgcaggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaa

SEQ ID NO: 817 - DNA, 1223 bp, Homo sapiens
aatgatgcctaaacatacagtaaaattagaatcagaaatacttctttaaaaaatattcaaaatgtgtttgtttcccatgggattattctctatcccacacgaatgtaaaaaaatccacattaatgatccatttaagtatagttttattgggtccttttctaatgattaaaggttctttctcaatttcattcctcagtcctgcaagtaaggactcatactgaagagtactgaaacaaggacttcttgtcagaaacagcttctggaatcttgggttttgtttttgttttttgacaaaatacactattggccatgtccatcacgagagtgtttgtagtaattaattaccttgtacaggacctggcacttagtagcattcttcaaatgttccctcagtgatccttttactctccttgtcacttatttgggagaaataggggcacgtgagataagaagaagaataattttgatgttggtatgcttgccctgttacttatagacagtctttgtcataggcaaacttgaatttgatttaaaatagggctgggaaaaatattcaataactgtaagcccccttttggatgccaaacttagaattttgtacattctctgatgaacaagcatttagatcgtaacatggtaaagcctattaccagccaatgttgttagcatctttgtatgcacatcactgtttgtgcaatatatgaatattttgttgcattgtattcttatataaaaataagtagaaaacataaaattgaaattgctgatgagaagccttgtctcgtgaatgtgatacacttgagacacggatggaactgatcaggagtgccaagtcaaaagcagcagatcttaagccctcactggttgttcctttaacatccaaaatggttggttatatgtaaaagaagaaaatgaaataatctggatgaaacactgggactgtgttatcaaagaatgtctgtagtgatgaggtgaaaattttcattttccagaaacagaactgctcatttataacataaatatattcaacttccacatactcaacacatgtgtatacatttttaggagtacattatgtaacaaaaccatggatttccaatacaatgagaagcagaaatgacactgcaagctagggtccaaagaaaccattaaaaaattttctacatgatgcttaggcagacagctctgctgccaccatccttgcccaagattttacaagctgg

SEQ ID NO: 818 - DNA, 1242 bp, Homo sapiens
aatacatgaaatgtgctccgtattcaacacagctttctgcccgggcacactttccaaaccagggtgcagagaggtgaagcctaattagaatacaaatatgttgctgagctgaagaagcagagatcagagttccaaatggtggtagtggctgtaatttttgagcggaatagaagaaagtagaggtgtacacagaaaaggagctcaagaaatacaaagggattcccttagtctttggctgaatactaagtggtacatgcacaagaaaacatccacaaattctggcagaaaacagctactggtgggttgcaagaagagagataacttggagtcgctgggagagtgtaggaataccaaattatagttctgaatagaaaaaagtacagagagtctctctgagcctacactggcttcagagcctgcctgattaaaaaaaaaaaaaaggctgggagcggtggctcacgtctgtaatcccagcactttaggagggtggatcacttgaggtcaggagtttgagaccctccctttctgtttctctctctctcgctctctctctctctgcctgtttctctccttctctctctgtctgtctctgtctttctctgtctgtctctttctctgtctgtctctttctctctgtctctgtctctctctctctctctctgcctgtctcactgtgtctgtcttctgtctcattctctttctctgtctgtctgtctctctctctcccttcctgtctgtttcggtgaaaccctgtctctagcaaaaaaagaaaaaaatatatatatgtatatatacacacacatatgtatatacacacatatgtatatatgtatatacacacacttatatacgtatacacacatatgtatatacgtatatacacacatgtatatacgtatacacacatgtatatacgtatacacacatgtatatacgtatacacacacgtgtgcatgtatgtatacacacacgtgtgtatatgtgtgcgtgtgtatacacacatatgtgtatatgtgtacatgtgtgtacacacacatatgtgtatatgtgtgcatgcgtgtatacacacatctatgtatatacacatatatgtatatatgcatatatgtgcatgtgtatatatatacacacgcatgtgtatatacacacatatatgtgtgtatacacatatatacacacatatatgtgtgtatatacatacatacacacatacgtgtgtatatacatacatacacacacata

SEQ ID NO: 819 - DNA, 1163 bp, Homo sapiens
tctgttgcccggctggagtgcaatggcacaatctcggctcactgcaaccttagcgtcccgggttcaagcaattctcctgcctcagcctcccaagtagctgggattacaggcgcctgccaccacatctggctaatttttttgtatttttagtagagatggagtttcaccatgttggccaggctggtctcgaactcttgacctcaggtgatccacttgcctcagcctcccaaagtgctaggattataggtgcgagccaccgcgcccagcctagacttgtatcattcttaaagtccagaatcccagaaggaggcatgtgtctctttcctttttttgagaccgagtctcgctctgtcgcccaggctggagtgcagtggtgtgatcttggcttactccaaactctggcttctaggttaaagtaattctcgtgcctcagcctcttgagtagctggcaccacaggcgtgtgctaccaaacctggctaattttttgtatttttagtagagaaggggttttgccatgttgcccaggctggtatcaaactcctgaactcaagcagtccactcttggcttccgaaagtggtgggactactggcatgagctgcggcacctggcctgatgtgtctctttctgtatagtaccagccaaactgagtggatagaaggacattggccaggcctgggtcatgtggcccatccctgagccagtcagtatggccagtggagtgtggttctctgacttgaccagggacaagtgcccgcttttggagaggggcttaagatcagccttcacttaagggcttgaaggagaagagtggttcttcaaatgaaaattggatgctgttatctaacagaaatggatataggttaggcaaaaattgataaatattctaaccatgaatctagatctaattttgaagaaattgactgacttgggccatgtggtgggttgaattgtgtcccccaaaaagatacaatgaagtcttaacctccagtgcctgtgaattttagcttatttatacataaggtctttgcagttaaaattaagatgaagtcatactatattagggtggcccctaatccaacaagtgataactccagaagaagggggaaatgaggatacagacacggaagatggaggcagggattagagttacactgccacaag

SEQ ID NO: 820 - DNA, 1208 bp, Homo sapiens
gagaagagagaagacgtccttattctgggaggccagtattatttatacgaaaaccaaagatatcacaagaaaactacagacaaataccatttatgagtaccagcacaaaaaaatcctcaacaaaacattagcaaatcaaaatttgcaacatataaaaagtgttatacaccacaaccaagtggaatttatcccaggagtgcaaagttggtttaactatttatttatttatttattatttgagggtctcgccctggtcttgccctgtcgtccaggctggagcacagtggcacaatcatggctcactgcagccttgacctcccaggctcaggaaatactcctgcctcagcccccaagtaggtgcgaccacagatgtgcaccaccatgcccagctgttaataattttttaactgatttgtagagacgggggtctccctatgttgcccaggctggtctcgaactcctgggctcaagcgatcctccccagagagctggaattacaggcatgagccgctgtacctggctggtttttaacactcttaattactgtaatacaatgtgttaatagagtaagtgacacagaccacatgatcatctccgtagacaccctccaaaatggcatttggccaaatccaacacgttttcttgatgtaaaaacaaacacaacaaactagcaatagaagagaactttctaaatctgaactacaaaaacactcagctaaaagatggaacagcttcccccgagatcagaaacaaggcaggatgtccactctcaccatgtacatccaccgttgtacatgaggttctagccagggaaattagacaataaaaagaaaccaaagtcattcaaattgcaaaagaagaggtaaaactgtcttggttttacagatgacatgatgatgtatatagaaaatcccaagaaatttacaaaacactattagagtttaacaagttcagcaaggttcagaatacccgtcattaaaaaaaaataataattgtattgctatacactagcagtgaacaatatgaacatgaaagtttgaaaacagttctgtttacagtagcatcaaaaataatacaacacttaggaataaatataaaagaaatataagacttgtatgttgtaaattacaaaatgttactgaaagaaattacatggaaagacatgttcatggatcagaagacttaaaattgttactatggtattactt

SEQ ID NO: 821 - DNA, 1149 bp, Homo sapiens
ctccagcctgggcaacaagagtgaaactccgtctcaaaaaaaaaaaaaaaaaaaaacccataccacctttgtttcccatagtaactctaccaggtggccagagtggctcttattcctctttacatgtgtcacttacgcagagagaagtaggagttaatttgtcttaaattctctacttagtagggttgcttgcactgaagccctagtaatccccagtttattgctgcctccttgagctgacaactgcttatactctgatgctgatcttttctctattccgcaggtctctagcatcaattcacgctttgccaaagtacacatcctgtatgtggggtccatgcctcttaagaactcttttcgaggaactatccggtaagaagtatccttttcacatataccttagcaactggaataagattaggatagactaggacaccagaattttgagcaacagttacaattcctatttttcttttgcccgtttttctttcttctttgtgctttgattctcccctagtagtatccaaaaaatacatggatgatctaggacaaaaggaaaatattaacgagagggtttaaaagtaaagcaaaggctgggcgcggtggctcacgcctgttatcctagcactttgagaagctgaggcgggtggatctcttgagatcaggagtttgagaccagcctagccaacatggtgaaaccccatctctgtaaaaaatacaaaaattagccaggcacagtggctcacacctgtaatcctatcactttgggaggctgaggtgggtggatcacaaagtcaggggtttgagaccagcctggccagtgtggtgaaaccctgtctctactaaaaatacaaaaactagccggacatgttggcgtgtgcctgtaatcccagctgctcaggaggctgaagccaaagaatcgcttgaacccaggaggcagaggttgcagtgagccaagattgcgccattgcactccagcctgggggacagagcgagactctgtctttaaaaaaaaaaaaaaaaaaaattagctgggcatggtggtgcgtgcctgtactcccagctacttgtggagctgaagcaggaagatcacttgagcctaggaggcagaggttgcagtgagctgagattgcaccactgcactctagc

SEQ ID NO: 822 - DNA, 1238 bp, Homo sapiens
tggtgactggcctagctgggtcttagtcttaggtctttgccctccaagtgagtactctaggccttcccactagcggggtagggagggagggctcagactagatcctcacaatggtgtgctctcgtaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgagtgatgtccagggagcaggaaaaggggtgttgtggggagcagagggacatgtctctcacagacccaacccaggttttggaggccggcccccacccccagggaaactccgagtctcctttgggcatagctcttgcgccatgtctccctgaccttgctggtgttggcaggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccaggtgggtcctcacaggagcactgggggaagttgctggctatgggagctggtcccaggagtggggagagtatcttggtatagttttgagagacagaactggtgctgccacgttatgctctcccttcacacagggcaggaatgatatcgccaccgtctccatctgtaagaagtgcatttaccccaagccagcccgaacacaccactgcagcatctgcaacaggtgggtcttggctttgctctctgggaatcccagctgtggtccttctgtagccctagggcaaaacctaaccttgagtttgctaagacatgggtgaatcacccatcgtgtcccaggtgatgtgccctcttctcctgacacctcatccttaggatggtcctgtgagttaggcattattaccacttgtgaaaaccgaggtttggagagatgagttaccttgtccaatatcttatagccattaaactgcagagctgggtttgaagcaaggcctggctgtcttc

SEQ ID NO: 823 - DNA, 1111 bp, Homo sapiens
caggttagctgcccagagtgtgacacacattgtgcccctcttcttggatggcaacgtgtcctttctgcctgaaaacagcttcccgagcagattccagccattccaggtaacagtcttagaacttacatccttcaagctggtttttttttagggctaatctggaatgggtagaggggcagacaagcttattgctggcaggcttgatcgggctctccttcctttataggatggctcctcagggcagaggcggctgattgcactgcttatggcctttgtctgctccctgcctcgaaatgtaagtgagcacatttgggaagtactgttatttaaccttgacaaggtgactccgggctgaaatttgccacaggctaagctgatcttttacttcccccaccagagaagttagttctcatccgtcccggtccctgctgccactatgtactggttctcttggagttcaagtgttctctgggtccattacatggccaggttttctgtaggtggaaatccctcagctgaaccaactcatgcgggagcttttggaactgagctgctgccacagctgccccttttcttccaccgctgctgccaagtgctttgcaggactcctcaacaagcaccctgcaggtactgagatcagactatgtaaggagcctcccagaatcaactacccatgaaatcttatagctcagtactcattctctttttaaaaggagcttgctaataacattaacagggcttcaactgctcaagcactgtcctgggactgcccgtgggaaaagcgtcaagaccacagttgggcagagctttatagtacctaagaagagaagggagcacaaagagtctagttctgccgtcctactccctacagtggggctagtgtggataattctttattggaagtagatgaccctctcttttcaaatggcagcacctctgtattatgagaataccaggctcttatgcaggtgtccaatcattttgtccacaggcaaaaatgatattttccctttctaacagcttctcagggagctctgcacttaaagtgatttgcatttcattgctaaagggaaaatgtgtagcctttatgtcagcatttcctctctccttt

SEQ ID NO: 824 - DNA, 1152 bp, Homo sapiens
ctcgagccaccgcccatatcccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcaggtacggcagacggcgccgcgcgccttccgcatgggggccaacaggagggagcggcctcagtacaggcgccgggcgggaagggaggagcggggtgactttgagagattggtctcaaggctggttagtgagcaccgcgaggttcagagccgtaacaagttagagagttgcctgtgtcttccttaaaaccatttacacttctcatctccctgtagccaattatagggaatcattacattttacagatgaggaaactgaggctcagcgagggcaagaggacttgcgcagggctgcagaccaggcaggagggggaggtgggactcggacccaggcgttcaggtccgaaccgggtgctcacgccacgaagccatgctgtttgtgggaggttgacgtgtggaggtgcatcctcgcagcgtccgctcccgtcgcgtggcatcctgggagtggcagatggccccgcgctctgactggctggaattaagaggagttgaggagacgggccaggaggagctggagatgttctgggtgtcctccttaagactttctctccgtttcttgctaaagttcttgattagtttgctccatgacgttttatgtggcgtttgtttttgtcttcttcccagacccccactttcctgcttttgaccagttcagagatctcttagttcagacagcttatctaaaattagaataaaacgatttccaggcttccgtggagttctgagactttgctcttctaggaaaaaaaaaaaactactaaaaagttattgaatgttaggaggccttcagatcttgggtttaagtaacaatataaaattatctaatgagtagtttttttaaaaaaactttggaaatttcgtatgcttggagagaagtaaggacacatttctcttggatattgagcgtattaacctttagaatatgtaagaaaagaatagtgaatctgctagaaatataatactttgttcgttagcagtattccactttaattcaatca

SEQ ID NO: 825 - DNA, 1178 bp, Homo sapiens
agtgtccgagtcagctgcatgtgattgtcggggctgggattggggcaggcaggcgagctgtaccttcgtccacagggcatgcacatccagctctcagaaattcttcctgtcagccaggtggaagcccgggacaagtggactcttggtggctggactggaaggggaccggcggggaccagcctggaccagctgaccagagggctgcacatctctgctctgcagccgggcaagcagaggacatgcagccatagtcctcactccctttctttggttgtttttcaaaccttcaagatagttactttctgaggttgactgaccaatcgcaaggtgccagaattgtgaaatgtccagtagcacagggcatgaacacagctgcccctccagacacagatggcaccctttttactccctcctgaggccgtactttgctttggtgtagaaatggctcaaacacctggcaagtgggggtggggagtgaggcagcaggggaaaagacacatggaagcaagaagatacgcactgagctgcgcaggacctgggacagtttgaaggcctctctcctttgggcctcacctttctcagggaagccatagagaaatcggcctaggacaagtcagagagaaaagggaaactgccacttatgaggcagaatccacgtcctgttacttccaccaagcagcagcggtagcacagaaaaaagtccaagaacctaatagcctgtcctcttggaagccaagactcatcccagagcccttgcagagacccactcccgaagacaaactgaactcttacatcaaaagagttggggggaaaaaatttaaaacgagaggaacaaatgagaagattgggaccaaggactcaggaagcaaggtgggatatgttcacccatagaccacttagctcccggcatacactccggctgcgtggatcacttttacatgctgggagtcaacttcctattaaaatataaatgctaagactagctcttcctgcctctgcttgagaaacagacaagctgtaggccagcagagagcagagaggttctctatgattgtgtgcggaagtgctggcgggggtaaagcaaaaacctcccttccaggagaactgtttcgaggcttgcagccagcccacagcactgatgggagatggaggaggcttggcaaaaacccaaaagaaag

SEQ ID NO: 826 - DNA, 1186 bp, Homo sapiens
tggtggacagttaatcgtcgctttcaagggaggcacaaggttttattgctgaagttttcattgccttgctctgtgaactcttttagtgccagtgtttgatgaatggttgttttcatggctgccaagagctgttgagtaagaatgtaactgcagacagtcatttccttgctgtgtttgtccaacaaccactgtctcacagctggaaaactcattactcatgagtacttctttcccaggtacaagaacataaagatgtatttattgaacactttttagggcaatgacactgaactgttaatccaaaaatatacactggtcaaacgataagcttaaatactagagaaaatccaaatattaaggagactttaaagatacataccagtcaaatatttctttcatttgtctattcattttttctttctttttttgttttgttgcatctattcattttaaaaatggaaacctaattcatataccataatatttcacataatatgacataaaaattcccagttttatttttatttatttatttagagacagagtcttgctctgttgtccaggctggagtgcagtggtgcgatttcagctcactgcaacctccgcctctcgggttcaatagattctcctgcctcagcctcccgagtagctgggattacaggcacccaccaccatgccaggctaatttttgtatttttcatagagatggagtttcatcatgttggccaggccgttcttgaactcctgacctcaggtgatccacctgcctcagctttccaaagtgctgggattacaggcgtgagccattgcacctggccaaaaattcctagttttaaagtgtacaattcagtggttttcagtatattcagaaggttgtataaccatcaccaccatctaattcgaggacatttccatcaccccaaagagaaaccctgtacctgttagcagtcactcccagttcctccctccttccagtctctggcaaccactaatttactctgtctctatagatttgcatattctggctgggtgcggtggctcgtgccttaatcccagcactttgggaggctgaggtgggaagatcacctgaggtcaggagttcaagaccagcctggccaacatggtgaaaccccatctctagtaaaaatacaaaaaaattagccaggtgtggtggcgggcgcctggt

SEQ ID NO: 827 - DNA, 1167 bp, Homo sapiens
catttatcttatctgttacaaacaatccagttatactcttttagttattttaaaatgtacaattaaattattattgactatagtcaccctgttgtgctatcaaatactaggtctttttttttttcccttgatggaaatccaggatggagtgcagtggtgtgaccacagctccctgcagcctctgtctcccagctaaggtgatcttcctgcctcggcctcccaggtagctggggttacaggttcgtgccactactcctggctaatttattgtaattttagtagagacggggttttgccatgttgcccaggctggtctcaaactcctgggctcaagtgatccgccctcctcggcctcccaaagtgctgggattacaggtgtgagccaccatgcccagcccaaatactaggtcttaagccttaatttttaatgaggaattcccaggtgaatcagaatcaagtggttcatagattacacttggaattgctagtcttgttcagctggtcttcttcagaaacagcgctgcttctcatccttggctacaccttagaggcacctgggaactttgaaaaaggaagcttgcagggcgtcagcttgggtagggcagggcagtggtgatctttgctgctctgacctatcctcccccttcccagaccattgactcagaatctcctggtgggggagacttgggcatcatagggtttaaaggctgctcagataatttcagtttgcagctggagctgagaaccattaagtccttgttactaaaactgtggcctgtggatcaacaatatcaacaatacctgggagcttgatagaaatgcagaatctcagctccctccctggatctgctgaatccgaatctgggttttaatctattccttgggttattcagatatgcatgaaattttgagaagctccacactagtccatccctctcatttaacagaggaaactgagggccagaaagaagtgacttatgggagttagtaagtaccagacaggcttaagtgccccgcctctctgctttttcacaggactcttattttcttgctgacacaattgcatcttttgtgggtacagatcaaactaaatgtcttcatgatcacagtctcgcagggaaagcttagagactcaaaggaagagctgcaggctgcttttcccttctc

SEQ ID NO: 828 - DNA, 1240 bp, Homo sapiens
aaacttaaacctgcccaaaactgagctcctactctttttgccaaacacactccttaagtgatcctcccacctcagcctccttagtagctgggattacaggcgtgagccaccatgcccagctaatatttttaattttttatagaaatgggctttcactatgttgtctaggctgatcttggaactcctgggctcaagcaatcctcctgcctcagcctcccaaagtgctgggattacaggcgtgagccactgcactcggccttatgtctattcttaacacagcagtttagcaaatgaacgcagaaacagaaaaccaaataccgcatgctctcacttatgagtgggagctaaataatgagaacacgtggacacaaagagggcaacagcaggcactggaggagggagaggattagaaaaaaatacctattgggtactatgcttagtacctgggtgatgaaataatctgtataccaaacctctgtgacacgaatttacctagataacaaacctgcacatataccccgaacctaaaataaaagttaaaagaaaaaaaaaacacagcagctagagttccttttaaaatataagtcagccaggcacggtggctcacacctgtaataccagcactttgggaggcggaggcaggtggatcacgaggtcaggagttcaaaactaacctggccaagatggtgaaaccccatctctactaaaaatacaaaaaaattagactggcatggtggcaggcacctgtaatcttagctacttgggaggctgaggcagagaatcgcttgaacccgggaggcggaggttgcagtgagccaagatcacaccactgcactccagcctgggggacagagcaagattctgtctcaaaaaacaaaacaaaacaaaaacaaaaacataagtcagatcatgtcacctttttgcaacacacacacacacacacacacaaatgttgcaatggcttgtttttatgtcactgagagtaagacccaaagtccttacaaaggccttcctggctctatcacattggcacctcccctacccctcaactccctgaccttggctcccactactttcctctcccacgttctacagccaccgcattggcctccttgccattccttaagcacatcagttacactcccaatgcatgacctttacaccctgttctactgcagagatctccacagggctccctacctcaccgccttcagggctttattgaaacatcacctcaggg

SEQ ID NO: 829 - DNA, 1188 bp, Homo sapiens
tggacgaacactcccgtcccgagcacagacgctgggtatttggctgccagcccgggcccgccaggccgggcctggcaccgccaacacctgctcggcgggaacaggaagacctgtgttcgggaactccctccggccacctccccgtatcctcctggccctcgaaggtcgaaaggtggcctctcagggacacccgccgctcgctcggctcctcccctcagccgggagacccaaggaataacagcctctgcgataggagcacgctctaccaatcaaccgtagtcttcgcccacgcctcagccggaggaaattgcattggttgcatcattctcggcagccgataaattgttttcttggattggctaatagcgttccttctcccctgtgccttcgtcgtcagaagctggcgattggttaatcgcgttgccaagctttggacgcggctcgaccattggaggccgcgggcccgcccccgccggctaggtgaaggtgagtgtctcctccagtcgcaacggccagacctgacctgccagctccgggcgtggggtgaaatctcttgattcctagtctctcgatatggcacctccgtcagtctttgccgaggttccgcaggcccagcctgtcctggtcttcaagctcactgccgacttcagggaggatccggacccccgcaaggtcaacctgggagtgggaggtaaggatgtagtgctctggagtgtgagcagctcggggagtggagcggacccaacccaggtcgtggagactgtgggagaagccgaggcccagtgtggcgctgcctgaagagggcggcgccggagaggaggctggatccacgaaggcttcctaaaacctgcccattttacagatgcaggtgtggagtccctggaaaggggcgatgtgtccgaggccgcacaaaccaggtgtagcagccaagacacaaactcagtctttccgattccccattctgccttctttatactgcatcctcctaagaaatgaggctgccggagcttgtagagagaggtagaaaaataggaagcctgataggcttagggttctggttgctaggaaatgggtaaaggagaacttttaacgctagaaagctctgttctgagtcggtaaatatttgagtgaccaccgagtatcaatcagccaccttattaagctttgtagggggagactgaggcttga

SEQ ID NO: 830 - DNA, 1219 bp, Homo sapiens
cctaatcatggcacaatctcagaagctataaagaaaataattgactttgcatggctatagacaccataaataaatatgtgataacatggaagaatatttgcaacatgcttattagtcacatctgttatatagtcagagcttcattgtattggtggaaaaattaggatataaagaaattcagaaaagaataaatacaaataaccagtaaacatgtccaaaatcatcctcattataaaattgaaaccacgctgatttatcaatgtttacccattagactgacaaacattttaaatgttcaaaaaatagtgttgagggaaaagagcaatgacatgcactattggggagactgtcaatgaataaagccttttcttgtattttggtaataacagtcaaaatgcacataataccatttgaccaagcaatttctcctctaggaatctatcctaaagaaatttatacaagttttcaaagataggtatgtaggcatacagttatgcattgtagctttgctttaacagaaaaagagtaaacacatgtattatttttgtagcctaaaaaaaaatcaagttttcattgaaaataaaaatgacaggtttgaagcaggacagtggccatggaagtcgaatccactaaggcgtgtgtaacaagtcacctgctgagtcaacaaaaataaataaaaattttttaaaaacaggcttgagagacacttcacaggaatagaaaatttagatagtttctaacaatgacaatgaagtaggacaggaaaaagtaattctccaaagcaaagtatgtatgtgtgtagtaacttaaaacttcagatactatgagaaactatttttaaataaagaacaatgtggtgtgctacagtttagagttgatctggaaatctggggagctattgatgctccttagttaataaattagtgatttttaaaaatatgaatccccattatccgtagcaaactaacgcaggaacagaaaaccaaatactgccaaatactgcatgttctcataagtggggctgaatgatgaagaacacatggatacatgaaggggaataacacacactggggcctgtcaggggtgggagtaggaggaaggagggcatcagaaagaacagctaatggatgcttggctgaatagctaggtgacaggatgatctatgcagcaaaccaccacggcacacatttacctatgtaacaaacctgcacatcctgca

SEQ ID NO: 831 - DNA, 1233 bp, Homo sapiens
aagtaaggagaaactttaattccaagggatgatcagaatgagttacttttgttttgttatgccttcattgcaattactatgcagtattgataattccctggaatctcacactattgggtttgtacttttagagtgaatatgtgttctcatgcagccaaattggccagtttgatgaattatatttccatttcttataaacgagaaggagatttatatgtcttctaattgcagacatatacatgggaaaagatttaccttttaaaatttcagtattgcatttttcagttgtaaaatttctattttgatcttcttaatattctatttcttttcttttctgtttctttgctgagaccttctatctttccattcattgtaggactgcccatatttcttggttatatggttgctctaatatctttgataattccaatatatgtgtcatctcagagttggcatcttttgattgtcttttctcttgtgagttgagattttcctggttctttgtatgccaagtatttttatattccatcctggacattttgaatattacattatgagactctgggtcctgtttaaatcaaagagaactttttttttttgttttaggaggcagttgatctcaagttctgagctgctttctgtaggctgtgaatctttttttttttttttttttgagacagagttgcactcttgttaccaacactgagtgcaatggtgtgatctctgcttactgcaatctccacctcctgggttcaagcgattctcctgcctcagcctcccaagtagcttggattacaggcatgcactaccatgcctggctaattttgtatttttagtagagacagggtttcaccatgttggtcaggctggtctcaaactcctgacctcgtgatccgcctgcctcagcctcccaaagtgctaggataacaggcgcaagccactgcggccggcccgtgattctattagttcatttttcttttctttctttctttctttctttttttttttttttttttttttttgagacagagtctcgctctgtcatccagactggagtgcagtgtcgtggtctcggcccactgcaacctccgctccctggttcaagcgactctcctgcctcagcctcccgagtagctgggactataggcgtgtgccaccacgcctggctaattttttgtatttttagtagagacggagtttcactgtgttaaccaggatggtcttgatctcctg

SEQ ID NO: 832 - DNA, 1173 bp, Homo sapiens
agagatgcttaaatccaagttgtttctccagctgtcacctcccccaggagatcaggattccactgacgtcctgggcagccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactcccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcagtgatttgtgtttttttttcccacgtcttcatttttctgtcatcttaacatgctcctaaggctgtcttgcacatttcaactagggagccagtttatttgcgggtttaacttaactgtagaggcttttgttatactcttgccagaatactgcctacctggtataagaatgtttaaaacaaggtgtccactctttgctgactcctggaatttaacaaggggtgttcttctaatcctttgtgggacagggcctgtggcagaggggcaaggagggaggatggagcatc

SEQ ID NO: 833 - DNA, 1330 bp, Homo sapiens
aaataggctgggcgaggtggctcacgcctgtaatcctagcactttgggaggccgaagcggttggattgcctgagctcaggagttcaagaccagcctgggcaacacggtgaaaccctgtctctactaaaagtacaaaaaaattagctgggcgtggtggtgcatgcctgtaatcccagctactcgggaggctgagacaggagaatagcttgaacctgggaggcagaggttgcagtgagccgagattgtgccactgcactccagcctgggcaacagagcgagactccatctttaaaaaaaaaattatataaagtttagctttaatatgtaaaatatttaatatttttatattaatatttaaataacattcatttaaaaagtttttaaagagtatctggtggtaaccccagagacttcacagggaagtgtgtggtcagtacatgtaaacagcatagatagtaagttccttgtttagaaaaggaatgggtagttgaggaagttccaaggaagatgtggggcttgctggataagaatttggaagaaagtgagtattttgtgtggaggcccagcatgagggaaagcttagtggtaggaaatagtctcaaagcctgcatggggctagcagctcagaaaatcagattgtaaatcatttgtagttgtggtggttttctttttggcacatttgttaagttttcaaatgggcctaactctgccacatatataatatcggagatggcaaaggcttgtgacggagatatctctcttaagcctttcctgcatcagagaatggctcccacatgtgtcaggctatctcataagtttaagtccttacagacaggctgacacaggcttgtctggcctgaggatattctgtgctgaggggtgtttctccacccctgtgatggatttgctacttctcagagactgtgcaggcacaacttctctgggacctgcacaaggaatttctcctgtctccccaacccccaggtcattcctgtcccaatcagctgctctactactgatgacattaaagatgccttcattacccaggcacaggagcagcagatagagctgttggaaatcccagagcactctgacatcaagcaggtgaaacaggggatggtgatattcagggaagagtaaatatctgttttttttgttgttgtttgttgtttgtttgtttgtttgagacagagtcttgctctgttgcctaggttggagtgcagtggcatgatcttggctcactgcaacctccgccttccgggttcaagtgattctcctgcctcagcctccccagtagctgggactacaggcatgcgccaccatacctggc

SEQ ID NO: 834 - DNA, 1330 bp, Homo sapiens; identical to SEQ ID NO: 833

SEQ ID NO: 835 - DNA, 1187 bp, Homo sapiens
ggaggctgaggcaggagaatcacttcttgaacccaggatgcagaggttgcagtgagccgagattgtgccactgtactctagcagcctgggtgacaaagcaagactccatctcaaaaaaaaaaaacaaaccaaaactagaagcccagtctgtgggctccagagggagagcttactttccaaaaaaggttttaataatttgtgttttgggtattgatatggaggagttaccttttaatctctggcttccaacagttgttcctatttctacattcatagtagttcagctcccttatttgttaagattttttctctgattgccatacttatgaaattcaatgtgcagttccttctgtccacatctgtattcatgtataaatttcaaagacatttcaaaatgtcttattatttatttgcatttcttgataacttttggtctgtatggatgactaagtttttgtttactagggagaagtggataccaaaaaatgtggttctgctttggtttccagtcttgccacgggcttgaaaccaagataccattttgctgctttggaaaagacctattatgagaggcttccatatcggtgagtagcatttcattcttcttggctttttgaagaatttgccatggatcttctgtataaacttctcttgttcgtttttaaccatataacatcttggttccatttggttactcagacactgaagtaagtgactctcaagtcattcatcttctctgagtttgttccctaatttgaaatcactttggaaatccttcagtttcagaatcaagaacttgtatcagttttttccttttcagggccaggcatgatggtgtgtgtctgtggttccagctacttggaaggctgaggcaggaggctcgctcgagcccaggagttcaagactatagtgtgcaatgactacgcctgtgaatagccactgcactctagcctgggcaacatagggagccccatttctttaaaaaattttttaccacaaataaatatgagataatgtatatgttaattagcttgatttagccatcccacagtatatacacatttcaaaacagcatgttgtatacaataaaaaatacaaattttagttatcaattaaaaataaatgagagggaaaatttaaaaaatttttttttgtcttttttttttttttgagacggagtctcgctc

SEQ ID NO: 836 - DNA, 2740 bp, Homo sapiens
gaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtattt

SEQ ID NO: 837 - DNA, 1038 bp, Homo sapiens
tctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcactgggtctgggagtttcttttggctgtgattcaaagtcttgggatttgtctctggctcatatctatgtctgtacctttaagagtataaaagaagtagaagttacaatggttgactcataccccattaacctgccctgctgtcctaaaggtaactttaggttaaactctgggacgcaggaagccaggagtctgctgccattaaatcaaacacattaacaccagctggcaacttggccctggggaagtgccagggttctcgggtgtgtcacgtggtcggtcacatagacctaagataaagacactgggagaggaaaagaccagcaggagaagcgctccctgggaaagcagttttttgctcttgcccaggctggagtgcaat

SEQ ID NO: 838 - DNA, 1149 bp, Homo sapiens
agtcctcttgttttgtgtctgctgtgtgttcttgcccttccattgtcagttctgtacatcctggttcagcttgtctcactgtggtagccccttctgcttgtcttcagccatcttggtttaatcctcataggtcatggatgaatggagccttgctgagcactttgagggcatttctgttgggcacaacctcagaaacgggaagtcttgaggcctgggggcgtgtggtcagtgaggcctccagaggtgggttaggggtgggcacctacaagggccagttgaggggagaggtgcagggattgctgaggagactttgtgagaatgatgtcaggcccgggaagctggtgtggaagaactgagctgtcagaaggagataccaatatcccctttgcagggtggtgatgggcatcaaacatgacgtggaacatgtccccttcatggagggtttccatctaaatgcatctgtgtgccttagggatcagtagttcaggggtggtggacttttttgagtgtctcctaatttctctgaggtgtctttggctctgtgtcaccaaatgtgcctgacctctgcatcccagtggttgctgaaagggaaacagtatattgcgtagtcagatgtcaggagtagagatcttaatgagaaaggccctggcagctggagagatgagaggacctagtggtcagcttatacccagactatctctccactcctccaagagtttgagtcccatagctgatgaaagaatttacatatgggctcccccctgctttcccactgaaaatctattctcatattttgggaaggagcatatgtcctttaactttcaatggtaaacaatctaggatagtgtttaaaggcatggattttggagtcacatatagttggtttgaatttctagcttcactacttaccagctgggtttgaccttggttgatttacttaacctctctgagcctcagtttcctcaactataataacatgggtggagggaggcatgttgaaaatatctacctcagggttgttggaataactgaaacaatgtttgtaaagctttagcacagtgcctggcaagcacttaataaatggctgtggtggtggtggttatatttattatgtgatttattcagaaacttggtttcagtgatctctaa

SEQ ID NO: 839 - DNA, 1216 bp, Homo sapiens
atggtaccccttgtcctcctactccgcggcgctcctcctagccaggcaccctcaggaagtcagctcagccacactgggccttttccctccactccgctgcctcggccgggcaggagagtggctcagcagctctggaacctgcagcccccctgccccgccacagtccgcttctggctgaccccgccggctttcccggcgcaggtactacgagaccggcagcatcaagccgggtgtgatcggtggctccaagcccaaagtggcgacgcccaaagtggtggacaagattgctgaatacaaacgacagaacccgactatgttcgcctgggagattcgagaccggctcctggccgagggcatctgtgacaatgacacagtgcccagcgtctcttccatcaacaggtgagcaagccacccgggttttcagggctggactccagctcctggctcctgcctgcaggggtgtcccacgcccagtctctgctctttgtccagcctctgccctttctccctgcttccagccccaaatccttctgtcagagaaagggaacctgtgaggcagagagttagacagacagacagggctgtctgcagttcagggctgggtattccctgccaggcttctcccgccggcgtcctggaaatgaatccaagtgtttgtggtaattaagactccaagattacgagcatccagccttgggatcttgagacaatcacagcctgcagccggagcctttaaaatgaccagtgtctattcatccctccaaacagactggcctttctaaaggctgctccttccccaggggccgccgcttgtcctggctccctcaccctccctgccaactcccacaaagctcacctcccaggagtctggtcttgctagccagctccacacaaatttctggcctgtaggcactgggatccgggcttgcagaacaaatgccaaccaccagccagcaactggcagggagtagaggagctggacaaggagggagtgccaagcagggagggagaactccagactttgagactgaaccttgggtgataccctcaaccacctaaggtgcctgtctccaggctgaagtctttgcactgatgacaggctcacacacgtgaggacagcacagggctgagtcagcttgacgtgtaggatatttaggtctcctggtctccaaacccctccagtgtgctctcggggagaacacatgtgcacactcca

SEQ ID NO: 840 - DNA, 1196 bp, Homo sapiens
gtaagaaccggttctgagctggcgtctgagctgctgcggggtggaagtggggggctgcccactccactcctcccatcccctcccagcctcctcctccggcaggaactgaacagaaccacaaaaagtctacatttatttaatatgatggtctttgcaaaaaggaacaaaacaacacaaaagcccaccaggctgctgctttgtggaaagacggtgtgtgtcgtgtgaaggcgaaacccggtgtacataacccctccccctccgccccgccccgcccggccccgtagagtccctgtcgcccgccggccctgcctgtagatacgccccgctgtctgtgctgtgagagtcgccgctcgctgggggggaagggggggacacagctacacgcccattaaagcacagcacgtcctgggggaggggggcattttttatgttacaaaaaaaaattacgaaagaaaagaaatctctatgcaaaatgacgaacatggtcctgtggactcctctggcctgttttgttggctctttctctgtaattccgtgttttcgctttttcctccctgcccctctctccctctgcccctctctcctctccgcttctctccccctctgtctctgtctctctccgtctctgtcgctcttgtctgtctgtctctgctctttcctcggcctctctccccagacctggcccggccgccctgtctccgcaggctagatccgaggtggcagctccagcccccgggctcgccccctcgcgggcgtgccccgcgcgccccgggcggccgaaggccgggccgccccgtcccgccccgtagttgctctttcggtagtggcgatgcgccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagt

SEQ ID NO: 841 - DNA, 1128 bp, Homo sapiens
acttaatacatcttagctgtgatgattaacttttgttctttcttcagatatcagttcagtcatccgatcttccttggggaaatacccattaccgtcctgaacccttgtcatccactacttggctataagctccagaagtgacaagacacttcacatcttaaatatgtttcctagtttataattcatttgggcagtaaatgtttgttgagcacttactctgtgccaggctctgtgtttgagtcatccttaccaaatgtacatagccacagccactcagatacaaacatatacgtacacatggcagtaaatggcaaagaggacagtctgcgtagctagacccacactcatatgagtcacttacctgtatccctgctgctctcacagcctcgatttcctctctctatgtcctgtatcagtgctgtcctgggacagaagatcaggttttatgaacaaggggaactgggtttcagtttcccagtgaaagggtagataggtctgttactaataactagcccctgcactcccccagtagctatcaggccttcctcctccactcagaccacatgtgactgtcaccccccaccacttcccacctgcttccctgggacctgttggctatggtggtggctgctgcgcaggcatgggtgccagggtcccagccacagtaggggtctcgggccaagatgcagtcatagcaggatcggtagcgggagcagctggagagtggtagctggatgactccgctaggagcccccacatagaggctgtgctgggagccagataggacagttggtcggcagcgtccccactcatacagatacacagcctctgcccaacctccccactccctcttcctatttcagcaaggctatattaagggtcacagagaagggctacctgcaatagagagatgactagattttccacagactgggactccctgaacacttgtgtctcttcaataatgtgcatcccagagcccaggactacggccttgtggatccagccatcagctggtatggaaagagcagagagttagaccccaactatgggatctgctctcagcaccctgcaagaggcctaatacgaacagctcaggagtcctgaggtccagaacaaggactcagc

SEQ ID NO: 842 - DNA, 1100 bp, Homo sapiens
tccgttagttagtttctctccgccacctcacctctatgaccctctatacagttcctcactgacacagtttctttgcatcatcttctcacctctactgctcctccacagcatctcctcgtcgtcctcatttctatagtcatctgcatcctttttgtagtccctttgccctaggccccgactagagaccctcttccgcttctccttcccctcactgggacctcaacacggcgagagcacccagcacgactcccgccaatcccccggcccaaaggaatgccagtctctatcctcccccgtgtcttcactccgctctactactccgagctccgccgcgccggcccccagccccaggttaccacttttctctctcccacttcgccggcaacgtgagtctcccgcacatgctactcgccttgacctcggaagcaaaactccgggagcggtcgtcccggaaccggaagcctcgaggtttagtcccgcccccctctcctcgctgcttaggctccgcggcctccaagctgtagctatgacggcgcgcgggactccgagccgcttcttggccagcgttctccacaacggactgggtcgctatgtgcagcagctgcagcgtctgagcttcagcgtcagccgcgacggcgcctcgtctcgcggcgccaggtgagccaagggaagtgcgcaggcgcgggtcggggtgggtgtggaggtggcaacgactccccgggtaggtcgcccccagtcaggggtcatactgctcactgtcccgggtcgcttagggagttcgtggagcgggaggtgatcgacttcgcccgacggaatccaggggtcgtaatatatgtaaactcgcgtccgtgctgcgtgcccagagtagtggccgaataccgtgagtggggccgggctcgggctggagggcgggatcaggggctcgacccgctatcctccttctcgcttggtcgcaccggccagcttccacccactctcacccctcttctgccagttaacggggctgtgcgcgaggagagcatccactgcaagtcggtcgaggagatctcgacgctggtgcagaagctggccgaccagtcgggcttggacgtgatccgcat

SEQ ID NO: 843 - DNA, 1180 bp, Homo sapiens
gggcggccctaggagccgcgcacaacagcgcaagcgggctggataccgggagccgattccagggcgcccacagaagcagaatcagaggggtaggcgggggtggggcgtgctgttcggcgctgtggccaaaatccgcccggcgctgaaagaggggacgtgggtgtgagtcccagcatcagccagggaatccgcccctagcttgttcttcgcccagctgggctccaagacgccctctgcgggcccatagctcctaccgcgtccacctgcagagcagaggctcctcaccaaaagccccaccccaccggagagggtcacgcaggtcccggggaatccgcactccttaatcgcgttagccgactttgtaggtgttcaggagcagcctcctagcagcctcagttttcccctccccgccctgctggttcaagcaccacagcctggaatgggagaactgttgtccaccgccccctccctccccgcaccccgcctctgctgcagcggacccgctttaataatgtcgctggaaagtgacacgcgatttattattaaagtaatgcgggcgcagggacgggaaaggtttaataaacgtgctgagatgccgaggattattcaccgcaaataaatgagagcgcgggcggcgttttaataaataatttcccgctgctcccgggggaaggcaggggagggggagggagggggagggaggaggagggggaggctgagccgctgccagaactcccggtttcgcctgcccacgggcttccaagccatccccgcgttttgtgtcctaggttgctcacacccgagatgtgaggttccaggagcgccgacccagagttgccaggcctgaaggcgggagaggctcagtcgcaccctacatttcccacctccaagattttaagtatagttcgcttgaaatccctggaatgcgctttcttctggctcctacccggagatccggagtccggacaaaccggggcaggaagggtccgtcggaccagctcctcccaagccgaggcttccaggtctcggccgggctcttctccctgcttttagctgagccgggctgggcgtacctctctcctccatctagagcagggtgtgaagaggaagccagagggggctgtctgaaaatgaccctgaccccctcctcgggctgtcgtgaggaggagggccgcttcgc

SEQ ID NO: 844 - DNA, 1179 bp, Homo sapiens
catatcctggtggagttattaacaaacatggattaaatcactgggactagagttcaacttcctgatatcaaggctaagtagggccaagggagtgtgtagactctccgtgccacgtgtctccatgaagaggaccacccttgcctggaggcaggagaatggcagagatgaactttcagtgaccatttctagaaccctgagattttaggagcttttgtagaatttctgaatttgtagctggtgactgagtagaggagctaagttccactccagagctccagagtgaaaggtgtgccttaaagaggggaaaggggaatcaattttcccctgaagccccagtacaggcttgttgtgaggatcaaaagagcaggagggtatgtcctgaggtccccagatgcatgtgtgatgctgctactacaggggtcagctgtgcagagcacccccacccccaccatttccattcacaccctttgggttctatagagttccactcctatcacctctcggtcttttggctaagatcaaatgtagtatgtttttaccagcttaacatctgatacatcctctatctgaggacaatatattaaatgggttttttgagcagggggatggaaaaggagcttgcttcatccactcctatgcatcaacctggtattgcaggacctccaggaatggtgcatcaccagggtgcaagagagagttccactcccagagagaggggtgaggggatgagatggtgtgagtagcagacttgggtgccagtgagcaaacaaggaagaggaggcaagaggtgggaggctggcaggaggtggacaggaaggcaggctgcctggagatgggccactcccttgtgagtgtcctcgtgctttccttacagatgctctactcatttggagtatggtatttgctctgcacatcctcataggtcagtgtatctgcacatgtggtatctctctactctgtgataatgcttggtgaccatgtggctgaggatacctgtgtgaagaacaagaaactaggggttgcccatagagcacttgggtgtttggtttgatgagcacagtgtttaaaacaaacatgaaattgaatacctgtaggaaaacatgtgcttctcaggtgcagccatagaccctgccactctactgcatttcactacttgcgtcacttatataatctgcctag

SEQ ID NO: 845 - DNA, 1277 bp, Homo sapiens
tgcagtgagctgagactgcaccactgcactccagcctgtgcaacaagagcgaaacttcgtctcaaaaaaaataaaaataaaaataaaaaatttttaaaaagaaaaagaattaaagaaaagaaatatcacccagcctgggtgacagagtgagtgagactgtctcaaaaaattaaaaaaaaaaagggccaagcgcggtggctcacgccagtaatcccagcactttggaaggctgaggcgggcagatcacctgagatccggagttcaagaccagcctggccaacatggagaaaccccatctctactaaaactgcaaaattagctgggtgtggtggtgcatgcctgtaatcccagctactcaggaagctaaggcaggagaatcacttgaacccgggaggtggaggttgcggtgagccgagatcgcgccattgtattccagcctgggcaccaagagcgaaactccatcttaaaaaaaaaataaaaataaaaaaattttaaaaagaaaaaaagaaaaagaattaaaatcacttctcggccttttggctaagatcaagtgtagtatctgttctcatcagtttagtatctgatatgtcctctatctgaggacaatatattaaatagatttttggagcagggagatggaataggagcttgctccgtccactccatgcatcgacctggtattgcagtacctccaggaacggtgcactcgctccggggatacaaaaaaaaaaaaaaaagaattaaaagaaatatcacctaaataatgcttttctgtgtatttactagtatattttcagaataccattaaatattttgaaatattacccataattcagcaactcacaaataaccacattaacagtttggtgtagtacttcctgcatacaaggatttatgaatctgtgctacaaaaatatttatccacatgctataattcctggatatctgtctctatgacttttcagtgaaagcatgaaagttttccagacatctaaatatatcagcacctgatctttgcaaccttaagtttaggtgcagcgaagagatggaaagctgttaaaactgttaacaaaggagttgttgggttattatgtatgaccttgatgtaaactctgttacagttcaaattctgttacaaatgccattccagtgacatcaagcttatcagtcccaaagatagaagaatagcaccatgatattgctgaacttttcagggcatcactgtggaatagtcaagattctgattatttctttatgctttttttctacataacatg

SEQ ID NO: 846 - DNA, 1214 bp, Homo sapiens
ctatgcctgtctaattttgtatttttagtagagacggggttttatcatgttggtcaggctggtcttgaactcctggcctcaggtgatccacccaccttggcctcccaaagtgctaggattacaggtgtgagccactgtgcctggctgaagatttctttttgacccttctcaccccttgaccgttgaattttgtaagctctgcgtacccatgagaagtctaggtagccagtaattgaaatattaaatattctccaattaaaagtggtatttagttggtcttttaattttgagtctcttttacaaagtccagggaagtttagatcaccacaaggctcagttactctagttttctgaggatagctgatgggcaggtaattttgaaggagggtatcaagtatagataataagccttgttggttatccttactaagttggggattggtcagcttcttcaaagattggagttgagttttcatactgtatcttgatgacttttaaattttcttttccatcatttcagtcagatgccctggatgcagctagaggatgattctctgtacatatcccaggctaatttcatcctggcctaccagttccgtccagatggtgccagcttgaatcgtcggcctctgggagtctttgctgggcatgatgaggacgtttgccactttgtgctggccaactcgcatattgttagtgcaggagggtaagtgctataggtttctccttccacccttttccatcttatacttcggggacattctgcctgcctctgacttttctgtcttaactccaaagggatgaggagggagaccagaagggttttccatttaaagcagagagattttaccaaaaggagttaatagggttagctggagaaggaaaacaggaagagcttctaatgaaaagtgaagctggttttgatattctccaggggaaaatatattttttctctcagctctgttcagccccaggtgtgctgaagaagtaaaggtatctagaaagtcagcaccttactgggctgaattgtctaatgcttagcaaatttggatgtcactggagacttgggctgtttctggagagttgttctctttctacagaaagaataattggttcttgggggtcggctccttatttctctcctagggatgggaagattggcattcataagattcacagcaccttcactgtcaagtactcggctcatgaacagg

SEQ ID NO: 847 - DNA, 1221 bp, Homo sapiens
tagttaatggattagcaagtttttgcagttactgcctatggtggtaaagggggagtaggagaataacattaagtggcaatagtggcattttgatattttaggagaggagagtatgattgtgtgagaggttgagattgaaagaatgtcaggagagttaaagagagatcaaaagagatggaaatgaccaacagtagaatttcttaggtagcaacacctccttttaatataaaggactattattgctgcctatggatagttgtatgattgttaggctctaaaagcataggattaaagagaaaacacaataatgatgcagatcttcagatgttggtatagttgttggatttataataagtacacatggtttatgtctataacttgaatgaaattacacattgtagtactaaacaaggtggtagtagtagttgtttccgcctgcatcttctgattcccttctggttttactttctctttcattctattttctttcctttttgtcctagctattctatctctggcctctgtgatctctgtggcttttctctcattctcgtgatctgttgtcctcttcctcattatcctgttccattgtcttgtccacattgccttctattcttcgttctggtctgtctcctgagactcagggcttcctgttattctcctcctatccccattttgtatcctctgctctcttgatgaatcgacacttttattggtatgaagtgttctttgtgttattatagtcatgcattttactttttacatgtgtcataaactctagaatacattgccctcatttttgcttaaacaagcgattatcttttttctttttttttttttttttttgagacggagtctcgctctgtcgcccagcctggagcagtggcatgatctcggttcactgcaagctccgcctcccgggttcacaccattctcctgcctcaccctcctgagtagctgggactacaggcacccaccaccaggcctggctaattttttttggatttttagtagagacggagtttcaccgtgttaggcaggatggtctcgaactcctgaccttgtgatccgcccacctcggcctcccaaagtgctaggattacagacgtgagtcaccatgcctggctgcgattatctttgaaagagatttaaaaatgtcttttatatttatcttttctgactcagcatttttttcttctcactaggaaatggtgaagaaga

SEQ ID NO: 848 - DNA, 1241 bp, Homo sapiens
ctaggctggtccctgcagcctcgacctcctgtgctcaatcaatcttcttgccttggactcccaaagtgctagattacagatgtgagccaccgcgcccagctatgactcctttctttctcgtctaggttgttcctcaaagtcattcaagctgtactcgccgaaggagcccccgaacggcaacgcctttccccccttccatcccggcaccatgctggatagggatgtggggtaagtgagtctcttggccacttcctaacccttctccaggtgggatcctgcctggaaaggggagggagtagccccctgcccccaataattcctatcttcaacccccattctcatagcctcttcctttacacagcccaactcccatgtatccgcctacatacctggagccagggattgggtaagtggagtccagtggggaagaaggtgctttccactgggtgaaggccgaggtagggggtggagggggcaggctccgctcctactgacctctctccttcacttcctccaggaggcacacaccatatggcaaccaaactgactacagaatatttgagcttaacaaacggcttcagaactggacagaggtatggccaagggaaaaggggctgggagcaggagggccatctgggcaccctatgggatatcttatgacacatgaacacccgttaccatgctccctaggagtgtgacaatctctggtgggatgcattcacgactgagttctttgaggatgatgccatgttgaccatcactttctgcctggaggatggaccaaagagatatagtaagtggcctctggggtcttgctatgagggtgtatacctcctatgtcgttctaaggtctagaagtgggtctgggagtgccaggggatatctagattggtaggggaggcatctgcctggccccttttgcggtccctttgtcctgaagagtttgtcccatctctacagccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtcagcaacccagctggatgtggaacaccatggcacctgggtttgattcccatcctctctcccagtgtatactcacagctgttccccagggaggcataatgtgaactg

SEQ ID NO: 849 - DNA, 1128 bp, Homo sapiens
tcttagtataaggcgtggatgtaggtgctatggaggacactatcttcttctcaaggagcttatggtctaactggggagaagaatctacagaaatgattcctgagttggtaacaaggcaaaatagaaaatgtgatttgtagaacaagagtaggctgtgaggccaggaagctagttaggcagatcatagatcaccttgaacgctaggcttatacatttggactttatctcagattcagtggaggaatgtgggtgtttctgagcagaaaagagacatgattaaaaatagtacttgggcatccactggaggagactagatctctttggggagatcccaacagggaatatgtaggcaaagtggattttcctcctttgggtctcaaagcaagcccttctgtgccgcctcagtctagaacatctggttgggcttttaactagtatggtttctttgcagccaaaaaggagtgtcctcctccggctcctgctgacagcttggctgtaggaaactcagggtaagtatggagacatgagcgagttaccctacagctgttagtcagcagccggctgacactccaggactgtcaactggatgcctctgttgcagggacgctgtagtcagctctagagtctttccctgtttccccaccccttactctgcctatcactaccgggcagtgtcttgggtggtgaggtgagaacggggcatgttcactgccctccagctgattccagtcgggctccaaatgtcctagaggtgccttttatctcctggcaagtcatacctttggggatttctttctttcatttaataacacttcaagtttgctcagtgctggtaatggtgtaacttaaagtggaggaagatgttaatggctaggagtcatttttcatgttcatgatcctccatcctgttctgccaagcatgttcccctccacattgatttcaggttggtgtgagctgggcaggtgagactcgatgtgaaggaggtggggggtattcaaggtcatggccagcctgcctcttggaattgggcagggctcagttgagatccaatttgtagttcagtcaataagacccttttgtgcaggaagaagatgatggaggcagtttgtgcatcccattcttctctg

SEQ ID NO: 850 - DNA, 1210 bp, Homo sapiens
gcctgaatgaacactattgaggttaggaccaataactgaagccgtatcttggatggaaaaggtgtgtctgtgtgtgtatgtgtgtgttctgccttaccttaaatattgataaaaagtgaagaaagatacctcaactgttgagattccgagatcgtgaatgacagaccatagtgaactctggaacagccatttaaagaatgagatagctctccatatgctgagaagcagtgatctctgctgggtgctgtggctcatacttgtaatccccgcactttgggaggccgaggagggcggatcacgaggtcaggagatcgaggccatcctggctaacaccgtgaaatcccacctctactaaaaatacaaaaaattagccaggtgtggtggcacatgccagtaatcccagctactcaggaggctgaggcaggagaatcgcttgaacccaggaggcggaggttgcagtgagcagagatcgcgccactgcactgcagcctggcaacagagcgagactccatctcaaaaaaaaaaaaaaaaggtgatctcgtgctcacttcagcagcacatatactaaaattggaacgatacagagaagattagtatggcccctgcgcaaggatgacatgcaaattcgtgaagtgttccatattaaaaaaaaaaaggtgctgtctaagatatataattaagtgaaatctgcagaatagtgtgcttccatttgtgtaaggacaaaacatggaagggagcctgtggatgcataggctggacatatagagcaccttggcacccacgatgagagtcagagctggtgagagacttagtaccctgtggggttgttttcccttgtggttatgtggccttaaacaaaactctctctaaagtaacgtacctgcttgaagtgcagtggtgagcctgtgtgtgaggaggctatgccctcatggcaacagctacccttggcagaatctgaacatctcagagacatggcctgaggatcctcatgagttgtctctgccacggtgtgggaggcactatttagacctccatttacttgaagcctagtgttcctcaggaattcctacatctgcctgtgggaaaatggtgatagatttcaaaggctctccaaggttcgatgtttccttctgagtgccatttcagcaacataggaatttcggtctgtttctccaaggtgaagggctttcattgccctgttgcctctctg

SEQ ID NO: 851 - DNA, 1499 bp, Homo sapiens
ctgctgcacacacaggcaccagcagggatgccacaggagtgcccacagggtgcaggactccactgatgagagatccagccaaagagctgcccccaggggtatgagggcaccagctgggttctccagggagcaggagttggacctccatggagccactaggcctggcctcctctacacatccccagggctatctggttaattccatcaagctcagagttaaaaggcatatcagcctggagtatttgggagagactggctgcagatccccgccagccaagatgcaagccactcgggacctgatgtcggcagctgtgcctctactgccctgaggacttaccagagggagccctactggccttcccccaccacagcagccctgcctgtgaagctcttgtttctgacatttcacaggcagagaggtgccatcagttcgcctccattccttgccaccatgaccagcctctccctgaactctctcttgctcgggacctgcctgagggctccctgctgcagttcgccgtacttccatctgctgggtgcctccatcgttggttgggtggggatggggcattttctgagctaagctttgtcattagtttgtgaagcacctggtcagcaacctgccccagacctggagggtctttgtggactgaaggtagacaccagccagcatggtggccctgttctgggggagcagggtaaggcaggaggaagtgggtgagctccgagatgatgagcacatgaagcctgtggccccttcgtacctgcaatatgtcaggagcctcacgctcacccaagatcctgcaggggccaggctccatctcactggctctgagggcaggacagggtatcacacatttctcaccaggcctcctttcctatgggcattggtgcctcccagaggtttcttgggctgctggctggtgagagaggacccttaaagaagatcaagccaagctgaccttggaccctgtccagcacagcttctggcacaggatgcttggtgaatgtaccctttctttccctccctgcagctctgagggagcccctgaccttgtagtgggtggaggaggtaaggggcctccctccctaaatctgcctcttctgcaagctacttggagacttgcctagttgtacccacccctccaggtccctggtgctagagcttctgagaagggcctttccctttcctctttgcctgctatataaggcaggctcctgtggctctgctggctcagtgtgggctgcaggaggactgcagactcagctgcaattctgaggggggtttgggaggcttgtgcgaggtctcaggcctgtgtggggagctggtgcctcttcctgcccgtatctttctcttccaagggcagtgctccaaggcagggactggagaagccaaggggagagtctaaaagggctagagcatttttaaaaatagacacagggtcttgggactggggtttcggattgagttgcaagcagggagaaaacctgaaggtcgg

SEQ ID NO: 852 - DNA, 1203 bp, Homo sapiens
tctcttgaatccaggatgcggaggttgcagtgagccaagatcgcatcactgcactccagcctgggtgacagagtgataccctgtttcaaaaaaatgaaaattaaaaaataaaaaaatagttttgcatatgggggagagaacagggaaagaaagggacagagatggaaaatcctattttattgttttgactttagacatccagaaggggttactaactttaaaactttaaataaagttgccctgtgttggggaagaaatctggcaatcctagttactttgaagtcacgctacccttttcactagagtctccctgacccaagagaacagggaagggccggtaggatacacataacagtagctccttttacttggctgaatttaggtatgccaggagcagggtgcagtattaggccagaaatctctgttggtctctgcttgcctctcagtgctaatgtggtcagctctccttgactgtagaccatccagccaaatccaagctctgcttttctcttttggactcaggacccattaaactcagtaacctcattaaattctgcctgcacatttctcctttcttttcttttcttttttttttttttgagacagagtctcactctgttgccaggctggagtgcaatggtgcgatctcggctcactgcaacctctgcctcccaagttcaagagattctcctgcctcagcctcctgaataactgggattacaggcacgtgccaccacgcctggctaatttttgtaattttggtagaggggttttgccatgttggccaggctggtcttgaactcctgatctcaggtgattgcctgcctcggcctccgaaagtgctgggattacaggtgtgagccaccgcacctggccatctcctttcttttctttttcccagccctgtctggtcatcttttatggggtggttccccattttaagccctgagcttctcctcatggcttccccacaccccccactgtttctcttattccattttttttttctttttttttttttgagacagggtcttgctttgtcgcccaggctggagtacagtggtgagatcttggctcactgcaactttcgcctcctgggttcaagcaattctcccacctcagcctcccaagtagctgggattacaagcgcagccaccatgcccagctaacttgtatttttcggtagagatgcggtttcaccat

SEQ ID NO: 853 - DNA, 1203 bp, Homo sapiens; identical to SEQ ID NO: 852

SEQ ID NO: 854 - DNA, 1145 bp, Homo sapiens
gggcatggtggcatgcacctgtagtcccagctccttgggaggctgaggcgggaggatggcttaagcccaggagttcaaggctgtgtagtacattatgatctcacctctgaatagccactgcactccagcctgggcaacatagcaaaaccccatctctaaaacaaaaaacaaaaaaaaattacatacaaaactggtaggagatacactgaaatgttaataaaaatgaggtgatatctatatgcatctaattttcttctgtactttctaaattgagcaggcattacttttattatttaggaaaaaaacgcacaaaaaaagtcaagagtactcattaccaactactactgtatggaatccagagccttccagagtttgtagagctcttcatactctggctctagcccttgtttttattttctgtctaaaatggctaatctcataactgcatgtcatatatgtgtataatatatgtatattcatatgtatgtctgtatgtctgtgtgttgtatatatatgtgtttatgtctgtacacattgtctgtagttaacacacctctgctcatgttctcatcctaaagagtacttagttctgttcgtctaaaactctgctcagcctttaatacctagttacaattccattgttttcttgaaatctatgctgacttctgaacttctataccccttatacctaagggatccgtaagtttacatatatgtaagattggcagaaaattaacctacaattaaaacctcacatttcttaattctctttaatctttaagttgctactttcataattctttttttttttttttttgagatggagtcttgctttgtcgcccaggcaagactggtgcgatctcggctcactgcagtctccgcctcctgggttcaagcaattctcctgtctcagccccccgagtagctaggattacaggcacccaccaccacgcccagctagtttttgtatttttaataaagatggggtttcaccatattggccaggctggcctcgaactcctgaattcaggtgatcgcctgccttgacctcccaaagtgctgggattacaggcgtgagccatcgtgcctggcctgctttcgtaactcttatagtacctgtctggaaaatgccctggcttttctct

SEQ ID NO: 855 - DNA, 1196 bp, Homo sapiens
agaagagatggcagttcacagcaactgcatagagtagggagcagctttcctcccaccatcctaggctggggaccttctttgcttctcacaccactgtggttggctcagctcaagtaagcacgttctctctgtatgctagagctactgacatcatctctactagaattgttttaaatatcttttgatgggaaataccaggttgaacttcaagcatcatggaaacaaaggttctagctgcaagagagtaaagttctaggtgtttgtatgccaaggtttatatgtacacagatccaacacatactgtaagaaagacttgagtacacaaggttttcaggttttaatgcccattgggaccgtgaacaaatgagaagaatgggagcattgtcttgcctcgcttggaaggacgccttccggcatctgatccacatggattcacttttaggatgcagttctttgggggccagatttggctgcagattcaccctgaagagaactatccaatgggcctggtggggcttgggtgcctgccttttttgttggaggctcagacttctagagcagagcaaagttgggaagaatgaggtcttaggattctcattccccagagagccccagcctcgcttctgatcattactccccaagtctgaatctactgtgaaggtgaagttatcaattttttcttgtttgagtcctttaaacccacaaatgtatatgctttattttatattatttattatgtacatatgcctgttagtacttcgtctgtgactaggacaaggtctgtcttgaagcttcctcatccatggatcctagggttctgctgtcctttaaggcgggtgagagggtagtgttgttttttataaacaggttgctgcttttatgttggccctagcatccccagcccctttagttgggcccacctgtattccttatgaccagtgttttggatgaggatggaggcaggtctcctaccttgtgggcagggcctctcaagtacctccatgaaatatttccaaggtggtttcttggtgacaggctctcttcccctatgtagggtacagtacagctgtgagtccacggcctccctcctcccaaggcaggtcacttgcctggccccacagtgataatggtttcttccacttaccttagattgcataatccatctttctggataatggaagctgcctgcctatctg

SEQ ID NO: 856 - DNA, 1261 bp, Homo sapiens
gtttttgtaagcagacaaaaaatttctaagtgcagtcttctctgtataggaaagctaagtcagaattaggtaatattttgttgtttcaatagatactaatattttgaaaaatatagttacttgttattgagtatatcagaagttaattattatatcaatagttggttttttaagtaggctggtgatatttgcctcatggtaggtcactgtggcatttctgggtgttaggatgctgttactccttaaaccctgaaaaagtgaaaacattaaagattcctgtcaaatgggtactaacgattctcttctgtgtgtgagatatgttgctaggtatggcgtgttaaagtataaaacagaacatttatgtgtgtctatgtaataaaacataacatttggaaaagattatgttatatggagttctatactttttcttcaattatttgcttggtctttacactataaagtattaattaacattagggtgtaacatttttagcagtggaaatgaggactggtaaacattatttaataaacatcctaattatatttaatatatatcataggctgggcatggtggttcacgcctgtagtccacacactttgggaggccgagccaggcggagtccttgagctcaggagtttgagaccagcctgggcaagatggcgaaaccctgtctctacaaaaaaaaaacataaaaattagccaggtgtggtggcttacgcctgtggactcagctacctgggaggctgaggtgggaggatcacctgcgtctgagaggtggacgctgtagtgagctgagatcatgccaccagcctgggtgacagaatgagagcatgtctcaaaaaaaaaaaaaaaaaaaaagtgtgcatgtgtgtgtgcttgtgtgtgtgtatcatagcctgaatgagtatactcctaactcatttggaatggtatttcctggaatattttagatggattctgtaccctacgttctttcatatagtaaggtgtatgtactggaaacaatagaaaaaacattttcaaaggcttgatgttttagatcattgaaaaaaattttttatctatgttatttaaagaggcagggtctcattctgttgcctaggctgcagtgcagtagtgtgatcatagttcacggtaacctcaaacttctgggcttaagcaatccacctgccacagcctccccagtagctaggactacaggtgtgtaccacagtgctcagtaatttttattatttttttaaattaattaattttttttga

SEQ ID NO: 857 - DNA, 1214 bp, Homo sapiens
ttggccctacctccctccctgtccccacccctgcagaaggcaactgttggttttcttcctcgattcttttccaagtaggttttgtttaccctactccccaaatccctgagccagaagtgtggtgcttatactcccaaacattgcatacccagcctcccgccgttgagttttagtctcttgtgctgtgtctgctggcacttgggctgaaaaggccactgcctcatctaggtttttggtttgtttttgaaacagggtcgcagtggcgtgatctctgctcactgcatcccaggctcaagccatcttcccaactcagcttccctagtagctgggaccacaggcagagaccggggcgagggggtctctacaaaaagtgttggccaggctggtctcgaactcctgggttcaagcaatctgctcacctcaatctcccaaagtgctgggattacagttgggagccacccgccggcctccatctaggttttcataaatatcttactcatgtggaaacctccagcttgtacatcaaatgtgtctctttttttgacttggtaagaaagcattaggctttggggttggggtaggtctgtaatgtgaaacaacttgtcttttcttctcccattgttataaaacttttaatggccaaacctcagatttgtactttttttttttaagctgctaaaaccattctcttccacctggttttactgtaacatttgaaaaggaaaaaatgtcatccctttaaaagataaataaatacattttgataacatactaagctcagtcaatggtggcacaaatacaagcaataaatatttgatttctagttatttaatgcttttacatttttctgtaataacttattttcagctggcaataaagactatgaacaaaaagaaggaataaactaaaacattccatctaattaggataagcatctaaaatgaggtgggcagcttaagtgtttttaactacttttacattaggctattcttaggtttcacttctgtttttgaagttttcatcagtaagtagtttcaaataaggatgaaaaatatcctcttagagttaagtagtagattaatattttataaaaatagcattatttgtgaaaacatctgtagcctgttatttcccatcttgaaaatgctaacatcgtttatgacatgaagtcaatatatacctcccttcctctctcccttcttctgagacagggt

SEQ ID NO: 858 - DNA, 1165 bp, Homo sapiens
gggctgcaggcattccttggcccagtggccagatttctggcacttgaagcaacagcctgttggaggaggtcctgtaggaatgcttgactgctgcggcttaggcagtttgaagttcttgtgtgctggaggtgtggctgggttttgtctcacagcaaaggcaagtaattgtaactcagaaatgcgttgctgtctggctgcctcctctctattattgtacaccttgaaggtgaggttgattaattcctgttgtggggtttgagggctggattctaatttttgaagcttttttctaatgtcaggagctgactgggtgataaaatgcctatttagaataagacggccttctgacccttcagggtctagggctgtaaagcatctcagggttgctgccaaacaagccaggaactgggctaggtttttgtctttaccttgggtagtttctttaagcttgtcaaaattaacagctttgtaaactgcctttgtaagcccatcaactaggcaggaaatcatgtaatctcgcctaattatacctggggaatctgcctgatagttccattggggatcatcttggggaactgctctaatgccttcttggaggtctggcttgtgaagccggtggttatcagtgtgagattgggctagagaaaaaactctttcctgttcatctggggaaagggtagatgttaggatgacatttaaatcactccaggttaaattgcaggacagagttagatactggaattcctatatataattagtggggtctgatgagaaagagcctaaacactgactgatctgagagaggtctgatagagaaaaaggcacaagtaccctgactatgccttcagctccagccacctctctaagaggaaatcgttgggcaggtaggggagagccagtcatggaacaaaactgtaagctggactgggtgtgaggaggggaggtgataaaaggattatagggtggaggagcagaggctgaggaagatttggagcctgattcagcctggcagaaagcaacatagggagcagtctggggaggaggggagaggtcagatggcttggtagaaaaggaagattggaaagactcagcaatgcttggggttgggactgaggggacaggcggtagggaaagaaggaggatttgggacgaattgcattgggaa

SEQ ID NO: 859 - DNA, 1173 bp, Homo sapiens
gataggatctacaagtttaatgaagagaaaataggaccacatattctaatgtatttctgaatctatagtggaaagttgtttttgtttttgtttttgtttttgtttttgtttttgagacggagtctcgctctgtcgcccaggctggagtgcagtggcgtgatctcggctcactgcaagctccgcctcccgggttcacgccattctcctgcctcagcctcccgagtagctgggtttacaggcatgcgccaccacgcccaactaattttgtgtttttagtagagacagggtttctctgtgttggtcaggctggtctctaactcccgacctcaggtgatccacccacctgggcctcccaaagtgctgggattacaggtgtgagccaccgcgcccggccatgaaaattgttttaagagctatatgactctgagaagcttatgaagtactaatgaagatttgatgaactctcaaacaaatttttgtttgctagaaatataattcttggggaaaaaagggcttctgctgtgagtggcacacatagggcatcgtttgctcttggtgccagaatcaacatcaagagatttcagaagcataattttttggtacttgggcagctggtgatcattggtcctgtagcccttacttgttgtgtaaattagacagttgtgactttttttttttttttgagacggagtcttgctctgtcaacaggctggagtgcagtggtgcgatctcagctcactacaacctctgcctcccgggttcaagggattctcctgcctcagcctcccaggtagctgggactataggtgcctgccaccacgcctggctaattttttgtatttttaatagagacggggtttcactgtgttagccaggatggtctcgatctcctgacctcctgatctgcctgcatcagcctcccaaagtgctgggattacaggcgtgagccaccatgcccaaccgtgacttttttttttttttttttttttggagacagagtcttgctctgtcaccaggctggagtgcagtggcgtgatttcggctcactgcacctcctcctcctggggtcaagtgattctagtacctcagcctgccaagtagctgggactataggtgtcccaccacaccagctaatttttgtatttttaatacagatgaggtttcaccgtgttg

SEQ ID NO: 860 - DNA, 1177 bp, Homo sapiens
actctggccaacatggcaaaacccccatctctactaaaaaatataaaaaattagctgggcgtggtgttgggcacctgtggtcccagctactcaggaggctgaggaaggagaatcgcttgaacctgggaggcagaggttgcagtgagctgaaatcgtgccactgcactccagcctgtgcgacagagcaagactcaaaaaagacaaaaaaagaaaagaaaatgctaaagccaccactgcctagaacatatttacagctcacactgggtaggccatgcacgcacacacctggcacacaccattggatgttttgtgtacaatccaattcagaaacaacatctgcatccggtgcaccctcagcctctgttccatgttctcagggatcacatctccctgcaattcagctgtgcagggtgggtcacaggcactgggtgtgtccttggccttttcctctggggtccagtgggcacagctccactgggctcctgtcctgtggccaatacccagtcgaggtcactacaggcaggggcagagttgatctggaaaggcgcctgaggccggtcagagggtgggctcctgggatgccttgtgggtaggggtgttagaggtgctgcttttggagggttactgggcagggctgtcttagcttaggctctcctccaaaagcaggctctgaaagaatgtgataatgagtgggcaactggggcttaatccttcaggggaccccctaagggcatgcatagaacacatctcagaattttcccactgaggatttaagaagctgggatatttatccacaaggccccatccctctggggttgaaggttgatttgggggttaacttttcagtgcttccagcctacccctctctggagcaaaaaatcctccaaagccccaggggcagaacaatgcagatgcttgaggtaggaggccctcaggccctccaggtgaatagaaccagccactgcacccacagatgcctctggcatgggcagggcaccagcagtgtctgctgtaaggcctagggcaagaggaataccaagtcctcagtgctccagtcctggggatcccaggggcccctgccctcctttctgcctgtctctgtcactgggacctctacactgggagctgcagtctgatgtaacccagcctgggacttcccagcagtccatccttgcac

SEQ ID NO: 861 - DNA, 1110 bp, Homo sapiens
tttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaaactggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggta

SEQ ID NO: 862 - DNA, 1099 bp, Homo sapiens
caagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacct

SEQ ID NO: 863 - DNA, 1167 bp, Homo sapiens
gccaggcttggatttgaaccaaggttcggcagattctttttttttttttttttttttttttgggatggagcctcgctctgtcgcccaggctggagtgcagtggtgcaatctcagcccactgcaagctccatgtccgtggttcacaccattctcttacctcagcctccccagtagctgggactacaggtggaggccaccacgccctgctaatttttttttgtattttttagtagagatggggtttcaccctgttagccaggatagtctcgatctcctgacctcgtgatccgcccgcctcggcctcccaaagtgctgggattacaggcgtgagccaccgcgcctggcctggtctgcagattctttaccccaagcttcacctgaagaagatcagtggttccccgagagtgggtcgtgcaaacatgtgctgggcggacacagcattgagtggcattgaatctcgtcatgagaagtttctttcctttcagttctctttcactccacattgggtcaaggggagaatctccatttggggctcctgtgctgttaacatctgtcagacgctggctgatgtcatttgtttgtttgaccaagagcaaatctgacccaggcttagaatcttgctagaacttgccttgctctcttgttgaacttcatggcattgtttcattgtatgtgtttttccggaatctcccgtctatacctaggaatgctggttttccatccactgtagcataggaaaatgtctttttgaaatacatgtttaagttttaaaaaataaagtcaacttaaataaacacactaagatgacactagtgtaggtgttactcaggttcattggttcacctggccggagggcttggggaatgcagagttaaacgaccccaagtgggactctgtctcttaggcacctagggtgccctctgcctcttgtctcctagggtgacaccagtggctcccaaattccaactgggaaaggagcctggaaaagcatcggcattcgtggtggctgctccccacaccaagtagaagaatccacgttgtcagagagctgctaacgtcaggcggtactggatttttgcaagccctctatttaaaattccccagaaattaaataaggaggctttggagggaggaatgccctagacaaattgtggagtgggtttgttt

SEQ ID NO: 864 - DNA, 1214 bp, Homo sapiens
tatagcgctctttacccaagataggaattatttaaaaagtctagagatgaagtccaaatttgtatattttggaaggctattcaaaggacaaaatatattcagaagtcaagttgataccagtgactatagtcatttcactttactttgtcaagacatttaaacagatggtgtactaaattttattctttttaatttttttttaacggagtcttgctctgttgcttaggctggagtgcagtgatgtgatcatagtttactgcagccttgaacccctgggctccagggatccttccaccttatcctccctagtagctggaactgcaggcatgcaccaccacgcctggcgaatttttaaaaatttttttgtagagatgaggtcttgctctgttgaccagactggtcttgaattcctgggtgcaagtgattcttctgccttgggcctcctgaagtgaattttaaccttttgattgtgaaaaattacagatatagaaaaccacaccagaaattgtgtagcttaagtttagtactttgtagacatagctttgtaatcactacctagatcaaaaagtagaactttgacaggcatcccagaagctcttccgtatgcccatctcagccactgcccttctcttctccacattttatcctgacttttatattatttccttccttgtgtttctttatggcttagtcacccagtattcatctctagatgttagggtttaaacttgctcatataaaacttgggtttttaaagtctcttaacttacaggccttcccccattcctttcttttctttatattatggcatgtgtaatgggggatgagggcaatatcacccacatgggtgcaaaaattagttctttagggccaaaaaaaaaccttatgcattacaatggtttgtgaccttccaaaggccccagtacatgaagagatataacactgtatctatggcattaaaattttatgggaggagggatgatgtgaaaaaaatgtttaaaatgactccttagaggggctagtaatgaaacactgatccatggaacctgggctgtttggcctgttgtgtttccctcaaactgcattttgctattgcatactcctgatgattgaagttcctttctgtatttccttcagtttggcagatgaatccaaaggcttgatcagtctcaagcctgatcctttggcaagacttacaggtggttttgcattct

SEQ ID NO: 865 - DNA, 1227 bp, Homo sapiens
gggcgtggggaagggcttactccgtaagtagctcacaacgtggcttgccagctctgagtagtcgaaagtctcgcctgtgatggtggtgacaggtcctgggggaccaggtgggcctgggggaccctgaactccggataggtaagatctaatactgtcacctgccgaccaaggaacaaagcaaagtcaagcctgtcccaagaggacatgttctccccacggaggtgacctgaagcacatgataacatgcctgccccgccccacacatgggcccaaggctgggccaggagggagcctagacttcccctcactgtccttcccctaaattacagatggagaaactgaggcagaggcctgagctgggtcaagtggcccatgagggctgtgggccagcaagactccagccagccacccatttgacaaatgagcacatgcaaggtgtggtgtgaaagcatgtgcgtgtaggggatgagcacgtgcgccagcctcctccccagggtgtgggcgaggtgaggctgtgtcgggggcagctatgagaaggctggtgttggggagctcataggcctgtaggcctggctctgcagggggaagacctgggcctggacacatagacacacatacacacacacacacacacacacacacacacacacacacacacacacacactcccactgccctacatcgtcccatgtctcttagcctcatttctgtgatgataccacagctcccttgcaaagagactgtatctccatgttcttgtccccacggcttgcggcggccagctactcactctgcatgtactcagagatgtactgctgaatctcctggccagagctgctgatagagcccggaggcccagggggcccagggggccctggcgggcctgacacgtacatggtacttgatgatccccctgcagcaaagagaaagcgtcctgtgtcggtttctccaccctagggtcagacaaacgggcccaggaatagcttccatggtctgaggagggagggtcttctcaggaggagaaataggatagtggcaaggagaagggtccccgagaagagaagaaaggacagcctgtaacagccactgtctgaaagtggcacagagctaggaagctgccccaggccaaaccgccctttccttctgcaacctgctgaaggacccccaacatcgcatcccccttctctcaactccccagcaccctgggtctgtctgttctccatcatg

SEQ ID NO: 866 - DNA, 1236 bp, Homo sapiens
ggtacagaaggaaggactggattgggccagttctgagatggaagagttgaaagaagtagatctaggaccaggactagacccaggttttgtggggatgaaagttattcaatgttgagcttctctttaagaaaaataatacaaagtcataaagaaaacgagatctaaaacttcatatttactagcccaagaaattagatcacaagaaattaatagtgccttagagatagacatacgtttgttctgagatatgttcaggtggtttagcggaaatgagtatacagaaatgctttccgattccaccctggcttcctctctccacctggaacaatcgacacctcctcaaactcccagcattcaaaggagccagtgcccatgaaggctctgaatcttaagcttcattagcttcactgtaaattcaccttcagataggactccccattagatgctcattaagccttttcaatgaaactatccattttagcagtcctaggctatgaatcaggagatatggacctgagcccaggctccgctgccaatactctgtgacactaagaaagtcaatatactctatggccataccaccctgaacgcgtccgttctcgtctgatctcggaagctaagcacggtcgggcctggttagtacttggatgggagaaagtcaatttacttctttgggcttcagtttcctctatggctgcactacacgtttgcaagggtctcttccgattacaataccattcaatgcggaataccttggcctactctatcttcagtgttgccagtcttagtaggtactattgtcattgttcaaactaagaattctgagtagtcttccttgactctattatccccttcttccctccaaatgtaaccaacatctctttttttttttttttttttgagatggagtttcactcttgtctcccaggctggagtgcagtggcgtgatccctgcccactgcaaccaccaccttctgggttcaagcgattctcctgcctcagcctccagagtagctgggattacagatacgcaccaccacgcccggctaattttttaaattttagtagagatgacagggtttcgccatgttggccaggctggtcttggactcctgatctcaggtgatttgcccgccttggcctcccaaggtgctgggattacaggcatgagccaccacacccaaccagtctctaaggtttatatacctctcccatctaacctcacctcaacctgat

SEQ ID NO: 867 - DNA, 1162 bp, Homo sapiens
agtcttcttttgaagtctgttgcaggtttaattgtcagtcctttgtaggcagtctgtccctggaccactctgcaaaaagtctctagccatgatttccttgaatatctcctctgatctatttcctcttcaggaactttggtatgttggactttactaaagtctcttagtgtgtgtctgtctctgtctgtctctctctctctctctctctctcattttttcttagcctctctctctccccttttttttttttttttttgagaaagaatctcactctgttgcccaggctggagtacagtggctcgatcttggctcactgcaccctccgcctcccaggttcaagtgatcctcctgcctcagcctcctgagtagctaggattacaggtgtgtgccaccatgcccggctagtttttgtatttttagtagagacgaggtttcaccattttggccaggctggtctcgaactcctgaccttaaatgatccacctgcctcagcctcccaaagtgctgggattacaggtgtgagccacggcgcccgacctcttttagcctctcttctgtatattctgtttctttgtgtctctgtgcttcattctcgctagttttttcaagtatgtattttagtttactctcttgggtctcatgtactgttactccattaagttttttcaattattcgatagtccttaaaatctgctggtctttatagcatcttcctttctcatgcttctaattttatctttaagggttttgaacacttaatttaagggtcttgaaacatgaagaccacttcatgtttctctcttgacttggggttttctggaccatgctggtgtataaacccaaatctcaaatctttgtgagtgtaggcctattgttacagattagcaagggagactttttccattcagcgttctggaaaagacagataaggctttttgatttgagtgtttgtttgtttttgagagtctctctctgtcgcccaggctggagggcagtggcacaatcttggctcactgcaacgtctgcctccgaggttcaagcagttctgcctcagcctcctgagtagctgggactacaggtgtgtgccaccatgcctggctagtttttgtatttttagtagagacagtttcactgtgttagccaggatggtctcgatctcctg

SEQ ID NO: 868 - DNA, 1220 bp, Homo sapiens
tatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggcccaggtaaattatttctggtttcacttataattactaatggctgagtcaagatgttgtctctgtgtttgcttactcttgatcaagtgtgagacagtttgaagactgtgctaccatacaaagtgaatgaagccagtgactaagcttctgtttgttttgttattctcatggccttcgcttgcattatttgggccttcattcagatgaacttgaggtgccattttgtt

SEQ ID NO: 869 - DNA, 1123 bp, Homo sapiens
tcttgggcattggcaagactgggcctgctccagctacagcaggattctatgagtatggcaaagccagctctggccagacatatggccctgaaacagatggtcagcctggcttcctgccatcctcggcctcaacctcgggcagtgtgacctatgaagggcactacagccacacagggcaggatggtcaagctgccttttccaaagatttttacggacccaactcccaaggttcacatgtggccagcggatttccagctgagcaggctgggggcctgaaaagtgaggtcgggccactgctgcagggcacaaacagccaatgggagagcccccatggattctcgggccaaagcaagcctgatctcacagcaggtcccatgtggcctccaccccacaaccagccctatgagctgtacgaccccgaggaaccaacctcagacaggacacctccttccttcgggggtcggcttaacaacagcaaacagggttttatcggtgctgggcggagggccaaggaggaccaggcgttgctatctgtgcggcccctgcaggctcatgagctgaacgactttcacggtgtggcccccctccacttgccgcatatctgtagcatctgtgacaagaaggtgtttgatttgaaggtgagttgtccaagacaggctgggagccacagctagaagcctgggcaggcctttccccatgacccaactcacgctgccaatgggcaaggaactgttgcattggggtaacagaattttgccatcagtattcttgactaaaatcacaggtattaggacccataggaatttcagaaatgtatcaggaccagtcccttgcttgaaggtgagtcagaaattcttacacactttttctagatgagaaagctgaggctgagtaggggagcaaaggaccccacctgggttgcagagagaaggggctcaggagtttcctgccttctcgtggagggcttctcccccgtagtatgcctagaatctactgccccttgagtacccatattgtagtgagttagaaaagaaaaaaagcagaattttggatcaggggaaacagattaattcccccttgggacctagacaaattattatagagagcctcagcttccccatca

SEQ ID NO: 870 - DNA, 1198 bp, Homo sapiens
tcacatattggggtgctattatttctataggatacatttctaagagtggaatggcaggatcatgggctctgtatactttgttttatttaatattgctaaagtatattctcaaaagtttacagatactcaacctcccactagcaacatatggatatgtgcatttcctcatatcctccacagccctcgttgttactgcttataaaaaacattattatgaaatggtggtgcatgcctgtggtcccagctacttgggaggctgagatgggagaatcacttgagtctggaagtcaaggctgcagtaagccgtgtttgcaccactgcgctctagcctgggtgatgggagtgagacccggtctcaaaaatatatatatatataatgaatccttttgtaaagagatagaataaaattgatattttatgtgtgtctgtgaatggattttttctgcattaattttgtaaattatagttttacaatcattgtttaggggaaagatagccattaagaacgtctggaagagaggggaaaagggaaccgtcttctgaataccactaatgatctttgttcccattagtttgcacagcggaaaggggctggccgtgtggtgcacatctgcaatctccctgaaggaagctgcactgagaatgacgtcattaacctggggctgccctttggaaaggtcactaattacatcctcatgaagtcgactaatcaggtaggtctgggtactttcactccagtgtatatgccacagaccacacattagtgaaagggaacgatataatttttgaaagaagccattcttaacataaagaggcgatgccgtagctggccttctgttggcatggcgtaggtgtttttgctggtgatgtttttttgtttcccctagtttcactctaaccttctagtgataggtacaggcctttgtgaattgcctagaggtgagaggagatgctttggaatgaggtgctcattcacatagaaagggtaattggcacccaaaataaaaatctatggacttgaatctcttcactgtgttgtcaacccccctgagctaattataatcttatcctctaagcctctcctatctgatggcctggatttggagccagccaagaacttgggactaggtatttttcctggtccttgatgtcagcaggtgaggccctttgtctcacagcaggagagtaggagtgtgag

SEQ ID NO: 871 - DNA, 1224 bp, Homo sapiens
tggacacatggcatcatgtatgtgcaacatctctactccatgttggaaacaggtggcaggcaagtcaacaatctagtttcactcaggaaggagaggtcacaagtgcaatccggctagcattttggggctgtgggaaatccccttttgatcactcccctttgtccccaagtcccctgagagcagaaagcaagctgcttctctttcttctcctccctgaaacaggaggaacttgagcagcccccggggccctccttcctctcttgccctcagactcagctcccctggaatattctcccaagtgagaagaaggaagaaacagtatttctctgggtatagtgctgtgggtggaggcctttctttactttccagggaggagaggtactggagaaatcagtttctggaatttaacaatcaggaattcagccataggtaactgcagtattgctaaattagactttctaatttatccaagcagctctgggcagacccagagtctagaggctttagggagaggcaggaacaggaggtaggcagtggagaatagtggctaagagtgtggtttgacagtcatgtggacctgggtttgaatcccaactctgccacttactggtcgtctgacccttgacaaaccactttgtctctcggagcctcattttccatctatgaaatggggagaataacagtacctgcttctccagttgtgaagaggccaagagacagtgcccctatggagtacactaagtgtgccatgcagggggactcaggaatcagcagggccgagctgacagcagtagtgtcttgtggaagagggagagaaagtgtgtgtgaccccagagttcctcgctgacagcaacgcggccctgggcagtggccctgttccttgtttctcctctgagtaaggattgctgactccacacagctctctgtcttcagcagcagggcttccatcagatctcgaggagctgtttaataaccacaacacttccagccattaacaaagataaagacagcattggaaaattgacttttgcctgagcacagtaagtacgaacccaactaaaaatcataacacatgctcccaaacccagttcgatgactgtgacacgctcccacccccatccttcgccgcctcccccacccaccagctgccaccagccccttctgccatggccatgctggtctccttttctctgcctcctactgtcaagcctttttcacactaaa

SEQ ID NO: 872 - DNA, 1177 bp, Homo sapiens
cttttgtggatgaatttgaaagtggagtgggaaatgagaaggcagggacaaagcatttttcctgctcttgctacttactgaagtaatgtggaaggaatacactggggtgggcaccatattgcttcgtatttcctgcttccctactggtcctcagcctagtcatggcttgtcaatccatagctctgtgttttgactgtgatgtaaatttaggatacttaccatttgttaaagtatcagaacagcatctttggaaaggaaaaactttcagcacttattgatgtcttctttttaaagactatggaatgcaaggaggaagagaggtggaagaactagtataacttttgaaacagcacaaaacagggaaatggcttccaggtattggtctgagagccagttctagaccacaacagttttcaccagtgcactgcaaaatgagaagagaagtagaacatagtgactttctcataaaacatattttattaattcacaaggctacagttatttctaagatgatgtttttcctatttgggggtgtaaaggaaagttgtaatgtgattgaaatagtaggtagaagttatttttttttctttacttagaagaataacaaaattggcatccctattttaggcccttcaaattttttttcaaattttacttgaccacaaaattaggaactatagcctgatatactgaattggagagagagaaaaaccacatcatctgtccatgtcattaatcagctgtgtgactttgagaaatcatttaacctctctgcatgtgttcttatatttgcaaaatggaaactgtcaaccagattctatgtatcccttaaggtttttatgaagtaaaataaggtcatatatatttaagggcttagaaactaaagagagctctgttaaaatcatcatttttataaactaccatcagcaaaagtggttaactttgagaatcattggcaaagatttcaacaaaaatctgtaaacttttctattcattaacttgatgaatgtaattggcaaatactataaaagaaagttaatgtagaaaatagaatggagtagagtagaatagaatgcacattatagggtcttcttaataaataatgaaatccatcttctaaaattcttgaatcatttttgacatcttattttgtcatataggcagtcattgtctcttc

SEQ ID NO: 873 - DNA, 1330 bp, Homo sapiens
ttcactaggcacagctgggatcttggtatcagccaggatattcagatattttcaaccaatgccataacgtggcaggttttctggggaccaaatgcagtggttttagtttctaattactgccgcgtatgatatacaatgtattttggacttgaaaaggcacaaacattttgccaacctctctgcttcattattttggttatctcatggaaaagctctctctagagaagtagaggcagggtttatgtaccaaagccttttattgaatgctctgattttgctttccctgttacaaccctcccattcatatggctttcacttccagcccttgtgagcttgtgtttcagaaagaaaagccacattctcttactcttcttcttaccaaaactgcatagctatatcgtgtgtcaacaagcgtttctgatttaggaaatgttatgttattgaatcttgtactcatctgtcaccttcacaaatctataaaagaaatgaatgtcctctttgtgaagtgtgagcatttacctgcatataacataagcttattttcatatgataaattctgtgtgactgaaaatagttaaatattctgtagtataccaaaccaaggagttgctttatttaaaagaaagattgcaggttatttttaaaattttttaaaccttgattgttcttaaatttgtaaagtgaacagaaatggcttggcacggctcatcatttgagccattttacgtatggtctgttgtgaagacaggtgaaaccagtgttccattgataccaagatctgtgcgtatggccacttgattatctgtaaaactgaccaaaaggaattggagaaatcaaaataagtaagcaacaaaaattaagtttataaaatccagcagccactaaataatcatctaccactcatgctttttaatattttattaacttcaaataagataaacatctatttccttccttctttcctttcttctcttctttcttctgcttattcatttccttagtaaatatttaatgtctgtatgccagggccggggatcctgaaatgaaaccaattttatcctcactttcagagtactttagtgtagtagaggacgtatgcataaaaatgtactatggaaattcacaaaattaacggattctcaaagcagctattgaagattccacaactccagttagtccttgctggtcattaaaagggacaccagaaaaacaaataactaataaaaaatacgagttaaatggctataatgcccacctgtttggaaaaaaaaatagggaaatagaaaatggtatatggaatcattacaaacaaattttgaaaagaactaag

SEQ ID NO: 874 - DNA, 1234 bp, Homo sapiens
ttaattgtgacctcgtcttccctgacctgtgtaagcatctctgtatcctttcggttttaatatctgcactgccaaaagcagtcctcatacttgcaaaaggtctgacaaggttctctccacatacattccagtatgtaaagagaccatgaatatttcagtaagagcaagaacatgactccatcagtgtgaaatttcaaatgtgattataaatatgggagagtcctataggagggtccaccagagataaacttcacggaaaacgttccctaacctcctttaaaagaatagaggatggcagattgttccaaaaggaatggcttgggtttttaactaacaaatgttagcaagcctttcttgaattcactatgtattcaaacttctaatatgctttgtgatttttttctttcatttctttctgtctgaggtaaccaggaattgcgttcaaaatgagctcatttgtgatcaggcttaaaagttgcccaagctgaggtcgtttccccccagtcacaaagcagaatgtttttctcaagacttcataggcacttactggtccgtactatctttggaatataattagaagctttgaatccttgaaaagcaaacctgttctcttcatcaaaaatgctaaccacctgtgcccgtggatcaatatcacctggatgtagtgcttgatatttttcccaactcagaagaaaaccattatggtttagagaggaaatgcagaatggcagaatccaccagagaaattgcacttatcgaaacaggccaaggcctgcatgtgttcggataaatcatttagtattgtgtaaataaagctgcagcctttacttcggagggatggtgtgggattttggccgagggaagcaggacagagaaggagcaggaagctatgctaattttcctgtcagcttaagggatccgtctcagcaagaatcttgtattctgataacggaatgctgtacgtgctgaccacatctaagaaccattaaaaagcaaggaaacaaacaaacaacccttttctcattccgacacacgaatagtcatcgagtattacaccagcccctctggtggcttccttcaaaactgttgatcttagctaaagtgtataaccagttaccagctgcacttcgcacggccatcccgtccacaatgcagcagactcttcccaaggccacctagcaagcaaggttgatcggatcatctaaactggccgcctcctgaatatttcactgaa

SEQ ID NO: 875 - DNA, 1155 bp, Homo sapiens
atttagcctcctttgtatccagcaaaaaaagattcagtacccaaaatggtggtattttggtatagtatgtatcttacaaaacggcaaaagacttcaaaagttcctacaattttatcttgggggtttccttttgaagtcgatgtagaattttaccttggggtggattttttgtacttcttggtctggtgtgttttgttgtgtaatgagcatggaggtgtgggataagaaagcagactgaatcccgaggaacaaagcctgccagactgtggtggtgtacttttcttgttgttattgcttaaatgctgcaagagagtggaaaactcttacgaaataatgcacgatgggtagaacttcagagaaaatctctgccgtctaccctgtgcattttcgaggaagctcagagggcatgctgaacctttgctttttgtttctgaagagttcaggggaacctacccataattaattttttaaaacactacctagagagcaccctcttggttattaaacacatgcgctgtttcgatgggatgtttgacctggattgtggatgcttgctgggacgtggcatgtgttgggaggctctgtgctgcctgctgagcaccagcaaagccacagtggcccctacctctgtgggaggccctgtgccaggtgccctcaaagagtagggggcccatgagggtatgaccagggggacctgatttcggctgagaagttggcggggattacaggcctgggcggctccctgaggaaattgcattaaaaatgagatctgaaggcttgattggggttggcccaatgaagggataggagaagggatggggagtgggcagaaggaaacacatgtgtgaaggtcctcaagggaaaagtgcttggcttggacagaggcaggaaatcaggtaggaggctagaggtcgggcagggctccgggagagtgacttggggtgcagcatatggtgaggatctgacactggggagtcatttgagcaggttggctgtttctgtaggagcgtgtgttaagctgctggcagtggggatggtgaaaatagagatgtggaggaaacagcagcggaacttgctgacaggttagatattggcattgagggagaaaggagagtcaaaggtaggtagatggagatgcttcactgagtggggagt

SEQ ID NO: 876 - DNA, 1302 bp, Homo sapiens
cctatctccaccctcactctttttgttgtggtgaactacacttcccttgttccactcggttctgttgcacatgtgattaggcaaggggcagatatgtgatatttattatgagtcttttccacgcagagaggatctaaatctggctctttgcaattgccttcatacatgtgcatacacaccacacacacacacacacacacacacacacacacacacacagacacatacatatgcacacaccccgactcaatggaggaccctcatttgtagaagggtaaaatgggtgaggcggaaatgcctgtatggcaccatggagttctgtgtagccagttctaatcctgggctatttggtaaggaatgaagttggagatagtcttctgtcccttacaaccaaaggaattctaactaatagtttgccaagttttatgtttataataaaaaatgacatgctttttcttttggatttttaatgcttttgaattaaaaatgctagaacatgaactgattcttctatcgctatttagatagagccttgcaagagcagagcacgcatgctttctttaagaacaggttggtttgtggtcgtctgaggactgttttaaggagacttattatacacaatcatcccccacaaatgatttctaaagagaggctggtatgaaagaaggagtttccatgattctgtcctgtggttctggggaattctgaaaatgaactttagatatttttgtgaaattcttattttcatatttttggtatctcagagttttcttttctggcttctgtttaacatactcttctttgccctaaatctctcttatttttgctccttgggacaactgaagaatccttagataattaatagtatgaaatactgcccttttagttgaaaaatgtcacaataatgtaataagataaataaggaggtgtcgctttaacctgtatcgtgtagtctcctctacttactaacacttacttgtattactagaagcattattttttaaatcatggaaaattggtggcaagctgagcatacagttgtttatttctgtttgactgattattacaacttcattatttgatgaaggttctgtacgttttcctttaagacacatagaaattgtgagaagatcctgcagccccgaaaggctacagtgttgatccaaggactctgagccgagtgcagggtttgtacttggacctgcaggctgggtggcgtctgtgggagcagtgtgttgagagagattctgaggctgtatgtgtcagggcctccaggggaaggatgcattgatggattaattt

SEQ ID NO: 877 - DNA, 1213 bp, Homo sapiens
tgtgtggtccacctcacttctcaagcaggtgtctttccagtctacaactcgttgaccacaggtggaattcataagctctgttccctgtcctgcttgggtcctccagagaaagaaatgttgaattatcatcttggtgatggtcaactctgaaagcctaaattttcatgatcaccaaagtgtttggatttaaaagggtggctcactccgtaattccggcactttgggaggctgaggcagaaggatcacttgagcccagaagtttcagactaggctgggcaacaaagcaagacccggtctctaccaaaaaaaaaaaaaaaaaaaaaaaaaaaaaatcaaaaaaattagctgggggtggtggtgtgctcctatagctccagctactcaggaggctgaggcgggaggatcgcttgagcccaggggtttgcggctgcagtgagctgtgattgcaccactgcactccagcctgggcgactgtgagaccccgtctttaagaaaaaaaaaaaaacaaaggtcacaagacattcttggctccgccctgcagagctgcttcccgatctccttttttatttgcttcccaacctgcgggcctcagtgtgactcaccacaccggactgcctggccctgctgcctgccgcccatccttgcggcctggacgactccatgtgcgagttgctggcgcagcgtccagaaaacagaccacaccccaggaatgatgatacgttatagcatttctctgctctgtaagagaggcaccagggtcgtgtgctgggtctggggtttgtccattccacatccggtgctgctgttgactctggtgtcggccgctggtgagctggctgtagctggtcacctctgggtggtttctggggcggtcgcaggctgactaacacaccaaaggtcagccagggtgttgaagctggcacctttcttcctggagcacagacgtcatcttggatcttttagatacttggacttactttatgcagaacattctggatttgtgaattagatggactctttattattttgtatttggattatttctttaaagagatcagagataaaaatatcattgttttgccagtttgctaccaccagcccacacccctcttcccgttgtccaaaaagggggtggttagagttttcttgagtgactgggctattatgattagcagattactaaagctgtgtgattttaacaagacgtaaacac

SEQ ID NO: 878 - DNA, 1219 bp, Homo sapiens
tgggtctttctcatgctgttcttgtgacagtgaataagtctcatgagatctgatggtttttttttttttgagatggagtatcgctcttttgcccaggctggagcgcagtggcatggaaatctgatggttttataaagatctgatggttttacatgctctctgttgcctacaccatgtaagatgtgccttttgcctcttctgccatgactgtgaggcctccccagccatgtggaactgtgagtcaattaactcctctctttgtctcttttttttttttttaaataagttacccagtcttaggtatgtgttattagcagcaagagaacagactaatatacctggtacctggaactatgctaggcactgggaaataatcgtgaaaccaagccaatttcatccttgttgcctagggaaacagactctgttcaccccttcacactaataagcatatgattctacaccagatgaaagttctccaggaaagaagctttgctccgaaagcattaagcacaggagcttcacccggtgctggggccagagaagacttccttgaagaacacaaaccaaaatctataagcgaatcgagtgagcagcaggatgagaactttccagagagggaacagcaatcttgaaaaagtctgggggtggaagggaacatgttgtatttgaaggttggacaggtggtcagtgtggcttgaacaaggagaatgggggtggggagtggaccaagatgactttggaggctcacacaggagccaggccaggcagcacctgctggacatcaggatttgggctttattgctagggtccttgaagagttttaaatggggaacacagtgaagtggtgaagcagaggccgtgacagcctgctctagcgggtggcccaggaaatgcagaggacataggaggggcagattggggatagattggatggggtgctggtggtgatggtgcctctcaagggtgtgtccttggtttccagttcctttaacaagagggatggtgggtggtgcccttcccgagcactgggacactgaagcaggattagctctgtgtctgtgccacttcctctctggggctgagtttcctcatttatatacagagagatggaccttatggcctccaaaaggccattgtccatattcctacacaagaacaattaaagctgcagtaaaggctatcaaggctgggtgcgatggttcacgtctgtaatcccagc

SEQ ID NO: 879 - DNA, 1281 bp, Homo sapiens
gagttgttgtttttttttaaatgggggtagttttctatctgtcatgggctctagcatctactccgctacccaattctgtcatctccaagctgagtttcctcttctgaggcagaggctggagcagttctttttcagttctcatcctctccatcccaatccagtatatcaatcaactctaactcggagacgtctagctggcaatgtttctaaaactttcactggatttctttagacattgaagcaaacatttttttctaagaattgcttctcagatgatgatatcaaatgtatatgcttttgcaagtttgaaaagttcaaattaaccacttttgactaggtaagtctttctaaaaaccatttaaagctaactgggtcttagcatcctcctgtgtatggaagagacaggtgaccgctccaggttgggtgctcacagaacccttttcctgactctcatggaagatggtggaaggaaaatagactgtctcatcaaccctcctgtgtcctctgaagcaatctcagtttttattaaccacctcttctgtgtttctggtagctatttaacctgtatttaatctgtacttcctatgccagcctcaattttatttgatttttacaattattctcttctaaccaatgaagtgtttgtcagtatgccccaaagcttgctcttttgtgctcccttttgaataactttctatccagaaaaagagattatttgggacttgagatttgcagtgataccaacttatagcaatgatgtactttaagggaactacccaactatgttgtgatagaagaaagagaaaccttcactttggcatttttttttaatcactgtttatttttctgtttgcggcccaggaagcagtgggaggtggtggcagatatgctttgcatatggattgttatgtttttatttgggcaagtttaatcatggaaaactcaaaaagaaggggggaaatggtcagtttaagccaaaagaaactttctaaacaatgtataggtacacagcaaaattaaacaaatccaacaatttctgaagcttagtgtaattgagtggtggttgttattcaataaaattattcccaaaagtgtttctcctaagagtgcagttcccatgagtcacttcctgaacccattgaccaaaggtggacagagacaatcctgtagaccttgacattcagaaagatgtgagctgcttactgatcatatatgcatacgtttctttacagcagaggaaaccattgtccacaaaactgatgttcttttggggttttatgt

SEQ ID NO: 880 - DNA, 1239 bp, Homo sapiens
tcctagccttccattgctatgcactgaatgaggactactctcgtgtgtgtgtgtgtgtgtgtgtgtgtgtgtgtgtgtgtgtgtgtgtgtgttggatctactaacatgtttagcaaatggctctgacagggtggccatgagcagatgagaccagctcttgcttggttggaagccacactgcagtttgcagtttagcctttggtgtctcagtggcttcttgcttattccatgctttttctatcccatcctctctctgtgccctcctgcaatggcagccttggcacaatgcctgggtgtcctcatccttgctttactctggaaagtgtggggatggagaggatggtgcatttccagtgcttccttacctgtcaataacaatggtggccacctgggtcccagcacttggctggtggagagatttttttcattatggagctaataaagggtccctacgttttacattgattaatgaattatcacccagacatgtgcagatgaaatgtcaatataagaaaaatcaaggtatttgggaaacatgggcataatcaggtagttttgctaaaattcctcttccttggtctacataaagaagacatgggtctgtcatagaatggggacattagactgaaaactgggacaacccccttccttattttatagagactaggagttaaggggcctgcctaagattgcagtgataaagaactgaaccctaaatcagctcccactaatgaaaccctgctttccttgtatcttttaaactcagttctgcatccaacttgagaagaaaaaaagcttctttccatatcaagtaccatatgagttcatttaaactgcaccttgcagaaatgcattgccagaaagcaccagtagcctcctatctgcaagcagagtagtgctctgctctggggaggggtcattggaaaccataatgcagagtgggccccctactccatttcccagcaaaaggctccagctggagggatgggttgtggggcaacctggttcctgctaactgccagattgaatgtgtgggctagaatgcctgcacatttagttaaactgggctcagcatgcttgtcctcaaaatgtccatcctggtcacagcacacaagatggctattggtctgcttttaccctaccctgtactatacatgaaaattccagttattaacacactcaaactggtggagcttgttcaccctaggaaggggattgtatatatggcaggcttccctg

SEQ ID NO: 881 - DNA, 1363 bp, Homo sapiens
gcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcctctgacacgtggctcaccgctgtcatttgggggatggaatgaacagtcactgttcta

SEQ ID NO: 882 - DNA, 1220 bp, Homo sapiens
atgattatttacatgtctgtttcaccagtaaaccaggaattccttcctgagctattgtacctccagcacctagctcagtgcgcagccacagagcagcacaacacatatccactgaataaatgaatgcataccagaatgtggatttgcttattcaatcctttctaagtgcctgaccagattttggtgagggagagaaactgacagaaccaaagcacaggagtacccaggagaggccgacttaggtgaggaccagaatctcaatgtgcagtggtcagaggacagctatgggtgctggaggggcataccgtgttagagggacatgcccctgtaaatttcctcaggttatctgagagaggaatctgtaacctggccaaagtctgggttctttggaaatggaataaaggggcagggagattttaatggctgaaaagggaataaataaaagcatgggctactaccttggaggacaaatttaggtgggattatactggaggcactgagccaggccagcataaaagggctgaggggaaagggcagaatgcaccttgaacttgacaaaaccttgcaaaatgtcaccaacctattattggctgactcttgcccatcctcctcctctccaccacctaacatgcaggcagctttcactgcttttgcagcccgcctgacatgcctacataaattgagtagaaataatttgtgtttcagtggaaaagtatgctttgtctacacagcacacacttgagggttatctgattctagccctgttcattgtctgtgagctcttttgtacctctttatattgtaggtaactaactgataaatatgcaatctttgtcttgcctggtagagattcaattatctttcctcctaccctgtggaaaaatcagtttgcctccatttacatattcatttcaatattgtgatctagaaatgtatgtttttcaattctcttctgaactggttataacatctgcgtggttccttcattggtggagtaaaataaaatctttgacctatattcattttgatatctgcaggagagtcatgattttatttatttatgaaaacccttttaacaattgtgattgcctctactccaaaattttggttgctttattaaaaagaagcttcctcattttgtatctggaaagtgattgatgatatttacattgcacattcattattattgtgcaacagaaaaagcctgtaacaagagactc

SEQ ID NO: 883 - DNA, 1196 bp, Homo sapiens
tgttttgaagctatagatcaattttggaagaattgacatctaaacaatatcaagccttctgacccatgaaataagatatctctcttcatttatttaggtcttttatagccatatttttgtagttttcagtatcagatctttacatcctttgtttatgaaatctctgagtacctcaaattctgaagtttcaatttctaatagttcattggtggtatatagaaatggagttgatttttgtatattgatcttgtgtttttcaaccttgctaaactcacttatttgttctagttgtgttttgcatagattttatattaggatggctctaaaatagactttttttccaggtctagattagctctgcttctaaagcatgacttttctggggtgtctatcaaatgacttgtgcattcaacaaagtttcttcattctggatggttgaaattaaaacatcccccagccttgtaagagctttggtagtatttctttagttaattttgtagagaccctgtatgtatgtatgtacagcttagaatttagtcagagtatcaagggtgccttcatagacatttctttgtctgtgtattttcctcaaattccagctgccactacttcctcagattctgatctctgttcagtgagatcactgtgctttgacgttcccctctctgtcccacagttaagaaagcacctccagacaaaaacaagtgatcatgagacttgctttgtttgtttctttttcctcagggtttacagtgcttgctgcctgttgtctgtctaaaaactgttgcttaataattttgtccagtttaacagctgtttatggtggcaagatttgtctagtcacagttactctttcgtagtcaaatatgatttttaactcaatcatattgtttttagctctgtagtccagttaaatctcaactatgatgttgtgagttcactggaagagtaaaattttaagcaaataatgatgtataacatgatcttgtatatattcattttatgaaaatgattttaaaaaattaatttcaaatgaatgctgtcacattgatggcttattaatttactaaacaaaaaataattacccaagtcctatgacacttgtacctcttttaccaaatatgtttattctgcctagttattggatatatttactgtggacattttattctgtttctttttaaatactttggaag

SEQ ID NO: 884 - DNA, 1273 bp, Homo sapiens
cacactggagtcagaaaaacagaaattaagattaaggtttaggcatagaaaattaaaggatcctggaggagcagctagttttcataggtacaaaagtggtgaaatggccacggagaagggaatcagtacatttctgcagcagtggttgcgctgctttgaacagatctccgttatgtagaatttaggatgccctattgctgtctttctagatttaaaatgagatctttgaaccaggaggagatcttcatctgagacttgtctttctaaattttttggatggccatcaatataaaatgccacccatctgcagttaatttcttttcctcatcatgtgattaaaagtggtgattcagtgggaactgggaatgtttttagctggtggtagaaggctgcctacactgggcactgttttagattctcatatcatttaaacagcaaggaggttcagggaagaataaccgtagccttgggtaatccactagggcttttgtgagtaggagagctgatacctcacattcttagcaggtgaaaacttgccatgatggaaacagatagtgaagagttactgacgtatcccaaattatatgctgtgacataaattcccagcatgcccagccctgatttctgagttcataagtaattctagtgaaccttagtaggaattctgggtaagaaaatgaggttgccattggtcttgtttgcatcaccaagaccagacatccagaagagcccctcaccttgaaaagcagacagattttaaattaaccccctccttcccactcaccttcatctccctaagagttttggccatttaattccacattttgaaaggaatacattggtgaaatttgggaagagaatctgtgctatgcaatgtttcattaaaatcttcagtttttcaagtctctctaaaaataatttgtagatctatacttgatgtattaagtcagttttttttcacagcgggcctgtggctcgcctgcatcagaattgcctgggtgcgtgttcagaacaggttcctggatctgagccctttttaactgaggccgactcttggagaggggcaccagaatctgcatttgtagtgtataccacatcgtggttcaactgaaattggagaaatactaacctgagattttgttgaagttcacacacagatcacagcccgccctctgcaggtgtcccctttgggctcctttaggaagagggcttccatgagaaggtgaccccataccttgccctcttggtcaatgggattggggctccacctggc

SEQ ID NO: 885 - DNA, 1143 bp, Homo sapiens
ttgctgatttacagttttatctaatttcactgtgtttaaaagcacattttctcctgtagtcatgtgtttcctttcttttgactagagtcatttgaacagttctaacagaaagatgatctatattcattctccatctttcctattaaatttgtttaacacctaatttgacatcaacaatctggctacatttgaaccaatatccagacacaaaagcaatttggctgagacaagttagtttctgataaatgcttcagtgtgtgtgtatagatttttctcctttaccattttacacagataatctgaatcagaaaatactgcaactccttcctccttttgtctgccttttgttctccaaaagtaagtggaaattacatttccaagaaaggaaatgaaataattgcaggcccaaggtctgcaaaatatgtgttgaattgacagtgaaaaggatccatgtgttgacagacacagttgttagatgccataaaggcagatgtgaagctcaatttatttctcatcttgcttgttcaatgactgcttaagagacacattccagtttaatttatctacttaaagctctaatacaaatactgtggactgctgtattaacttctaaactttgaaacctaatgctcgattattcggttcttgacattctttagctaaataaaataactgatgccgtgtattttcatattgacagtaatttaccaaataagagcacctttctggaaaaatctgtttcttaagtataattagactatccagattgaatctgagaattctgtgtatgtataggtaattatttacccagactggcacacttcattcatttaatgtttaaaccttttaatgactaaaagaattttaacttaatgtagttacatgtaagctttaacagtttgtatcatttgtcagaatcccctgaaactggcctagcttccaggaatgagaagggttattttcagtgctgtgtctggctggctttgacttattagtaagtactctgttacactaaccacattctcttactttatagacttggcctgtcaaagcactttgaagtcgggtcagcaattaataagtaaagtatttcctttgcttttaaaaactgtctttgcattctagtagttaacacttctattt

SEQ ID NO: 886 - DNA, 1207 bp, Homo sapiens
cagccaaccacgtaaaatagttcagtcttgtgccaattatctgaaagcagttttctaagtaaaggatgaaatgtaaaactggaggagaagctgagtgtgtagaatgatctggcacagctggcccagtgctggtgtctggcaagagagtgaagagcagagctcttggagttgggccctggcactgtcacccagcttccccacacttcttctcttcaagatggggatagcacctgccttatctgacacatggggttgttgtcaagatcaaatggaataaagtgtgaaaatactttaaaatgcaaggtctgagtgccacctttgaaaaagaatccatttttatgactttcacatcaccactaattatggaaagaataagcaaaaccaaactattactagagaaaaatacaatgccataaagaaacaaaattagttttagaaagaaaaaagttgaaaacttcttaaatcataagcaatcaatgttccatacgtactttcgttttcagaatatcactttgtgctttttctttcttcccatgacttcctgcagttacacattatttaatgtcaattcaaaatctgggaagcaactgaacaaggatcagtggacaactgggttttttgctggtaaatcttgaactgtgtagatacagtgctgaatgacctggtcaataacctttaaaacaaattgtcactgcatgcttgaggacagacgtcttcccctagtaccatcagggctttcctgaaatgtcacaaatggcgacattttgtggtccagggttcaaaaggcttgtgcagtcagagggcagcctgagtggcatggcagcacttttgggtatgcctaaaggcagggcatttgtttgaacgtcacagcttatcacctgaagggttgacctgcagaagtcaagcctgccttgagaatattaatttaaccgcttattttcaaaattccttggtggtagtggtggtggtggtggtggtggtgctagtgtggttcaaattagtgtcttagtgcgtatggactggcactaagggcatgtgtatttcacagaaaatctgcgctatgagagctgaatgccttagtcagctttgtacatgagcagcaaacctctctcttctctgtttttaaaatttgaagtaggatcttatttttaaattgtttttgagaggaaaggattataggttgctgttaattaactctcattttttt

SEQ ID NO: 887 - DNA, 1421 bp, Homo sapiens
gtctctacttgcttgagatttttgttattttgggggtttgggggtgctttttgttttgtttttgccaaatgtaacatgaaagcagatgctgcagctttagtctgttatgctgatttagtaaaaaaaaattttttacatatattgcttgctttcgatgcttctgtgaaatttttttctaaagcttttgtgcagctgtatggtaaaaatatggtgattaatttgaagagcttacattgaaagacaatgtaataggaaataaatgtagattgcagttggtcaagaattttgtagagaggataacaagacttaattactgaaaaacagtaacatagcattttgaaatataatcttttaaaatattgatgctttccttttaaatggaaatttaaattttataattaaaagtttaaacatttatgataattttcctcatcagttctcccataggaaataaagcatgtgaaagggtatttaaagttttggaggactctttttaaaatgactgtgttgataactagtttgggctggttttgttttagaaaaaacattttcatgtaggagtattctgtgaaggaaaggaatcatgcaaaatatactttttgctttggcgtcttacagttgtaaaggaatggtgatcattctgaatacttctgtagtgagtattcattaagaaaagaatgacaaaaatagtattcatacataggaattgggaccagttctctgaaaatgaagatatactcacactgggtccattttacgggtcccagtaacatttgactgagggaaaacaagtaagctcgactgttgttggggtaccttaatggtttcggtctgttatatacctataaaatagacaagtatatgtttgtccctttgtaggtaactgctatgatgattgctatatagtgaaactgacatgagtttaaaactagatggagcagcttttattgctggcaggaaaaagcatggtgtaatattaaggactggggcccaggtctagactccaggactccataaaagagtttaagttcaagcccttccattaatgaactgtgtaagcataggcagttacaaaaggacccatctctaaaatgggaataataatactttacctccctcacagtattgttgtgagggaaacaatagcataactgcaaaagtgctttgaacagtaaaaagatatacaagtaaaaggcattatttatatgagtaagaaagacatttttgaggggagaaaagttattccactttaaaaatcaatagccaagtctcatgccttttgttactttagtaagcgaaaatttcaggtactaaatacctttcttagccaagtttataacaaaaacatctcagtatacttcattacttatttaagcgtgatgtcttttttttttttttttttttttttttttttttttttt

SEQ ID NO: 888 - DNA, 1187 bp, Homo sapiens
cctgagggaggcgccggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcccagtttgaagggcggcccatgccccagctcacctccatcatcgtcaaccagctcaagaagatcatcaagcgcaagcacaccctaccgaattacaagatcaggtgagctggaggtcggggagggggcctggctgccgggaacccgggcctgggcgggacgct

SEQ ID NO: 889 - DNA, 1222 bp, Homo sapiens
cattaacaggagtttggaaaaaaaattgattccaaccttcatggatgacttggaggtgttgaagacttcagcggaggaagtcactgcagatgtggtggaaacagcaaaacaactagaactagaaatggaacctgaagacgtgactgaattgctgcaatctcatgagaaaatttgatcggatgaggagttgcttctcatggatgagtaaaggaagtggtttcttcagatggaatctattcctggtgaaaatgctgtgaacattgttgaaatgacaacaaaggatttagaatatttacaaacttagttgacaaagcagcaaaaggggttcagaggattgactccaatgttgaaagaagttctacttgtgagtaaaacgctatcagacagcactgcatgctaaaaaactatttcatgaaagggtcaataaatggggcaaacttcattgttatcttaagaaattgccacagccaccccaaccttcaccagccaccatccttatcagtcagcagccatcatcattgagaaaattgaggtaagacccttcaccagcaaaagattacagcttgctaagggctcagatgatccttagcattttatagcaaagtatttttagattaaggtatgtagactgtttttcagacataattctattgcacacttaatagactacagtatagtgtaaacatcactattatatacacgagaaaccaaaagaaaatttgcaagttgctttactatggtggtctggaactgaacccacaatatcactgaggtatgcctgcatcgagttggtgaaagtcaaaaattcccctatcaggcttaattcggcccgtgtttaaggcagctctgctgttgatgatttttacccagtgaccgagcctcgtagagtgggctcccttgacagagactgccttttggagccaatcacaatggaggtttactctgcagctgaggataattttaattctgttatgaaaattgtatgagtaccatgcaatagaattccaaatgttttactttgtagtaggaaaaaaactagtaccagaaaataaacatgtaggctttttagggaaaacttcagaggcaaaagaatgcagagcatttaaactttgggcaaacaatagtttccccctgtgtgcaccatactttctttcccagacccagcaacatgacccggggatgtgcacctgtcctttctgtctggtgagaaacttgctccata

SEQ ID NO: 890 - DNA, 1315 bp, Homo sapiens
tcaggatgctttgcatgctgtggcagctccagctggtagcgatggttctcagggcattggaaagaggccaccaggttctttagtttctactgggatgacatcgtagcccagtcccagttccttaggttctcagtccccttttacttccctccaccccacatggttttgaggattttttttaagccttttttggggagttgggagaggagtgagaaatgtgtgttgaataaacagattcctgctgttatcaaatgctgtctgctcttcatactttttcctattctgatgttttttcagatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcctggagaagtgtatggtatctaaactcacccaccaagatggcaggtgtggccctgtagcaggatgctaattaagtgggaaaatagaaaccttttgcacatgggtcggattttcccctggttcaccagagcatattcatattaatgttggggaccaactctcctagagcatttccattccctgtgccacttaacacgatgtctgtcaccagctgctatagtattggcagtactctagtttagggatgggcggtactttagcacggaagcttcccttagtattattgagagctacttcctgcgatgctctaggaagcagatacagttatt

SEQ ID NO: 891 - DNA, 1471 bp, Homo sapiens
tggctaatttttgcatttttagtagacccgaggtttcactatgttggccaggctggtcttgaactcctgacctcaagaaatctgcctgcctcggcctcccaaagtgctgggattacaggtgtgggccactacgcctggtgaatttttatattctttatagtgatggggttttgacatgttgcccaggctagtctcaaactcctgggctcaagcaatcctcccgccttggccttccaaagtgctgggattacaggtgtgagcgactgtgcccagccgcatgtcttacaattaagtagagatgggttttgccaggccaggctggtcttgaactcctgacctcaggtgatctgcctgcctctgcttcccagagtgctgggattaaaggtgcgagccactgctccggcccatactgaagtttttaaaaagcatgtgaaaaaaaaaatccccaaaggatcatatgcttttttattttatatatttttaattgttcttgttgctgtgtagggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtaaaattctatttcctagaatatgcttaagtgttcacctgtaaaagtgaaattctgatggataaatatcagggctgtattgttattttccagataaactggtctttcatctttccttcagtatcatttgcagtgacttcgctgtcaaaagtttgccttcagaataccaccatccaaaacataaataa

SEQ ID NO: 892 - DNA, 1220 bp, Homo sapiens
aaagacatagagaacaaagaagagaaagaaagaaaatatactagtgggactcatttaattggtcccatgaattgctctaaaatagttttacataagaaagacaatttgctttacataattctactggataacaaaataattggtggaccaatacaagaaaacaggtggtatgtgtgttgcctaagtccaatagcattttttttttttgagatggagtcttgctctatcgtccaggctggagtgcagtggcacaatctcagctcaccacaagctacgcctcccaggttcaagccattctccggcctcagcctcccgagtagctgggattacaggcgtgcaccaccacacccagctgatttttgtatttttagtagagacggggttttgccatgttggccaggctggtcttgaactcctaaccctaagtgatccacccaccttggcctcccgaaactgctgggattacagacatgagtcactgcgccaggccagaaatgtattttttttttaagtgacagaaaacaggttatacgtaacgttaaaaataataaaatggaagactatgccttcggggctcatttctatagtttgttgctagagaagtttctctgaacgtgtggagcacagggaaaaaattggtctataggttgttgggttatagacccttccttttatattcatatgtatttatatgagaataaacatgacccaaatattctacacttaatattttgcaatcaggaaaaaatgacttgatagaagtatttaccctgccaggcgtggtggctcacacctgtaatcccagcactttgggaggccgaaccaggaggatcatctgaggacaggagttcgaggacagcctggccaacatcatgaaaccccatctctaccaaaaatacaaaaaattagccaggcatggtggtgcacacctgtaatcccagctactcaggaagctgaggcaggagaattgtttgaacccaggaggcggagtgagatcgcatcattgcactccagcctgggcgataagagcgaaggctctgtctcaagaaaaaataaaataaaataaaatacaagtcaggcgcggtggctcactcctgtaatcccagcactttgggaggcagaggcaggtggatcatgaggtgaggagtggagaccagcctggccaatatggtaaaactctgtctctactaaaaatgcaaaaattagccgggcatggtggt

SEQ ID NO: 893 - DNA, 1376 bp, Homo sapiens
gtctcaatctcctgaccttgtgatccacccacctcggcctcccaaagtgctgggattacaggcgtgagccatcgcgcccagctgaattttcactttcatacaagtaaatttggactttttgatagctgttgatacaaatattaacttgaagttaaactgcatctctgttttaggcctgttaaaatagacataactatttttaaggggaaaggaaatctaaaaaataatctaatagtgcatatgtgacggtaaaaaaattaacgtgtccagttaaatgacagaacaagtagttcatctgtaatcagttgaaattaggttactataagccctcaatttgtattatgtagttttaattagtacagaaccttgtttcttactatgtaagttagatatcaaagttcattatatttcatactagatttttttactcctaggatttaaagtggtgggtctttgaaaggtgacccctagatctaaattctagtttcccatttgtaaactctgccagcaccacattttagttgtaagcaaggaccagtgattatgtctttggttttgttagggctcactcaaaaaggtagtctggatgaaataagttgattctcattgcatcacaaagactaatgatgagtttggtgaatcctgttaaaacaactgatcttaatgtgtgaaataaaacctattcaaatatttaagtagatagtggaaggtacctaatatattttacaattatgcttatagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggtatgttggagctattagcttttcttcctagaaataatagtctgtgttacttttctccccccttaatgaatagcttcatcttggtatgcattggttaatttcaataaggtaaggaattaaagttgcctaatggactgggaaaagttctgaacaagaaatctcagaatattttgtttctagttgccttctatgaattctggaccaaaccatataatctctttcagacccagtttcttgacatataaaacaatacattgccagtgctgctcgaagtgtggtttcatgactggtgtcatctgtaaactatctggtctgtgatgaaataagtatagagtagaaaagcatatgcaaagtttcttagtagcaattttattgtacattttgtgtgtttttactctgataaaaagtgagctttttctgtttcatttttgtggt

SEQ ID NO: 894 - DNA, 1149 bp, Homo sapiens
atgaagatttttcccgtgggatttccccccatttacccaataattcattcataataaacagttgttgaacctagataaaatacacctctgtctcttcccatttgcctataagtttcttgccaagatgtgatacagcagctcaaagaatgcttgccaagtcactaatagtctttgctctctctagttcagtgactttccgatactgtgtaacattcagggcactatgtgaacttgtaagtgtgaccatactgcatgttttatggtgacctggtccagtactgcctttgttaaagcatctgtcatcagtaagagatgataagttttttgcacaacagtgaaaaccccacctttaagcatatgattacgcttaataaatattttattaaaaggagaattaaagacctaaaagggaagaagttagactgttctagttctggtactgttgaggcactgatgaggataaatgatcatgcagaggtctcttcataattgaccccaatggagtcatcaagcatttgagcgtcaacgatctcccagtgggccgaagcgtggaagaaaccctccgcttggtgaaggcgttccagtatgtagaaacacatggagaagtctgcccagcgaactggacaccggattctcctacggtaggtttttttccccaaaagcagtgaggtccatgttctctcagcctcgagagctattgacctgaaatatccacaaaagggagcccactcttgaagcaagcgtgcagatgatatgcaaatgggtgaagctgctgtggggtagagggggtggggtggggagccaggaaccaattatcagagacaggcaggcctttttttttttttttgagacggagtcttgctctcgcccaggctggagtgcagtggcgctctctcagctcactgcaagctccgcctcctgggttcacgccattgtcctgcctcagcctcctgagtagctgggactacagggcgcccaccaccacggctaattttttgaattttagtagagacggggtttcaccgtgttagccaggatggtctggatctcctgacctcgtgatccacccgccttggcctcccaaagtgctgggattaccggcgtgagccaccgtgcccggcctagagacaggcaggccttaatgaaact

SEQ ID NO: 895 - DNA, 1183 bp, Homo sapiens
ttatgtaatagatgatgtgttgaatcattcacaatttttaaaaaattagtttgcagatactcctcagacatcagtgtgttaagttgtggttatcttaaaaatatcaaagactaatactggaatatgtattctacacatatatcatttatttctttgatctttctatttgttgtaggtgtgttgatttctggttttctattctgtgattaggctctgcttgatttttgtgtaaatacatatgtgattttttttttcttgtgtttgctgaagattttttctttttcttccaagtcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttac

SEQ ID NO: 896 - DNA, 1180 bp, Homo sapiens
tctaatcacctctgaggagcttcatcactgttcatatgaatttcatgatacacatcagccatgttttatttgtatgttttgttttatagatcagcttatgagacagacattctcaccatttggacaaattatggaaataagagttttcccagaaaagggctattcatttgtcaggtaacactctacttgaaatatcattattactcttatatttgattcattcctttcacttatgttctccagggtatcagtgtttgttattttagtgcttctttgcagtatagaagtttaagctacctacctaatgtactttagaaaaaaaataccaacttgcaggtgtaaactgatgagtttccatgttatttattgtgttaggttcttaaaaaataaaagacaaaaccatatcatttttctttcttagattttcaacccatgaaagtgcagcccatgccattgtttcggtgaacggtactacgattgaaggacatgtggttaaatgctattggggtaaagaatctcctgatatgactaaaaacttccaacaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagagtaagttgtttgggtttttccagtatagaaacgtatggttctgacaaaataaataaaagtgtgttttcctagggagaatctattttaattatatacattgagctatttggcattatgagcattatagaaactaatctaacaaaatatgatttatgaggctaagaaa

SEQ ID NO: 897 - DNA, 1185 bp, Homo sapiens
gggttattcttttaatgacctgtatatccccaacaactggtttgattcctggtacatactggatattaataagtatttggtaaattaatttattgctgtatggttttattctgcttaattaatagaaaaagtatgttctaccaaggagttttgctgtcggtagaccatgtattccttaaatcaaagatgtcaaagtaaccatattgcaaatcaacttttgaaactggttatacatgagatttgatgggaggaatttgttgatatcttacagtaagggaaaaaaaagtaaaatttttagatcttcatgtttatctttgtcctcttacagatcaaacaaaagactttgttagtatgtgctgtttccttaaaaactgtaacaacttgaactttgcaagctcagaagcatcacgtatatcaaacttgaaaggcacttatggaatgttctttttctccaggaggccttagaaatgactaagtgcaatgctatcctttgaatttagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtaataaaacctttcgtagatccaacactgaaatgttatgtgtctcagaaagtagcttagtgtctgagcatttgcatttgttcccttgtgctgggctagctatagcaaatcactgcaaatttaatagcctaaagcagcaaaagtttatcatcttacaggctttaggtcagaaatccaacatggtctcactggggtaaactcgaggtgccagcagggctacattcctttctcggagcccctaagggagaatttccttggccttgtggctccttcttccatattcatagccagcaacattgcatttgtctgaccatttttttcatgttgacatctcatctgaccacaaccaagaaagtttccccaattttaagaatccgtgtgattacatggggcccagccagttaatcgaggataatcccccccatttcaaggttattaatttaatcacacctgcacattccttttgcatgtaagctaacaagttaaaagaatcgaagaacatctcaaatgcagaagcagaacaacttttaaat

SEQ ID NO: 898 - DNA, 1213 bp, Homo sapiens
gccaagattatgatagtgcctttcttgttgaagcattgtgaagattaatgtgttgacatgtaaaaactctttgagcagtgcttggcaaagtagaagctttcagtcggtagtagtcattcgccattattagcagacatgaagaatttacagtggtattctggcttgatgttgtggcttttatttagaaaaaatatactttactttgtgatttaaaacttttttcttgactttaaaaaatcacttgtatttatgactttcggggacatctggagggcataactttaacatatcatttaattggtagcctcctcttaagttatcattaggtggggtggtagggttatggcattcataaccaccattggaaagaaattttttttttaattaaaaaagttagtatgtatttagtgatacagtttttttttttgtttgtttgtttgtatataagttctgagaaatgtacgaatgactctctgggttattttattatattagaatgacaatttatactattgattgcccttaaagtaaggctccaatggataagttgatagggcttttgagaacaacttgcttttactagtgtgtatatgtgatcatttaataggtgtggcaatccaaaatgatctatttttggaggactgagctgtcgcagttgtatatgttgttcatatgtttataaaatagcattttaaaacatgatttggcatgaaattattttctggcatcaagaacaagagagagaaggggcctcaaacacttttttttttttcttcctgttggtagacatgaaccatccctctctgggaccttctgctcagccagctggattagacttctgaaaatattttccaaatgtaaatattacccaaagatttaaaaaatagcctagcatttacatgcaaagcgaaatgatcttacctgtttggagtttactcatggaggggaagctgtccatcagtatacattctaatactgttttccaaaacaggagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtagaattaagctttcagaacatcacatttcttacatttttgtttatttatt

SEQ ID NO: 899 - DNA, 1253 bp, Homo sapiens
gaagcttggccttggggcaacagaccaagtctagcacaaataataaagagtgtatgtgtgtgtggcgcacagtcacgtttcacgtacaaatgtgtaaaactcggcattcttacaaataaaacataccacaataacagatttttgcaggtattacagtgcaagcacgctttggcaatcaatttaaacattttcttgtggaatattcttccatgctatggtttggtttgtttctaaagccccataggatgtggaaactaagtcaggacagattttctgggggtatcctctggttgctcttccagatacttcctgacttcctggggcttggggagaggtggatgcctgctggggccatttgcagagcaagaacagcttctcctgggaataagcaggcctccactgacctttgttggacgttctctcctctccctccttcccatctgtctccgtcttctctctcccacctttctgcagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacaggtgagttggcccgccagcactatgctctctcttctctgtagccattacatttttttggccaagtgaaaaggtagtgagatctctaattgtaattggatgccaggcatacagcttcatagtttttgaaattcttctttgggacctggtgcaccagaaaggccgatcattaagaatgatagaattcttgtgcacaaagtaacatttttcttaagatagtacgcttttatttaagtaaatacatgcttttttttttttttttttgtaccactgacatctctggcatttagaatatagggttgaaatttggatactcaagatttctgattcatttattagagtttgagtttctctccatgatttccttctatgcagtgagcgggacagaacaggccccctttgtggccgagtttaaagttctgctttcagaatgttagttgacgatgagaagggccacacagggactgagttttgttagggatcaatttctctcttcaaggagaccccgcatactg

SEQ ID NO: 900 - DNA, 1209 bp, Homo sapiens
ggattacaggcgtgagccactgagccccgcctgaaatcctactttccactgtagtaacgtagtatttataaatgtagagcaaaacaatcatgagaagacttacccagcccagtgacttaattagtgtaaagacgatacaggtagtcagtccttcataaaaatgctgaaaatgtgtgtttcttagttcatgttagttttaaatttgcttataaatttataacttctgtaaggaatgtaattttcagtatagaaaatggaaggttttgaaaattactatttatggaatgtttatataggtaaaacattattttagatgttggtaatacaaataatagctaataataatagttaaccctaattgaatggcagttaattttttatgagctgcacaggtattaactcatttaatcctcacaggaactctataggtaggactggtttttgtttttcttgtacagacagggaaacgtgcccaaggtcagctagccaagtgacagagcctcgtccatgacctcaggcagcttgtgtcagacagagtgtgtgtgctcagagcaaatttgagaaaagacacagtctgtagtccaagaaaagtaattctgttggtcagtagagtaatagttatagaaatggtcttttgttacctggttcagacttaacttaggcttatttaaagtcattttttaataagtaaactttatttttagttagaaaacatgttaatgaagttgtgatacagtctgaactgtttgtgaactcactattttctcatcagattggttttcatttgatcagcttatggtctcaggcaagccctttaaccactctaggttttgattttcttctctttaaaaactgaatttgctagttttataaaccttttttttttttgctgactttgatatggtttgtgagtaccctgttttgggatttttttttttttttttttttttgagacggagtctcgctctgtcacccaggctggagtgcagtggcgcagtctcagctcactgcaacctccacctactgggttcaagcaattctcctgcctcagcctcccaagtagctgggactacaggcgtgcgccaccatgcctgcttcatttttttaatatttagtagagacagggtttcaccgtgttagccaggttggtctcaatctcctgacctcgtgatctgcctgcctcggcctcccaaagtgctgggattacag

SEQ ID NO: 901 - DNA, 1204 bp, Homo sapiens
aagagattctcaggatggaggctgtgtctgggtgaaagagctgattagaaacccaaagataccctgtgtaaataaaagatactagggaagtcttatctatatcatcaccttattattgctatggtgtaatttgattttctgagatactgaattttctgagtaattttttccatctagtgcgtataggtttgagtcttaaatgtttgtcttctcctaaaatcatgttttcgttttaggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgggaggtaaagctctgcctgttgcccctgcatagttctgactctgccttcacttgcagtaagcccag

SEQ ID NO: 902 - DNA, 1223 bp, Homo sapiens
gccccctagactgagacgttggcgtttgaaatcagccaatggcaggtctacactggagcttcctctccgcctccttcgcctagcctgcgagtgttctgagggaagcaaggaggcggcggcggccgcagcgagtggcgagtagtggaaacgttgcttctgaggggagcccaaggtagggaggcgaggcgacggtgtgcgggagcgggctctccagggacttcccgggtccgcaactggcagggccgttcgattcgcaggggatcccgtttcgtttctgttgttttccctttatttttaggagtgcccggggcgacgggaccccgggagaggggaaagggaacagtctggggtccgggcatcgctgtgggccgggctgggtttagggggacggcggtgcgggctgggccggtttgggcgcggcgggggccggatgatggggcgagtccggaccttggcgggcgagtgctcggcgcaggcgcaagcgcagagtctcctcgcggtcgtcctctcggcccctccctctggggggacccccagtgccaggctgtcagtgcgcagccccagcccgcgggacccctggggactctgggcgcctgttctgcagatgaccggttctaacgagttcaagctgaaccagccacccgaggatggcatctcctccgtgaagttcagccccaacacctcccagttcctgcttgtctcctcctgggacacgtccgtgcgtctctacgatgtgccggccaactccatgcggctcaagtaccagcacaccggcgccgtcctggactgcgccttctacgtaggtgccctcccgccctgctcctgccctcttactgtgttaacgattctccacgtgaggagcgtttcttttccagtgttgggtagaggcgtctgtcggtggggttatttggacagttctttagcttttcaggagcatctgccttgaacctgtaccgttttgggttggagacatgcagacattggaaactccgtctccccttttctgttacacgcttgtggagtaactctaaactttctgaaaatacgatcattatatttgcaacaatactgttttggctgccgtattgaaaggaaccgtttaggggaaatgtatgtttaccctcagctagcgtgttggctaggataaagcagccctcctttaatttccagacacaggagtttagtgaccacttgcttttttatgctgttttttggtttgttta

SEQ ID NO: 903 - DNA, 1358 bp, Homo sapiens
atatctgtgtatttggaaaaataattgtaacgtaattgcagtgcatttagacaggcatctatttggacctgtttctatctctaaatgaatttttggaaacattaatgaggtttacatatttctctgacatttatatagttcttatgtccatttcagttgaccagccgctggtgattaaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaatgttggatgtttttgaatgttggtaattaatataatttacttaaaaaggcttgtgtaaggcaaaactcgtcatcacaggcatgttgggggatgacattttacctttaagtccactctccctcgtttaattgtctcctctgatgtgtgttggggattcagtcctgcataaagtgatttgttggagttcagccatttccctcatgcccccttgtgccctctcggtggatcagcagggcctttgagccaagtgtgcagcttcactcaggatgggcagagactatgtggcagcctctggggaccttttggctcagtgctttactagtgccagcgcagtagtgcttaggtagcttgtgcatccccgtgttgatgtagtcatagtccacacagagccaaataacagacccttctgtacttagccatcaaatactaaatcacagtgaagcccttgggaaggtaaataatgtaatagccagggactgatggtattagttctttagtgtgattatgtgcttctaaaagtccctaaccacttggttgaggacagacc

SEQ ID NO: 904 - DNA, 1651 bp, Homo sapiens
agtgataataggtttgggccagttgtcaggagacatgtggcttgggagatcatgtttgaagaccttgagttaccttttgaccatatctcagtcatgattttaatcacatcctcagccatttgaattatttagcatctttttgaaattacatattttactcctaattatatgacaaagatatataccatgaaatatttatcatgtaattatgattaaaatgtgcagtctccccaaagatgtgaataatcactttaagtattctatatttaattaaaggagtctggtggactgtgctgggtcaacttggttaagctgagaactacatttcccagcatccccttccctatatgcttctgagttagagctggccaaaaggggaacacacacggacagggaaggctgaagaaacatggtggccattatcttttgggtttctttgctgtcaggtgcagtgatggatggttgcagaggtgcctgatagagtttagcttctctttactcattggctttgcccaagggcccgccaccagatgcttggctacagacccacaggacattaactacacagcctttcctcagatccttttgcagttctgtggtggctaaacgtgcctggcctctctgactgcttgtgtttgccgatcctccagcaccccgtccagaccttcatgcctccccaacagctcctcccacaactacaaggtcagattcctataatcaagccctattccatgagcccctgggactctgcttccctgtctgaaccctgactggatacaaggagtaagagagttacaggcaagtgtgaatgaagtctgttcaaaagggctttcgttctttcaaagccttttgcttttaaagttgttgtgaagggcaaatgtttagaggtggatgaaggtgctaaaacctttcagctcctgtggtctctagaacataatgggagtctttttcatatgaagatgatccttctgaccctccaccatttctgaaggtggatttgtgctgatcagacaaattcagatttgtgaaacctaaaacagaatcaatactcaccgcgtgtctatttctgtccttcatcccttcgtctctctttccctctcatgacccttatgcttctaggacttgtggtggggattttttattagaggtgcaggttttttattttttattagaggttcctagacaaggaatacagcaaatccatgcccttgacctcactcaggaacatgccttaatgtgcttagctcaccagtcaccacagtactgtctttgtggatcacgttttgttttcctaaaagattcattcatttgtccatccatccatccatccatccatcatccattcacccattcacgcattcattcatctcttgaacctaacatttctgacctagccttggacatagcattgagtttaggaagctgggctctatagtggacctatcaggcttgaatgcaggtgctgtaactccctagctatgggatttgggatcattatttaacttttgagccttgcgttcttacctttaagtggtgataataacaatgcctattgcatagggttgttatatgtattaggtgagatagcagatataaagtgattaacaccatgcacagtgttaattgctgttattgttattattcaaagatg

SEQ ID NO: 905 - DNA, 1228 bp, Homo sapiens
tagctggggacaaccccagatgttcaccggggacagggacattaagtaactggtccatgattcacacaggtaattagtgacagagcctgaatttgaacccagatagtcttactcaagagccctttctctgacctgtggtccttctagattctccgactcttaaagtcttgtaataaatatcttacacgtatatcttatggtttcttcactaagaatgtcactctgtacctaagtgatactaacttttggcaaacaataattccagaaaaccatagaatgtatcatcttatggtgtgaagtggtagtaagggcactggattaagaactaagacttggtcccctgttaaccttggacatgtttcttacctcccagagcctctgttttcctcattggcaaatgaagggtgatgactccccttacatacctggctgtgtggttctaggggtcaagcaagacagtttgaagagcctgaaaagcactaaacgtttatgagcacataaattattatcactatacataggattgtgatctattttgttccaaatatgagaacataacactttttttgaatttgttaaatttgttaaattttcttcatttttttctctctctctctagactctctctctctatgtatatatgtatatatactgtctctctctgtctatatatatatacttgtactgctgaacttaaacatatacatatacatacatacatatatatgtgtgtgtgtgtgtgtttaaatttaagttcaggggtacaagtgcaggttagttacataggtaaacttgtgtcatgggggtttgttgtacagattatttcattacccaggtattaagtctagtacccattagttattttttcgaatcatctccttcctcccaccctccacccttggataggcccagtgtctgttgttcccctctatgtgtccatgtgttctcattatttagctcccacttataagtgagaacatacggtatttggttttctgttcctgtgttagtttgttaagattgatggcctccagctctatccatgtccctgcaaaggatatgatattggagaacctgacacttaaagggcctcttttaagcctcatgcacatactttaattcaataaaggttttcattgataatagcctgtcactatcacccaaacagaaaattagtggatcttcagctcccttcccttcccttcccttcccttcccttcccttccct

SEQ ID NO: 906 - DNA, 1173 bp, Homo sapiens
ttcattgatcaacactcaggtggtatcagctgaatctctcatttaggaagtcaaaactttcgtttaatacttgtttactgtaaaatacacagaaaacatacattacacaaaacttaccattttaacgatttttaagtggttttaagcatactcacaatgttgcaagcatcactaccatccagctccagaactttttcatcattcctgctgtggtttcgatgtgtccccttcaagactcaggctctaccttaatactgccaatgtgacagtattaagagggggagcctttaagaggtgattaggtcattagggctcccccttcctgaggggcacttaggcccgcataaaacacgtctcactgtgagcttccttgcccttctgccttccgccgtatgagggcacagcgtccctgccctctggaggatgtggcaacagggggccatcttggaagcagagagcagccctcaccagacaaccaaacctgctggtgccttgatcttggtttcccagtctctagaactgtgagagaataaatttctgttcttcataaattacccactctcaagtattttgctatagcataatggactaaggcaatccccaactgaaactctgtacccattaaacaactcattattccctcctccccccagcccctgacaaccactgttctctctctacaaatttgatgactccagatacctcatatgagtggaatcatacagcatttgtcctttttcttttggtttatttcacttagcataatgtctgtaaggcttatccatgttgtcgcatatgaagaatttcctcattttttaaagctgaatcacattccattatatgtatgtaccacattttatccattgatgggcacttggcttgcttctaccatttggctattgtgattactgctgctatcaacatgggtgtactcacttactgcttttgtcattcacttatgatatttgtttagatccattagttcattatgggttacaaaatggtgattttctaatattttctctttaccagttttcaggataatgaagtgatagatcagtattccacaaaggtgacccattttttttttaaaccaacttttttttttctttaaatagctcttcgggttggcttctgtatcctttgacacaattccaggagccttttatcact

SEQ ID NO: 907 - DNA, 1248 bp, Homo sapiens
tagaaagggaaacagacccaagggattgcacagttattaaaagtataattgctctccaggcaggacaaacaagaatgagcactgtcggtgtgatgtgggttcaatcctgcttttgtcaccactcgtgggtcatctggacttggctccacccattctccttgcaggttcaccatcttctcttctccctgagtgaggtataagctccctgaacctgaatctgactcccaggtaaggagagggcagggcttgtccactgggctgtactggcatttgaggctagatagttctttgtggtggttgcgtgggggtcttacactttatagggtggttaagagcatctctggcctctaccaactagatgccagtagcacacccctagctgcagtcttgacaaccaaaaatgtccccagacattaccaaatgtcctctggggagcaaaatacctcctgtttgaaaattattggtctagacatctgtattttgtttgcttggggctaaaaacatagtacctttttaaaacatgaacaccaaacaatttgttttactctaatagccctgataattctgtagcagcattctcgttgtaaataaaaaataaaaatgaaaattcaaaattcagacttgaagactagaaaaaagaccatatgtgtgtgtgcatgtgtatgttttgacaaaacctagaacttttccaatggaaatctcaggaaagggcatggactgggagtcggaagacctggatccagtcctaggctgctgcttcttgctggccagtgtcttggtgagtcaagtcccttgagcagtgagattttttgtcattaatgtgaggaagatgttatagtgattcatctctgagggtcctggaaggactgacattcttaataattgaacagaagcgtaatgagtggtacaaatgtggaatcagggaatttccagtgatgggcaaattcacaacatgtgagaaaggtagggagggaaagagagagagtgggggcggggagggcaacagtgcaaaaaaggtgcaagaatggatgccccaaattcactgcgggttgtgaagtcactccaggacctggtctcaagtcagctaacggtttccacacagtcccctggaggcccatctccatataaggaaaaccagagggaagattagatttgttttacagagacttgtttcacctccacgtcaggaaggcatgacttatttgtcttagttgtggtgtgatctaggcctgcttgtatctctgcttg

SEQ ID NO: 908 - DNA, 1234 bp, Homo sapiens
ttctttagctcaggtttgtttttctttggggtgaggacgaggtccttggacattaaacttatttcttacaaatctaccaataaaataagtgcagcaggacagccctttggataatattagcttccatattgctggaaacagaagtctagatgcatacattttccagggatgaagtgtccatatctagaaaataggcaagacaatattgactccttcatgagactgtttaggagataaagtaactgatctaaaggagtggtggctttccagagcagtggctactgatgttccctattctcctgccccactcctatttcctgaaagtggactgacctactcttgactcacatttctgatgagccataggccaggaagccttgaattctggggttttcagaccattgcttcagctactcactccctccttctcaatacccttcatctctctacaactgattctaacctgcttccacttcatcttgtcccaccgtcctaaacccttggctttgtgactctggaatctctctgcttgcttttgcttccttttcccctctgctctcaatgtgttaggcaccctttctgttgctggcatttggacctcaactctcctagctctgactttactaatctctccagtcttagcccctcttgtcatcttggcaagaaactctttgcactagcctcaccctatgcagtccagccagttccaggggctgatagagggaagggggatgttggatatgttaggggcatttttatggttaacttctgtggtggaaagatcatttggaaatcacactgaagattattgttgggtgagtaagttggaggggcattttactttgtatttcaatacctgtttttatttataagtcacacatacatctcttccccactccactccacaacctcattttccctccaagcatttaggaacaaagaggtttctaaatccagtgtaagtgaaagagcctgaaaacctgtcagcagattaaacaaagagtaaatcttcatgatttgggttaggcaatgacttagatacgacattcaaagcacaagcaacaaaaggaagaaatggacaaattggactcataaaaattaaaaatttttgtaccacaggtggtgtcattaaggaagtggaaagacaatccatagaatgggaaaaatatttgcaaataatatatctgataagggactcgtatacagaaaatataaaaactgtacaactcaataa

SEQ ID NO: 909 - DNA, 1247 bp, Homo sapiens
ctacacaggaaaaatagatggttaacagttccccatggtttccaggctctgaggatggtctaagcatctcccagagtaagaaggtctccatggtgtttaccatttaacacatcagattccagtggtctctgtacatggcacttattttcttcatgaagtggaacttgagtgttggaaatggccccagatcatcctatacaacctcctcattctgtagacaaagagaactgaaggtctgtgaatggcagacacttgggcaaggtcccacggtgacttagtggcagagccaggggcatcctctagcttctcatacaataatctactgtcttggatagttgctcgttctccattctgtacacacctacaaggtgtctgctgtggggcagctactgtagcaggcatgaggactacagagagaaaaataagtactctatgcgctgaaaatgcttagagtcccagccagggacacacccaaagaggagcagctttagttcaaagcatgtggatgccgggtctcttggaaggttttcctcttaggaaccagtgttaatggcatcgctttcaagactttgcgggctcctgattcttgaacaggggtcaagatgtagacagttggcacggttccactgaggttagccatgcgcagcaggaatagggtaggtgggggcacattctgccacggtgaccatggcctctgtaaagtgaattaggggcaattgccaagtggaccaacatctgcttcagcgtcttgagaaagctgaaaataaaaatcgatgcgtataaaattaggctgtcgagtgaacctcagaccacaggtaattgcaatctgagttcacgttgctgcgactatcctgaacagctcagaaaacaggtacttttcaccacatacagtgtctgtgttctcagctcctgctccagggatagtttctggcttgttaaatgacactgctggacatcccccagaatttaattttaatatcacctcctcctcctttgcttaacatatacccatttatgttctgcaatttcagagaaaggaacatataataattatgttttagaaattggaacaagaaactagcagatgcaagtttagtgaatattgagttttaaaattgtctggctgtgatttgtggccatgtcatggcaaatatttttcaatgtcactgccttagccagtgctgtcactaaggcagtcagctggggaatagagggctgaacactatgatctcaatattaatgggagc

SEQ ID NO: 910 - DNA, 1202 bp, Homo sapiens
gggaggggacccccaggatggtctgaccctggcatcacagagacggcttcgtgaatagggagaagctgcgtgggaaggagcagtgggaatgtacggtcacattaggtgggaggcagcctagacccaggggccagaggaggtctggaatctcttgtgctgggttgggccatccctcggtcattggcatcctctgccctggactgaaagcttcagagctgtggtcaagctttatcagaaaagtcaggggctcaaacggcagggtcatctgtccaatgcccggattggcagatgggacagctgaggccttgaaagcctcaggcaaagagagtggcatcccgagagccaaagtggctccttgtccagtgctctgtccctgtgctgcactatctgagaccatggctttatcagaaggtcacaccatcccagcacagaatccaagcagggcagtcaagctgctcgcggaaggcctttcattctggaagcactgcctgcaaatggcccggctcccaggctgtgtggcggggttcattcttttctcttcatttcctctttttccttgctgaaaggcccacattagaaatagcctcacttgggggtatagctcagcggtagagcatttgactgcagaaatagcctcactcagggaagctccacttggaatgcaagcgcctggtaacaggtggaaagtcctgctctgtccttgtcttcacgcattttccagcacacctgctacctgccacctgcctgacccagctcctgtcacagggtgaacctcacggacttgtgcttcacagagcacaggaggctgatccctcactaggatgcaggtgtgatgcagagctcgggccctccaggtgggtgggtgggatggggaggtcacagaggttggggaaatgagggaggggctgacataactagaaggaagtggtagatgggtgctggcagaggggaatgcctgatgagaaggtaggagtgctggatgtgtgaatgcacaagagtgtgatactgaacttggccagaaaaggagattcatgaatagcagaagtgacagggagtttggagacacacgttcagaccagggtttgggagagctctatggcaacctttactgaaccctcgccccatgccaagcattgtgctagacacggtcatagctcagtaataaaacacttaggaagctgacagtgatgatgggaataata

SEQ ID NO: 911 - DNA, 1182 bp, Homo sapiens
tgctcagaggagatccccaggggcaggctcagtggacaggaggggtgcagcagtaacagattgtcccttaatcttcagtccctggagaactcacacaccagagaaagagccaggcaatcagaaaccctccttatagaggtgaattttcatttctgggaggagaagccggtttccctccagatgtgaatcccagccctgccacagccctgggagggcagctttgtaaggcaccctgggccccggcacaccctgctggagtcattcaccgccttcctgtggcacccggatgcaggggcagcacagacccctctgcctctggccagcccccgccactgttccgcagcacaccctaccctgaggggtgctcagaggggccagtgagcctgcctcagagcagggtcccgagaagcctggtgcctggatgagcagcagccacagcccctgggaacttgtcagaaatgcaaacgctctgccagtcccagacctcctgaatcagaaactctgggtacggggccatggtgtgtttctcaggccctccaggtgggtgtttgtggggtccggttggagagccaccagggctcgtcaccactccctccttcgtgccctctggggtcggggagacttgctccagggcttgctttactctgactgtcttctctctccacccactccttttctccattgcatgcatcacaaggtgatcgcggaagtctgtttctttaccagttgagctctgtctccatgagattgcagcctccctgaggccagggccacttctgttagcagcaaatcaccattgcctagcagggtgcctggcacatggtggcacgagctcagcttatttgccaaatgaatgaatggggactagtggggaggctggctggggactcccaactgaaatccctagtaggggacggagaggctcggcctggtacctgtctggggagaagtggggactgggactgtgctcagctcagccttggctctcggtggggattgcttttccctggggccctgcatgggggacaagctccacaagcacaggtgacctggcttcaggtcctggctccaagggtattggccactgaccctgagtagccccccccgccctgccctgcacctccatgtttctattggtgaatcagctggcacggttaacttcaaaggcttcttgcagctctg

SEQ ID NO: 912 - DNA, 1276 bp, Homo sapiens
tccctaccccaagtagattcagtaaatcgggggcagggcttggaagctgttggtaacaaatgccttaggtgagttttactcaatttggggaagcagtgacttcccagacccttttgatgagaggctgggtaaggagaggaatggaggaaataagaaacagatctcacgctccaggagcgcctggcctgagcagcctcgtgcaggaagctctctgaggagctggacaagctctgtgtctgctgctccacagggtcatgcttgaaatgtgactaggacggccgaagaatggaaattttacatctcatttacttttaactaatttaaatttaaaagcagatacttaattcagttattagaaaacttttaagaatgtttggaacagcttgggtccataactccttttccgactctaagtcttatgaaatctagatacagctcaggtacttcagatgaaaatgtagcatccaaattgagatggacctaagtgtaaaatacacactggaatttgaagacttagtatgaaaaaaatgcaaatttttaattaataacttttatactgactacatgttgaagtggttattttgcgtctattcgagttgaactacatgaaaattaacctcacctggaacatttaacctaggtatgggctcacactctgtttttgttgggcagtgctgctctgaggcactttcttgctggaatttgactcagagtgctagggagttggaggagaggagagaagccccagctgtggccccttgtttggctcacgtgggagcagggtttcaggctgatggcacacctggccctatagatggccacaaggccacctgtgatgggtctgttgggctctggctggcctgtccatctccttgggtactttgcccaaagagggaaactgcccgttccctccaggtagtgcctttagaaaacgagaatcttctctaacgctctgggctaggaagagagagctgagcacgtctcaccctgggctgcactgcatctcacacaagtgggacatggcctgctgctggtcagggtgagaactctgcctttaagttagaatcagatcaaatcaaatcaaattgaattctttaccccagtggggtagagagcaccgccaaatactaagctacaggaatgtggcccagaaagcaaattaggttttatttctgcctcctgcctttgccccgctgtttctggaagagaccccatagacagtgccgtgaagggcagcctacggagtctgtggcaggcagggactcgcaggtgagcc

SEQ ID NO: 913 - DNA, 3067 bp, Homo sapiens
ctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttccttctgtaacaccagaaccatttggccttaattccaatgtgagagacagaatccctggggtgctggactggccctccagagggtaagccatgtccggagtctcgggcccaaggaacgatttggagggtgcttgttagggcctcccgtgttgggtagaaatttggtggatctgttggctgaaaagacggacttgcttgcctctcctacagcatggagaggctgaccccatggctctgccaccgttggggcagggttagcagatggcagcccttctctgtggctgacaggtcactgagtgataagcatggttggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcaccacatgcccggtgtggccgagggcacacagcctctatagcaggccttcctgtggaaggcagaggcagtgagggaggtggacggtgccagctgaggctgaggcatgcagcagcccccagctacctttgcttagggctggggtgggaggcacatggtgacaggtatatgtcgtgggactggggtgtgggtgacctgccctcaaaccttgcctgccacctccccattcaggcctggtggcaggaagggacaagctgtggagctggctgagtcacagccacctccccacctccccgcaagctggtcccatcgaccagcaagcccagccccagggcgcttagggagaaatgacccagcctcctcagaccccgcctgcctgtcctgtgcccaccacgcagcagtcaggggagaaaatggtggctatcccttctgcttagagaaagaaatggcctttagctggtttcatgtttgtgttttgactggagggagtagaccctatctataaggtgccaccccatcatccaagctgccacactgcccggagcagcctgttcctgcactccaccctgctggccccaggacttctgatctcagtcctctgggagggaggttcgcctaggaggtgccccccacattggtgtccccatgggcagcaggcagacagctcacccccaccagcatgatggccccagctgggggcagtggcaggagccttacttttgtcacagccttgcccacaaaccctgcctctgaggggagactgaggaagggcagagccagaagcaagccgtgcca

SEQ ID NO: 914 - DNA, 1631 bp, Homo sapiens
gggtgaactaacctggcagtgccccagccatcttttggccttggccatccgagctgttgagacatctttggttgtggtcttctgccagggcatcgagtcccagtcctgagagctgcagagaacctggtggcacttaacagatgtcttgtcccgactctctcatcagccaggggcagggttcagggcaagtcgatttcccacccataagatgagaaacattttggatgaaaaatattgctttggattctcctgggaggcagtgtggtacactggaaagaaaaccatatcaggagtcccaggggtatatctggattctaggccctgctctgcttccaacttccaactcaaagccttgggattcacttctcctctctcagcctcaatttctcatctgtaaaatgaggttggactggatggtttctaagggccttttggctctaagatactgtgtttgaaacgggctgttggtgtggagataataaagggctggagtgaaggtcttctcaaatcctgttttctccttgtcatttatgaaccagaaaatgacagatggcgagacctggacaggaaatgccctcttcagattgaccaaccgagcaccagcatctgggaatgcctgcctgaaaaggacagctcactatggcaccgggaggcagtgaccgcctgcgctgtgaccagtctgatcaaagacctcagcatcagcgaccacaacgggaacccctcagcaccccctagcaagcgccagtgccgctcactgtccttctccgatgagatgtccagttgccggacatcatggaggcccttgggctccaaagtctggactcccgtggaaaagagacgctgctacagcgggggcagcgtccagcgctattccaacggcttcagcaccatgcagaggagttccagcttcagcctcccttcccgggccaacgtgctctcctcaccctgcgaccaggcaggactccaccaccgatttggagggcagccctgccaaggggtgccaggctcagccccgtgtggacaggcaggtgacacctggagccctgacctgcaccccgtgggaggaggccggctggacctgcagcggtccctctcttgctcacatgagcagttttcctttgtggaatactgtcctccctcagccaacagcacacctgcctcaacaccagagctggcgagacgctccagcggcctttcccgcagccgctcccagccgtgtgtccttaacgacaagaaggtcggtgttaaaaggcggcgccctgaagaagtgcaagagcagaggccttctctagaccttgccaagatggcacaggtaagagccccagcagcctggagtcaccttggtgctcactggagcctctgctggttctgggccgtcctagacaagcatagattgccagtttcagaaatacccaggagtgggttaatttccttgtttttttaaatcctattcaaagaaagattatttccagttggtttttaaaaagcgtttatttctatttacaagcaaatattccctttcactgtgagctcagtgctaggggtacaagggcaggtggatggtgagaggcggggtgttggtgggcagactcactggaccaaacactggtaatcccctccggcccttcact

SEQ ID NO: 915 - DNA, 1144 bp, Homo sapiens
ccttggcctcccaaaatgataggattacaagcttgagccaccatgcccggcccatattatgtctttgatattctttcctgtttttaattttccattcttttgtcattctgtgtataacagggatattttcttctgactgttctttgctgattttttttttattttttgctgtgtgtagtctgctatcaagcccacccttgaacttcctaattactgtatttttcaattatgttattttttattttattttttttgagacaagagtcttgttctgttgcccaggctggagtgcagtggcatgatctcggctcactgcaaactccacctcccgggttcaagcaattctcctgcctcagcctcccgagtagctgggattacaggcactcaccaccacaaaattagcctggctaatttttgtgtttttagtagagatggggtttcaccgtgttggccaggctggtcttgaactcctgacctcaggtggtctgcctgcctccgcctcccagagtgctaggattataggcgtgagccaccgtgtctggccctgtttgtttctctgttgtggttttcagttctctgctagaattctcccacttgtcattgtcatttctgtcagttgttttgaaatctttttctgaaaattcatttatttgggtctcctgtcgggtctgtttctaaagtcaatttctccccttgggtttggttgtttccttgaatgtctgctcatttttgggtgccagaaattgaatgtgaaagacattggagatagtttgaggccctgagtgatatctctagaaacctaaaacatctatttgtgatttttataagttgtactagaagaataaacaggcatgggaaaagaaggaaccggtaggccgaggtgggcggatcacgaggtcaggagatcaagaccatcctggctaacacggtgaaaccccatctctactaaaaatacaaaaacaaaattagctgggcgtggtggcgggcgcctgtagtcccagctacttgggaggctgaggtgggagaatggtgtgaacccgggaggcagagctttcagtgagccgagatcgtgccactgcattgcagcctgggcgacagagcgagactctgtctcaaaaaaaaaaaaagaaggaaccggtaagaa

SEQ ID NO: 916 - DNA, 1130 bp, Homo sapiens
tcacttgatgcatgcagtaatacactgaatatagaaaagagggtgattaattttggagtggaggggtagggaagcatcttggaggagtaaatatccaagttgggtggaaatttcagggacagtttggtgacctagtggcgtgtaaagagggagaagatttcaactaatggaaatattatctaaaggcctgaaggctgaagcagtattttatgttctgggcctgtaaataatttgataaattgaaatacaaagtatacgtggggatggacagacatgaggattaagttaaagataggaaccatattatgctttgccatgcttaagaccttcgattttgcatttaggctatggggaattgttaaaatgtttttagtagtggaatatgattagaagaacttgaaataacccttcttgaaacattgagatatagtgtgtgtacattaaagtgcacaaatcagaagtatacagctaagtgaattatcagaaagtgaatacatccacataacaatcacctggtcaagatgtaaaatattatagaactctagaaattccccttgaactctctaccaattattactcctttcttcctttttttttttttcaggctttgtcacccaggtaggagtgcactggtgagatcatggcacattgtagcctcaacctctcaggctcaagcgatcctgtcgcctcatattttgattttttttgtagagacaaggtttcactatgttgcccaggctggccctccttcctttttaaaagtaaccactatctaccaatcatgaacaaaagatgagttttaacatcagattaatttgcctgtttttgaaggtataaatgaaactctttagggtgtgctattcctggtgtctttcaggcttttttttttttttttttttttttgagacagagtcttggctctgacacccaggctggagtgcagtctcacgatcttggctcactgcaaccttcaccacctgggttcaagtggttctcgtgcctcagcctcatgagtagctgggattacaggcgcacgccattatgcctcgctatgtagttcatttttattgccatataagattcctttgtggctgggcgctgtggctcatgcctgtaatcccagcgctttg

SEQ ID NO: 917 - DNA, 1227 bp, Homo sapiens
attagccgggcgtggtggcgggtgcctgtaatcccagctactcaggatgctgaggcaggagaatcgcctgaacccgggaggcggaggttgcagtgagccaagatcttgtctcaaaaagaaagaaaaaaactaaaattatttgcactaataaatgatatgaaatgtttttatgtcagtataaagtcagagaaaacagaatgtctagctataagtatgggtcttctataaagtattccttacccaccaatgggggtgactttcactgaattgctgtgtgaccacttgattgatagtctctttaaaaccaccatgaacctcaagtttgcaaatcaggctctccccattgccaatatcacctcatactataacgaattcatatattgtgctggtccttcctaaagggatccagcaaggatatttacatttgtttacatgggatatttactaaacctatacagccttctgagggataagccaaatacccacttcggaggagatatctggggaagatgaaggagtctttatagctatagacacgcccactctctttggatcagcctccttttgataaatagaggtcatagtcctttcaggtacacttcaggcagatcaccaaactgcatatcctaatactctgaacaaagcaaggaacttttcatttatttatgcggcaaactttttttttttttttgagacggagtcttgctctgtcgcccaggctagagtgcagtggcacgatctcggctcactgcaagctccgcctcccgggttcaggccattctcctgcctcagcctcccgagtagctgggactacaggtgcctgcaaccacgcccggctaatttttttgtatttttagtagagacgggttttcaccgtgttagccaggacggtcttgatctcctgacctcgtgatccgcccacctcagcctcccaaactgctgggattacaggcgtgagccaccgtgcctggctatgcggcaaacatttattgaagaactttcatatgtgaggcgtgtgctgggcagtgaaggaaatacccagaatcatccctgcctcctagagctgcggggaggattagacaggcaggaagaaataccagacagtgcgagaagaattctataagaaagtaacagagaaaatccccgaactgcccaaagttgagaggaaaactgctagtggagaaatcagtaaagatgtgtgtcaggaggtaaacttaatgggcagta

SEQ ID NO: 918 - DNA, 1178 bp, Homo sapiens
cctttgaactgagaatctcatagtttaggagctgtgggctggaaccacatgctggcagctgccaccctcgagacagaaggcccatcgccatagtcatagcattctttgctgctggctggcagcttggagaggcgaggtgggcacctcccaaggaggaatgagttaggtggaccagccagtcctggttttgacgactgagttcaccagggtgaacagatagtcatatgggagcccctttttgtccttggcaggtttgtgcttcttttggccgggcgcggtggctcatgcctgtaatcccagcactttgggaggccgaggcgggcggatcacctgagttcagaagtttgagacctgcttggccaacttggtgaaaccccatctggaaggctgaggcaggagaatcacgtgagcccaggaggcggaggttgcagtgagccgagatcgcgccactgcactccagcctggacaacagcgtgagactccatctcaaaacaacaacaacaacaatttttagtctttggcgatgccctgaggctcatctcttccacagaggcttggaggatcggccacacgagtggggtatgcagaggcacaggcaggtgggggagtgagaaccccagggcgcatctgaccttggcgtgccggcaggaagagaacaagcagtcctcctggaagattccaccagaactgtttattggacaggggactcagacgatgtgtgtccccagccacagtggtggctgagagtgtccctatcctgtgcatgagatcctgaccacccgtccctgcagggaccgtccccgtgttgggaagcaggagggtatgtcgcagagcctcacccagtgggagccacaatccttattccttgctcctcaggcttggatgttgctccggcttctatcccccacatcctgtcctccctcccggagcccagggaccacccatgtgaggctgggccactggggaaatctcgcacacgtagcgcgtctcaccagaaatagaagcagagcctcacgtccttggctgcttcgctgtgggaatgccttctaaggcgccgtttttggtgatgtcccttcacggatctttcaggcccagtgagtcagcagtgtctgcattcacacaggctgggtggggttgttggatctgccccgggtggatggcacctgctccctcagggc

SEQ ID NO: 919 - DNA, 1148 bp, Homo sapiens
ttatatttttggaaattctgtgtaaaccattggaaatggaaggagaaagcctgtgacatacgaagacaagcaacactaatcaggagtataaattctgttttgcagttaattaaatatttgattccctactatgtttcaaagataaataaaatgtgattaagtaaaaggcatttaacctttagagacttggagatgggcagggtatatagtagcctgccagctagagtagggaagatgttaaagaagataacctgtgagatgggttttgaagggtggataggagtttgccaggcaagctctgccacctcaaaaaaatagttccttggctgttagatgcttgtgtcactataggcttgggattactgaaaagctatgcttgtccctcccttcctaacacttctgaggctggaatgtctgtctcccatctacttccttaagaggtgtgggttacagtgtggtgtacagttgggagtgaattactacttgaccttgggtacatgataaccttgactgtagagtccatgcttttcctgagtagttcttcagagtccttcctgccagtgacttggttctaggtgtggagcaggagctggctgtcggaggactcattgaattcagtggaaacagcagggagcatggttttcttttgaatggaaaccatgagtgtagcagttcttctttatgacttgctacataatcatgcaggaaaatgcctgtcacgggattggatcctaggagattagccccattgctaattaaaagccccattaaaagaggggaagttcttttaggtatctacagcttcctaagatttgaatggtttacaaagcagaatgttggctgggcatggtggctcatgcctgtatcccagcactttgggaggccaaggcagacagatcagaaggtcaggagtttgataccagcctgaccaacatggtgaaacctcgtctatactaaaaatacaaaaattatccgggcatggtggcatgcgcctgtaatcccagctactagggaggctggggcaggagaatcccttggacctgggaggcggaggttgcagtgagccgagacggcgccattgcactccagcctgggtgacagagtgagactacgtctcaaaaaaaaaaaaaaaacgaaaaaggtagaat

SEQ ID NO: 920 - DNA, 1186 bp, Homo sapiens
cacatgatgtatttgagatttttaagacattttgggccagattattctcttgttcctttttacttctgagtagtattccactgaatgactcgaccgcagtttctttacccgctcacccattaatggacacttgggctgtttccagcttttcgctattctgagcaagtagctatgaaccattctcatgcatgtctttttgtggacatatgatttcatttctcttgggtaagttcctagaaatggaattgctgggtcatggagtaggtgtatgtttagtcttacaaagtggttataacattttatgcttccactgatcatgtatggaagtcagctattttttaaaccaccctacagaacgttggctttctgcttgggtggtggagtgggatgggagggtgagtgggtagggccccctcctctcccttgacccccacctccctactagcaggatgggggcaggggtctgcaccgttggctctgctgggcgtgggctgtggagttcacatgctctggaagatgtagctgtgtcctctatattagggtggggcctgtttctcttgcttttcctggctattctgaacaattcttgttccttcattccttccccccgcctcccaatgtctctcccttcccctgcttcctcttgtccccaaaataccatgctctctgatgaagctccaggctagtaagtcaagaatgaaggtcgtggcctttggtacctggtgtgttcctggttctttctgacatctgtgcccactgttttgcattcatgactgacagaagtggacttttggagcctactgatggtcacatggtagcacatgctgtcctagtttgcttccgtgtgaggatggacacttggctaagtaggtattctagacagctgctcccagagcagcctcaccatgagctgggccaccccagaacccggcatctgggtgtgctagcctcatgggcctcaggaagctgcagccagctcttccaagtctctggggtcattacttttagaagcatgttttatagggttactagaatgttctcttaagtggattccattttatgtatttatatcctacctctttcaggaaagttctttgaggactcaaaaaataggatgccgtaataggggttgagattgggggagggccaaaattgattttaaaatgcaaatacagcaaccaaaaat

SEQ ID NO: 921 - DNA, 1199 bp, Homo sapiens
tttcaggcttatagactatagatgtgcttcaggtggtacgtggcatcagttggctgctcaattaacatttttttttaatttccttttgtggctgaattggtgtcaggtacatttttttcatgtatttttttaagaggtattgtatatcactagaaacacaatctcagaaagtaaaatcctgataaatgtttctgtttctgtttttcttatctctccacctaaaaagaataaagttttgaactattttcccttggagactttgagttttgtgattacaaaaataaagaataattgtttttattctaaatatttcctactggatgcttctaatgattattaccatgttttatcaaatctaagatgccattgactttaagacacaccattattttagtaccactaagaaaaaaaaacttgccaactgtgatggtgatacacatcctggtttcagagttgttaaaatgtggaaaatgtgtatcctagaagcaatgagctacagtattgttattaagctctacttgcatgattatgagcatgacctcataacctgtgtccttttttctctttggtagctttggcatggcatatgactttattgattcagtgggaaatgatgtggatgttgtctctgactctgaagtaagtgttatttgtcgcttaatgtaattttggaggtgttttgtgataggtgttttatatcatgctgtgttttgcataatataaatgtgcaagtcttgagaaattagtgatgaaataagataaaacttacctgattattgagtatcttttttgttgttaaagtatcattgtttaccacatttgtatttaaagaggaaggaataatcaatccccaaacactggcagtggtaataatatattgatggttatattttaatgatagtaattgaaactgataatagtgtttgggattattctgtatatgttaccagttgagttacaaatgatatttctagtaaaatctattggatccttagtggctttgatctgatatgctaaaagcctgggtcagcataacagtgtgacgtatacacccttaactttaagaaatcctatcatgtaaaaataaatgtttgactgtcactaacataatgtgactcataaagtgtacgtgattctggtttgaaagctccgtcctctgtgtgtttgcatgtagctttttgtttaaagttctatttgta

SEQ ID NO: 922 - DNA, 1207 bp, Homo sapiens
gtcagagataaaggcggtcaaagggtcaggacaattgtttaattcccaacttcataaatagagaaaaattgcatagcatcctaattatttcattgtggtttgcatgttgatcttgaagttatttttcttgttctatttgaggaagaaacactactttacatgaaaacaatgaggggaagccctttttcttaaatgccctcaagctgtggccaatcttacctctggtcagttgctgattttggtcctgtcctgcacatttcattttttagggatactgggtgcccacctttgctccctgttctctggagctgtgctgtgggatgcagggactgctaggcatgttgcgcctggtaaaagtcttactgtattttgaagacttagtaccctaaaatgtcaactatccatttttttctattgatgatgacctgttgaaataatcctctaggtatactgagttaaatgtattactaaaattaattgcacctttctctttacttttttcatgtggctactagaaaatttaaaatttcttgtgtagctcacattttttctgtgggacagtgctggtctagagttgacttgtgggtgggaagtgcggctttggagacaggtttcccacccccgttatgaggggcagtggtatctgacacagaaaacccttcagactatcagaatacatctccaaccccagacctctctatcctcagaatcacttctcaaggtctctgatcatttttttttctcctctcttcattcagacctgctccacaatatccacaccaagtgcccagatccacccacaccgcctatattaagtgagaagccgacaccttttttcaacagtgaagacagaagtttgcactatctttcagctccagttggagttttttgtaccaacttttaggattttttttaatgtttaaaacatcattactataagaactttgagctactgccgtcagtgctgtgctgtgctatggtgctctgtctacttgctcaggtacttgtaaattattaatttatgcagaatgttgattacagtgcagtgcgctgtagtaggcatttttaccatcactgagttttccatggcaggaaggcttgttgtgcttttagtattttagtgaacttgaaatatcctgcttgatgggattctggacaggatgtgtttgctttctgatcaaggccttattggaaagcagtcccccaa

SEQ ID NO: 923 - DNA, 1242 bp, Homo sapiens
tacaacttagtgaggctccctaagcctctgaggccattgtctgggcattcctgactttagctaaccgagtactgcagtgattctggagatcctgatgctgctgctgctgctcctgatcatgatgatgatgatgatgatttgagacaggacctccctctgtcactcaggatggagtactgtgatgcagtcataggtcactgcagcctcaaacccctgggctcaagccatcctcctgccttagtctcccaagtaactaggactacaggcaggtgccagcatgcctggctaattttttgtaggacatggtctcgctatgttgcccaggctggtctcaaactcctggcctgaagccatcctcctgctgtggcctcccaaagtgccaggattccaggcatgagcccctgtaccccactgattctggggatgttgatactcatgttccttctctccctccctcttttcctcccttcttccctagcttcttccttctctcctcgcttcgttctttcctctctccttccctccttttttctctcttttgtcccttccttccttccttccatgaatacttaatgagtgtatgagccccaagtgtatcccagactttcacagtttgactttattattttttctctgaacgtttcctgaatgtggatcctggctgcctaccctcattcctgaggggagagaaggacataacgttctttgagatgtggagcacctagccgcattgtgcagagacaacaaatacttcaatttaaatctgtgttctaaaatggctgagaagatatttcatagattttatgagaggaaaaaacccatgcccttagaatattggacggtagggcagaagtcttctagtaatccctccccttctgtcctccccatcccacccctgctccccatcatcccaccacagcatgtcagttgttacttcatctgtgctatcacaggtctgaaatgtagctgaaatcgttttcctagcttgtataggctacttaaaggaaaaagagccccacgtcccacacagatatctaggatgtttgatccgtgacaagctccaaatgagtctcctgtgtggtgctgtcagaggtggggaagaaaacaaactaggactctcatcttcttacctgcagcatgtttattaccttgagagaaaaacaattgtgctcacagctggaattcatgagtgtgttttcctttttgcagctgggataaacttttgagatcttatttttcttt

SEQ ID NO: 924 - DNA, 2156 bp, Homo sapiens
caaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtcttaaaacccatggtatttttattatagggagagtggggaaagaaactaagtgtgggtggggcagacaggccagtgtaagagagactggttcattacgttccattttcatttctacaaggacttggctg

SEQ ID NO: 925 - DNA, 1289 bp, Homo sapiens
gtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaa

SEQ ID NO: 926 - DNA, 1393 bp, Homo sapiens
gttagatagcatgtgctatttcatactggttattggagctgatatgatttatatatttgtatcataatactagtatcataagacttgcaagttttaggcattaaataatttgtaggccaagtaaaagctagcttataagacaacctgaaacaattaaaatattgaattccacaaatgttaatcattgagaaaatgctgaacttctgtttcttatttcataattcattgccaagatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattagtaagtttatttaattgtaaatttatttttctaaaagatgaacaccttctatgtagctgtgagaccttcattctttcagt

SEQ ID NO: 927 - DNA, 1469 bp, Homo sapiens
actccgtcttggccatgtctagtaattgctatgtgttgggagaaactttgtgaatgcaccattttgatgatcatgaaacgctgatgaaaaatgcctccaaacatttttctgtactcatacttagattcacaatggttgtgtatctctataatgtgaaatatttttttgtggtgataaaaagagggccaaggaggtatgagccatcagactggaaaaaaggatgactatatgatgaggagaaactggggtggcagggagggagggagggtttatcactgcttaacttcatcttcatgaaatgaaactttgtaacttattgtagttagaaattgtaactttgatattgaattctcttgccttcaacaagcacactgacagagaaaaaatgctactgtctgttggttccaatattctcccactgctagagcttcctgttaagcaagtgtgatctgcaacattttttcaacttttgctagcactgtatactattgcattcttaggctactgtgaggtctatgtttcttgtaccagaaattgtccttttgacttctagatccttcttccctaatgtgttttgtatgtggttataaaattgtagacttttgtgattttgccaaagttgtagctaaatatttatacacttgtcttgaatttttttcagatccacttaaaatatttagaaaaacaagttttattccttatgtgtcttataaggaataaaatggtcttcatttgacacttactttcccatgaacacttgcagttgctaagggactttattttgtaacatatcaattataaatattgtatttatctttgaaattttgtacattgcttttcccaccttttcctttttcttctttcttgtctgtattggtttttgatcacggcctggtgttgtgatactgggaagagcattagccaagaacttgtctctttgatctgtttcgttaagctgaaccagtgtctttacatttcatttgtacttcaaaaaatatgctattgtttagactttccatcctttttttttttattttgaggaaaagtcaaattcattgtttatttttatattatttttaagttatctgaacaaatacttttgaaaaaaaagtttgttgtatagtcaaaacaaatcggtgccacccggccgtgacaaatcctagtagattctgtgcatgtggagcggccgcgaagaggtgacaccgtttggggctgtgtccttattttattttatttttttgtagaatgtaaaaagtcattttagatgccacccattgactttgccacatagctgaactgtgtttactggaaaaattcagaggcctaaagtttaaaataaaatttacttctgatgttttaattaaaatgtttgccacattaacttttctgatgccttaaaagtgaacttctttaaagaacctttgtgctattttatcacaggcttacactacaattgttaataaatactt

SEQ ID NO: 928 - DNA, 1219 bp, Homo sapiens
cagcacttaatccagaaagttcccggatgggtggctctgacaatgggcatttacctctgaaattggtgccgacgcttgatgttgcatgcatctagtttgcatacaaataaagaattagacttgtcatgaagcaggtataatcaatgaaaggcccagctgtcttaatcaggtttcgttagcctgagcagctctctgtgagcaagataaagtgtttttcagaggtattaataattactcataatctctcctatcatatcgcaagactttttacatgcctttcaattttaagcaacgattaaagcaattaagattgctgcatttacaagctatttttcattcccagaaaatatcctacacctacttgtccatatggtactttgcaattggaacataaggatagtttaggaaaattacgtatgctcttatcctaatctgcctattactggatagtgtcttaactaatgaacccgactttctgagctgctcttaagtggtggtcttgtcatatcagagagacacaaaacgggtaacccaatcagtcaaggatgctttgaacaagtttgttttgttacaatatgccgagcttatgcatactgcctcatgctgtgaatacattagcaccgaatggtgtttgaaaagcatttcgatggaaatttcttagccacaaccataagtgtaattggctgcctttcaataggacataacagacttcaagttaaatggaaactattaaagctcaaatgatttctgccgttgtttcatgacaaatgtacagttttattattatgagtattcattcttgtacagtggtcgacagcgatttgaatatacatgattattcacatgcccgatgatctagaatggtatatatcatcacagttaaaagaggtaaccaaggtgacgttgcttcaggtgctaatgtcattataaaactgtaaagcaattattctgttagttcttgcctggggttatgaatacattgaagagtgcagagccattagatgtagctacttcaaaaagcggggaaaagaagatgaattttaatgcatgggtaattgctcaacatgaccgcattcctaataaatttttgtatattagaaaaaaagaacagaatatatttgtgtatgatgcatgaaacagaaaaaaaactcagatgaaatgcatgcaattaattttatggtaaaatcattttatgactatgcaccttataataaatata

SEQ ID NO: 929 - DNA, 1245 bp, Homo sapiens
ctggagtgcagtggtgtggtctcggctcactgcagtctccctctcctgggttcaagtgattctcctgcctcagccttccaagtagctgggattacaggcatgcactaccacacccggctaatttttgtatttttagtagagatggggtttcaccatgttggtcaggctggtctcgaactcctgacctcaggtgatccaaccgccttggcctcccaagtgctgggattataggcatgagccaccgcactcggcctgcattgtgattttagattgccatgtagtacgagggataaaggaaaagaattacaatgatatttttaagaagagatttaaaaatatattcaaattcacagaaatgcatccccctattaaggccaatactaggagtcaaagtctgcatcttctgcatcaaaacacattaaattaatgaacaagagattccttctctggacagtgttcctcacaggtaggccagtgacatggtgggctggagagagaggtccacccaggctcctgaattggagagcactgtttttacagaggaagggaagaacttggcaaggaggggaaatttttcagtcagtctaggaccttcggcaacaaactggaaactcaacctctcagttttctaaccatgagatgagattaatcatatctgtcttacaaatgaactggcaataccctatcaaaacaactattaatacatcaagtggagattagaaagtatatagaactaaatggcaatgaagacatcacgtttaaaaaatgcagtcccgctggacgtggtggctcatgcctgtaatcccagcactttgggaggccgaggcgggcagatcacttgaggtcaggagttagagaccagtctggccaacatggcaaaaccccatctctactaaaaatacaaaaattagccaggcatggtggcatgtgtctataatcccagctacttgggaggctgaggcaggagaatcacttgaactcaggaggcggaggttgcagtgagctgagatggtgccgctgcactccagcctgtgcaacagagtgagactctgtctcaaaaataaataaacaaataaatttaaaaaatcccagcaattcagtcaagcccatgattagaaggaactttctagccttgttttgttcaccacaataaaaacaacaagtgattcatccaatttatgaataaaagggctttcacaaaattcagcccttatccatcatttgaagagctcatttaaaaaaact

SEQ ID NO: 930 - DNA, 1198 bp, Homo sapiens
cttgtgtgggccaggcagtggcctctgatgctgtggcagggtggctgtggcatcccgtcctccagtgcaacccgtgcctcaggacgccctgcacactgacagtcaaggtgtgcacagcacagcacccagcgggtttcactgacaggggatgggagccgcagcccccaaccctcagagttcacagcaacagaagcaagatgacagccagataatccacaatgccaggggcttttgagagtaatgagtcctttctgtctttggatgggtgacactggtggctcacttcacaggacagagaagtaagtgcctacgtctttcatttgggaaggtttagcgcccatcggtgtaggaggcaaagcaggcttgtgagacgtgttccatggccactaagaaaggtggatgttggcttggggtcggttgcacagaacgatgacaagctgggcctctctcccacaggccacctgagagcatgggaaaggccccacagcagagagggcttcagaacgagaaaccccagcatccaaggagaatgtgatacaggactctgtggccacgggattccagatgatggcaggggctgagggaggagggtgcatccccggggctggaaggttaagggccctctgaagcagaagcccctgggtctatggagtgatccagagccatgctgctctcttctgctcctgttccccagaaacctgggtacctcaagacctcatgtatttcccacagagaaatacatgtctcctgcacccccacccctgagagcaaggctgatgcaattccagggcccagagctggactgggaaactgagggtgctaaaggtacaaggtttgggcccctgagcacgtggaccccaaaaatacattagcttcaggacgagctacatactttgcagatcccagtacaaaaaggaaatgaaacctccttgttcaaaattattacaaatttcaagatggtaacacatagcattaaatcaagtgccaggacccttctgcatttgggacctgtgcagcacatgcccataaacctggcactgcctggatctgccacagccccgccggtgatgctggagcagaatcagtatcagaatacttagaagagactagaataatcaataagcacctagcccaaatcagttcatgacacctcctctatcaccatgtccaaggtgaggcagcatccgggccggtgggg

SEQ ID NO: 931 - DNA, 1177 bp, Homo sapiens
gaaagatacaaaggaaaaggggaggaaaaaaaatctgttctgaagaaagcattggaccctgggaccccagccccagagtgcgtggcccagctagtaccggggctggcgtggcccctggtggggctgggaattgtaggtggcaattggaaaacccagggtgggctaaccaggcacagccacagcaggcccttcggtggatcttcggggtctgctggcagcgggggcggaggcaccggtggggtggcagcgaggactggctgccctggacacgctggggatggccacggaggaggggctggggcatgtcctgcagagggtgtggggtgggagccaagcaggaggggagtcctctgtcattgggtcctggtgccccttccccagagccacagcagccagaggcgcaggaaggaaggggcctaagccgtgactgtcacccgcccagaagctgcacctgctcgggcaccacaaggaaacaaaaggtgaaaggggtggtgagtcagtggcaggagaggacactgggcagagctgtgcccaggccttggcctctgtctgtggcgatgtccgcctccctgtctctgggctgcctctccttccctgcaccccctgccgtggtctccccactggccctgacactcctttccagagccgcagaggctttcggcgtcccagagggcgcgggcctgcgagtcctgcctctgtggccaccatgccccggggtcgcctgggacatctgcttcctgcctgctgatcggtgccattcctcacagcggcccctttctgtctccaagtggcctggtttggatgatcaattgtgtggttgcccggtctaaccaccagatgctgtgccaggacgatctctttcttcctttatagctttttattatataatgaaagtgacgagaaaaaaattaagaaatccagcatcttgtgtcatgtcagcactgataaacaaccatttgtagtttttcacatgacctcccagttcgtactggaaaacatgcaaaatctatgtggccttttaaatttcaggatagtttagatttatagaaaagttgtgaagctgatacagagagttcccttgttccccagaagcagtttccccttacgtcaccgtctggcattaaccgggtacatttgtcgtaactagaggacccgtatccatacctcgttgtgaact

SEQ ID NO: 932 - DNA, 1175 bp, Homo sapiens
cggcaggacgcaccgcggaccccggagagagcggacgagcagggcgccggcgccatggacctggtcatcacgcaggagctggcccgcgccgagagccagcaaggtgaccccaggcccgccacgacccccgccccggggaggccccgggacccgccacgacccccgccccggggaggccccggaccctctcatcccagcccgcccaatgggtgatccctcgagggccacagccggagcccccacctcccgatcgtctgaccagagcaaacgtacaggaaggcgcccacaccgctgctccctggcggcgacaggttctgacggtggctgtggcccgggggcccaaggcggctgcctggggccttcgggatggcgttgcccggctcacttctcccagcccagtgaccaaaccttcctcaaccacccgtttgggacagatgctgcgtccttgaagaaggcctacgagttgatcaaatcggccaacctagggaaatcggagtttgacccctcagagagcttcagcccagacctgtttgttctgtgtgcagagcaggccctgaaggtaactagttcccgggatcctcggtcagggcagctttgacagggagagggagggcctctgggtgtgcagcggatgcagagtggggctggggagaggcagctcctggccgggcagtcaaggggccaggatggaggatggggctggaaacaggctccacctgtgctgggggcctgttctgaaagcgggcccgtggtgcttctgggcagggaggccacccctccgggtctgtgatcttctgtggtggtgttctcttgcagatgaggcagccagaggtgagcgaggactgcatccaaatgtacttcaaggtgaaggcgcccatcacccagtttctgggccgagcgcacctgtgcagggcccagatgtgtgccccgaagtcggcagaaaacctggtgagaggcgtcctgtgccccttatccccaacagttcaattttcaccccatctccagagcaatgccaggctagaccaggcttaaaatcgttcttagggtagtagagtgaaggaattcctttccagagtgacacgaaacttgcaccatttcctgtccatgctttttgctcaagtggtgatatctgacacacaggacccctggacctttgcctcgtagcagcgtggtct

SEQ ID NO: 933 - DNA, 1166 bp, Homo sapiens
ctgtcttctgccttaagaaatgaaaccccttcggggtgtgcccatcatttttttagtggtgtttggaagttttcccctaaaagcccaaggcccatttaagaggtagaagtgcgtaaacaggaatgcacaaagccagaactgagcacgtgcgcatgcagggcccgtctgtcagccacgtctttctgagaaggggcttggcctgttccccgcaggcctccaacattgacgacgtccttggccaccacacaggcttcctggacacctgcctgaaggactgcatgctcaccaaccccgagctgctgaaggtcttctccaagctcatgtctgtgtgcgtcatgttcaccaactgcatgcaggtgcgtgggtgtgggtagcaccatcgggtgggcaggcgcgggtgggcagaccatgtcccgaccgtggccgcacgcagcctgctcacgttttcctgcccttgtgttcgtggaggagccgctgggatctgagtgtttccagaactcctggtcttcctggccgggtgattccctcctggagcccctgccctggcagcgtgggcagggctgtgttcctcccgaaccatccctcagcctctgtggtgctggtctctgtccggggcctttgcttatggcccttgcatgctcttttcctcagcacttgagctatttgattccgttaaggacctgcaggcactagtcacaagcagctgccgactggcgatggtgcagaacctgcgtgtctagtggcagaagcaggggtctgagaatgaggctctccaggcagtgccatggggagggtccggaggagggcgagtggggaggtggaggagggcatggccacttcagggtcccaaatagggaaacaccaaaataactgttctcaggaaaatcagctggtcaccgtggaaggtagacctgggaattctgtcggcacagataagtcatttcccctgcagcctcagagatgcttgtgtacccccagccgcaggctacaacagaggtgcggagggtgacgtgcctgcaggacttgttttttctgcaaagcattgtggttgtaactaacagaagcatttccttgcgactctccccccctagaaatttacacagagcatgaaattagatggcgagctgggcgggcagacgctggagcacagcaccgtcctggggctg

SEQ ID NO: 934 - DNA, 1293 bp, Homo sapiens
gagcagcagagcattccctgctggcccagacccatgtgtggagggaggtgcaggggaaagggaacctgggtctcaggccccattcatgctgcccacggggctggctcccggagctgcggaggccgcctggaagctggaggcaggtgaatcccaggcccacccagaggaccctctgagaggctgctggggtgtcggggaggggccctaatcccaggcccatgcagaggaccctctgagaggctgctggagttcagggaggggccctaatcccagtcccgtccagaggaccctctgagaggctgctggggtgttgggcaggggccctaatcccaggcccatgcagaggaccctctgagaggctgctgggctgttgggggaggggccctaggccaggcaggccaggtgataacttggtttgtcaaagcctgacattggccagtcttgagtgtttaaaaaaatgttttttatttctacagtttgaattttatgaatagctgtcttcttacctataggagaacatattgtgatgttcgtgcctcagagctaaaactatgagtgaatttcggattcaccatgacgtcaatgaactgcttagcctgctgcgtgtccacggaggagatggggctgaggtctacattgacctgcttcaaaagaacaggaccccgtacgtcactaccactgtctctgctcacagtgccaaggtgagcactgcccttggtgtagcgctgtgcagggtgagcactgttcctgggtcagggtggtgcagggtgagcccacccctgggtcagggtgcagggtgagcgccgttcctgggtcagggtggtacagggtgagcaccattcctgggtgagggtgcagggtgagcccacccctgggtcagggtgcaggatgaacactgttcctggatcaggatggtgcagggtgaacccacccctcagtccatgtgcaggatgagcgtcgtccctgggtcagggtgcatgatgagcaccgcccctgggtcagggtgcagggtgagcgccacctctggtgcagggggcagggtgagcgccacctctggtgcagggtgcagggtgagcgccacctctggtgcagggtgcagggtgagcgccacctctggtgcagggctgtgcggggtgcagggtgagcgccaccccggggtcaggatggtgcagggtgagcactgcccctggtgcagggctgtgtaccgtgcaagatgcagggtgagtgcccgttcctgggtggcctcaatggtaccggcaacgatggcagacagcacttggtctgtgtgtgtgt

SEQ ID NO: 935 - DNA, 1198 bp, Homo sapiens
ggcacgtcggccacctgcatgatcacgtcctggaggtagaggtggcgctgcacgtccccatcctgcaggaaaagtgcgccgtgggcggggccaggtgactcgcggcacgcccaccgcgtcaggcctcgcccacacccgtggccccagtcatcccgcgctccggtcccgccccacagcctcaggccccgcccactccacgttccggccccgccccaccacctcaggtcccgcctgtcccaggctccggccccgccccgcagtcgtaggcccctcccactccaggctccggccccgcctcgccgccgtaggccccactggatcctacaactactttttccctcttttgctcacgcacctcgaagaactggtgctcccgcgggaagcgcacggggcgcgcaacgaagcgaaagggcgcggccccagccgcgggatcccgctctacaggcagcggctccgccgccccgggccccgcagcgaggcgggcgcacagcgcggggggcaactgcatcaccccgggcgcgggcgggcgcagcctgtcggccaccgtccgcgagccgagccggacgtgacgtcacgctcacttccgccgccgtcgggggctgcgcgggggctgtggctccgggactgcggtgagtcctggccgaacgcgggcgcgggcgtgatgagggggttgggggactgccaggcccgggggggcccacgaggcgacggggctggcgggacgcggctcttcccgcgcgctccctctggctgtgcagcggtccccgaactctggggccgaagcccttcgggcctgcaccggccaggccagcgtcttgccccgcggcccgacactcagccggggcggggcggagcgggcctccgggtcgtcccgggtgtcccctcccagccctgggaagccgggtcgcaggtccccctctcgcacgccctctcccgtccgccttgccccgcctgtcgtctcccgctgcagtccctggatcttgttccctctaaaccagtcgcgaactggagccaaagtgactccagttttattgtaaccgtttttaatttaaagcccttgggtgacttcccgttactttagttcaaaggccctttcctggtttgtcggggtcctgtcgacctctccagtccccgcagctcccgtgaaacacaggacctgtgctaggtgctcagggcgtgtgggggaaggcatcacagg

SEQ ID NO: 936 - DNA, 1243 bp, Homo sapiens
tttcttattaatttctttattaacccattgatcattcaggagcgtgttgtttaatttccatgtgtttgtgtagtttttgaggttcctcttgttactgctttcttgttttatttcatcgagtcagaaaagatactcaataagattttgatttgttgaaacttgttctgtggcctaacatatggtatattctgtagaatgttccatgtgccgatgagaagaatgtgtgttttgcagcagttgggtgaaatgttctgtaaatgtcagttagacctgtttgatctagcatgtagtttcactccagtgtttctgttgatttctggctggaaacaccctacggagagggggtgttgaagccccctactattactgtattgcactctgcctctcactttcaatctatcaatgtttgctttatatatctgggtgctctggtgttgggtgcatagatatttataattgttatatctgcttgctgaattgacccctttatcaatcgtatagtgactttctctgtgtctttttacagtctgacctgtagtctattttgtgtaagtattgctgctcctgctctttatacagtctttgacttttagtctgttctgtcatctgtaagtatagctattcctgctctttttttttttttttggtttctgtttacatggaatatgtttttccaccctttgactttcagtctgcgtatgtctttataggtaaagtcggtttcttataggtagcatatagtttgatcttgttttttatccatttagccactctgtgttttttgcttgtttttgagacagggtctcactctgttgcccaggctggtgtgcagtggtgtgatcatagctcactgtagccttgaactcctgggctcaagcagtcttcccaccgcagcctcctgatagttaggactacaggcgtgtgccaccacacctggctgttttatttatttatttatttattttttgtagaggcgaggtcttgctatgttgctgaggctggtcttgaactcttggcctcagatgatctttccacattggcctcccaaagcgctgggattacaaatgtgagccactgtgcctggcctactctatgtcttttagttggagaatatagtacatttgctttcaatattattatggataaagacttaatattgccattttgttgcttgttttctgattgtaactcctctcttccttttttactgtcttccttcgcatgtggttaagagattttctct

SEQ ID NO: 937 - DNA, 1192 bp, Homo sapiens
ttccctccacctggaggcctcctgtgcagctgtagcgggaacgagcagccgagggcccagagggatccgcctcattgtggggagaggcagcggtcgggtggtccactcctgccccagagaggccatagcttggcaacccacctgccttcgcttctgcctccccaggctcctttcttcacaccctggagggcccccgcttccgggcctcccagtgcatctatgcgcatcgcacgctgccccacgtgctggctttccgagtgtccatcgcccgcctggccccggggagcgggcccatcacgctgctcctgcggtcagccttctccccagaaagcccagacctggacctgcatcagggtcctgacttccagggagcccggtaaggagggggctggatttgcagccagggagtccagggagggagctcatccctgaggcatggccacgctctcacaggtacctgtatggccacaccctcacccctgagcagcccggggggccacagcaagaggtacacatgctgtggacaccagcacccccagacctgacccttggggaaggtgaggaggctaggacgtgggacttcctgacagcagtgggcggcagccaggctgaggctcaggcctgcctcactgaggccctgcagctgcaggccaggggagctctgtatacggctcacgcacaggcctgggcccagctctgggtagaatgtggcttggacgtggtggggcccctgcagctgcgccaggccctgcgtggctccctctactacctgctcagtgccctgccccagcccaaggccccaggatacatctgccatggcctcagtcctgggggcctctccaatgggagccgtgaggaatgctactggggccacgtcttctgggaccaggtgagcactgtacacccagcaccagccacacagcaggcgacacatggaggtccacggtctctgccctccctgggaccagggctatggttggggaagcacagggactgtggcaaaagggaagaggcctggaaggtgtgcaggagtttggtagaggagtgatctaggtgaggggaatggaaggtgcagagaccagagctgagagggcctgaggcactttccagagcgtggggaggggcctccaccaaggcgagaagggctgcaggtccagatcaccagcgtttgtagacagtagtgtggcgcttg

SEQ ID NO: 938 - DNA, 1218 bp, Homo sapiens
catctccgcccagggctctcctcggccctccacatccaggtctgacaccctggctgctcagcccagcacctgatgccccttagcctgagctcagggtcccctctgccagccccttcctcccatgctgggggttagaggagagacttggggctggccaggggttgggttgggagaagcagcacctggtttgttggaagtgagagcatcagtccttcaaaaaagacagttgcagccgggcctggtggcgcatgcctgtggtcccggctactccggaagctgaggcaagaggattgcttgaacccgggcgtcgtggcatgcacctgcagtctcagctactcaggaggctgaggcaggaggactgctcgaacccgggcgtggtggcgcgtgcctgcgctcccagctactcgggaggctgaggcaggaggactgctggaacccgggcgtggtggcatgagcctgcggtcccagctactccggaggctgaggcaggagggttgctcgagcctgggagttctgggctgtagtgtgttaggctgactggctgtccgcacatcagtatggtgacctcccaggagcaggggaccaccaagttgcctaaggaggggtgaaccggtccaggtcggaaacggagcaggtcaaaactcctgtggtgatcaaaaaggacagttgcagacatggggaggacttgctagtcccagctccaggctggatctgggcgtgcctttcctctgctctaaccccttccatggctccccactgccccctgctgaagtccaagctctccatttggccaagaagcctagcagcctcccctgattggcctctgccaacctccagcctccccttctggcagctcccttcttgccctttatgcttctgcaaagctgaagtaccaaggactgagtccctggactcagtttccgtaggtgccgagtgctgagtcaccaggagtagtagctaccaagtcctccttggaggtgctgagtgctgagtccctgggaggtgctgactgctgagtcccagacaccaactgcaccctgattctcagggcgtgcccacacatgttctttctcccgggaatgctgcccccattttctcaccttttgccaacctcttgccctacaatgccaagctccatgcctcctcacctgccaagtaggcccccgcccctgcgtccacgaacgccacgcactgcctgggagggctgcacgcaggtcg

SEQ ID NO: 939 - DNA, 1184 bp, Homo sapiens
acctggtttattccggttttcttttttttttttctttgagacagagtctcactctgtcacccaggctggagtgcggtggcacaatcttggctcactgcaacttcgcctcccaggttcaagcgattcttctgcctcagcctcccgagtagctgggattataggtggccaccagcacacccagctagtttagggatttttagtagagacggggtttctccgtgttggccaggctggtctcgaactcctgtcctcaggtgatccacccacctcgacctcccaaagtgctgggattacaggtgtgagccaccgccctggcctatttacttagtaaagtctctgcccagccaggccaagccctcactgatgtttcatcatcctgctcaggcgtgcccggtgctgcaccgttggtgctgccagtgagcagtggaggctggaaaaggtgtctgggctgctgcaggacgcgctccagatgctgcacctcaccccacctgcccctcaccccgcctgtccctcaccccgcctggcccttcctgtgaccctcagcccgcctggcccttcctgtgaccctcaccccgcctggcccttcctgtgaccctcagcccgcctggcccttcctctgaccctcagcccgcctggcccttcctctgagactctacaatggcttttcatccaacccagcagggtctgccattgccgcaaggtggaggcatctcagaggccctgcttggccttgccctgtccaggcaggcgggccgtgggttgacctccatgagacagcagggctgggcctgctcctttgggttttaaccaacataaaggtggcaggcaattgaggacctgcacctcttaagaataatcccccaaagctgagaacaccagcatctctgcagagagcacagctgcaggaagtagctgaacccctgcctggtgggggaggcaccgtgggagccctctggcacagtgacccccgccagcagtgatgccacctggcttcctgcgccaggccctgcaggaatggagtgggggtattccctggaattgtgggggccacttactcttccccaactttccgtaaaacagaagccaagcaccacgcgtctgttgggatcccaggtttccacagctcctcctttccaagcctgggaggctgatggtcagaggtcgccctgccccagggctgtcag

SEQ ID NO: 940 - DNA, 1269 bp, Homo sapiens
atgaacggtgattctcaacccaggtcgtattcgatgttaggggtttgttacggattctactagacaagcacataatgaacagtgattctcaacccaggtcgtattcgatgttaggggtttgttacggattctaccagacaagcacataacaaacagtgattctcatcccaggccgtattctatgttaggggtttgtgtagtttccccaggacctgtagtggtgattgtccagaagccttccataggaggaatgcatggtcattaggtatgccacagctccaaacaccagcaacaccactcaatgactattgaggtaatgacagtgacactgcagctccacatggctggggaggtctcaccatcatggcagatggcaaagcgggaggaaaggcatgtcttaatggtgacaggcgagcagaagagctttttagattcttaattttttaaatgactgatcaatatgtgattagtgttttttgtgtttctttttttttttttttttttttttaagaggtaaggtctcactctgttgcctaggctcatggctcattgtaggctcaaactcctggaaatacgggtgcatgccaccacgcttgcctaatttatttttttattttttattttttgtagagactgggtcttgccgtgttgcccaaggtggtctcaaactcctgggctcaagagatcctcctgcctcagcctcccaaagtgctgagattacaggcgtgagccactggacccagcattaattttctttcaaggaagaaaagtgtttctactcctgaagacaaagataattttaaaatactttttcactgggcacagtggatcacacttgtaatctcagtgctttgagaggctgaggtgggaggatcttttgagcccaggagtttgagaccagcttggacaacatggtgaaaccccgtctctacaaaaaaatataaaaattagctgggtgtggtggtgggcacctgtagtctcagctacttaggaggctgaggcaggagactcacttgaacccaggaggcagaggttgcagtgagctgagatcgggccactgcactccagtctggcgacagagcaagactctgtctcaaaaaacaaaaagtccaggcgcggtggctcacgcctgtaatcccagcactttgggaggccgaggcgggcggatcacgaggtcaggagatcgagaccatcctggctaacatggtgaaaccccatctctactaaaaatacaaaaaattagccgggcgtggtggcgggcgcctgtag

SEQ ID NO: 941 - DNA, 1418 bp, Homo sapiens
tgcttcagtggtgagcctcgagggtgccccctgcacttacagaagatggggtggggggcttccctgctgcagcctgggggagaagcctcctgggccctgggttctatagacccccatggcactgactcagacccagacaggctgacctactgctgaccctgggagcccgcctggagttcgaggctctcagtgggtgaggtggacattgcctgaggttggtgccctcggtcctccccagcaagcgagcctgacgctgtccacgtcgtgctggaccgccacctggtcacaggccagaatgccagctccactgtcccggccgtgcagaacctgctcttcctctgtggcagccggtgagggcaccagggtgggcacattcctgccacatcagagctgcacccggtgcttttgcccaagctttgaccacacgtctgtcctgcaggaaatgaacctgctgggtagatgcaccccctgagacagcccaggtgtctccagaggcagccccgtctcaggcttcagggaccccgcctcttccctcctgacaagggccctggatggcagcctggtctggccctgatgggattgttggaggcctcctggaatcagctctgagggggtgtcggctctcctggagggtccaaacccccatcctcctgcatgttctctggtaggaggcagagaaaagaccccacgtgcctggagagctgtgctagctgctaggtggtcctcgggaattccaggctgggttttctagggaggactggttgtcacgtgtggtcactgttgactagacagagtcggctcgggggtcctctgtgtgggtttgccctgctgtggcctgtctgccacccaccacctctttcactgttggtgggggccttgaggggagggcccagccggcgggagctggctcagaactttggccaaaggtgaacggaattttttaggagcagcagcctcctgccccaaggccgaccggcactggcagcactttcctgttgaagaaatcttcctggcgtgtggtttcaaagtgtaagcacctcagtgatgcaccctgtcctaagcattgagaggcacgtttacttgtgaatatgagaccatgagattctcaatgataggaaagtgctgtcccccacggccttgcacagtggcctcgggtagagcggctatcaagagcagacagtggtccagcctgctgggcacctggcctgggctgtggccctccagcgggctgccccctggccccaggttagggcgtccaggagaggcttaggccctctacttcctcacagttccccagtttgagccatcgaaggccttcttcctgcccacctccccgtctcagccacagccgttcccaagcaccagcgtggctcctggtgccagtgacctgccaggaggccccttgtgattataaaacc

SEQ ID NO: 942 - DNA, 1170 bp, Homo sapiens
cctgcaccgttgggatcaatgtctcatttatgtagaaaatgcagaaatctttacattcctcaagctagcccctgccccaatcctgccctggcctgaacacccccagggacagagctggtctctgggctgggggcccccgggcctgggccgggcaggctggaccatacccccagtccaccagctccagtctccacagccatcctggcccacacaggcaccccacacaaacctatttattgaatctgctggacccaagcggctctccagcccttccgtccttccccagccgctcttgtcgccttggcaggacttgactctgcctccctggccagccttgcaagaggactggggtctcctgccctctctgttgagccaggaatcccaagtgaggggttgccctgaggtctgactcttggggcaagcccgccacccactgtgggactttctggtgggctcctcagctcccaccccaggctggggcccagattgtgaggtctgtgtgcatgtgtgtgtgtatgtgtgtgtgcatgcgtgtgtgtgttgtggggatctggcctggcccttggggatggggctgctggggactgccccccttcccgccgtggccaggcgctctgtgtgctgtgtgtgccccaggctctgttgaccccgtccaggaactaacttacccagcttggtctctcctgagtcctccaccctggcctgggattggccagggagcagggcgggcattgggaccagtgtggagcctgagggtgcctgccctgctctggagggagggccaggagctgccacacccccaagtcctctcagggcccaccctcctttttcagcctctgcataaggcccctgggtacactgcagaagccccatccttcccgcctccgggcataaggcccctgaccacacttcagaagccccatcccccctgccaccgggcgatccctgctgtgagccgaagctctccctgccccgccctggccatgtgatcgtgttggtgacagaccctgatgtgctggtgctgtgtccccaaaaccggggccctccacagaggccccttcccagcgacactacctggggctcaggcctggacccccccagttcacggttgctcctgggagctgcccctcccgtcacatcagaaccttggaagctgctgctgctgcttac

SEQ ID NO: 943 - DNA, 1225 bp, Homo sapiens
gtttcggtggcccttcgccccacgctataagagcagtcacttccggaactgctgcccttcgcctttgccgcgaaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgtgagtgtggtgaccgggcccggggtgccggctggggacgcggagtccgtggggatgcggggtgggcggcggggtatttttgggacggaggcctacgggccgagccacgcgcggcctcgcccggcggccccgggatgggccggcaggaggccgccggggtaactccgccgtcgcgtcctctccgcccgcctcaggatgcgctacgtcgcctcctacctgctggctgccctagggggcaactcctcccccagcgccaaggacatcaagaagatcttggacagcgtgggtatcgaggcggacgacgaccggctcaacaaggtagcggccgcccttgccccgcagccgccgtggggccccagtgtcccatacaggcgattcttctgcctgatccggccacatgctggagggttcggggagaggctcgtttcagtctagttggcgatttcttggatagagaagtaagccgggcggaggtcgggcgcggtggctcacgcctgtagtcccagtactttgggaggacgaggcaggcggatcacctgaggtcaggggttcgagaccagcctggtaaacatgtcgaaaccccatccctactaaaaatacaaaaattagccgggcgtggtggtgggtgcctgtagtccccctacttgggaggctgaggcaggaaaatcgctcgaacccgggagatggaggttgcacggatcgtgccactgtactccagtctgggtggcagaaggagaccctgtctcaaaaggaaaaaaaaaaaaaaaagcagggtgggtacgaggcaaaatcgtgattaacaagctttggaagtttaataccagtgagctgcgtaagattgcgttaaaaaaaaaaaaaagcagtcctggcgcatggctcacccggctttgggaggccatggcgag

SEQ ID NO: 944 - DNA, 2213 bp, Homo sapiens
aataaaaaattagccaggcttggttgctcatgcctgtagtcccagactgaggtgggatagtcacttgagcccgggaggtcaaggctgcagtgagatcctaccactgcactccagcctgaagtcaaagtcaatttcattgccagtttattttgccagtgttgaagatacctatgagtagtcaacataagtagtgagatgccctgtgtccttttgtcagtcctaagtctaagaaagctagtgtccatttatttttatatcacttcccaagtgaggctggtggctccctttgggcagtgcagttctggaaacttcagggcctattcccatgtggggaacccagtcctgctgtgactctgggagggagagggccggggatacaatcgtacattcctggtaacagccctgtgattgtctgcttcaggttatcagtgagctgaatggaaaaaacattgaagacgtcattgcccagggtgagttgatgtggacgggctttcgtttgttttcatggtccatcctaatccctgccggtccatctgtggcctgccaggtttcgcttgtggaccagagcaccctagaagcctcacccgaggagtgagcagggctccagtgggctcacgtcatgggcacttctagacactctcaggagcagggcagcagggggcaccctgtgttctcagcagacgtttaggtggccctgcctcttaagcctgactgctcctagccctgaggccattccccaggatttgtctgaagcttggtgtctggagaactgagttcacgtcagcagtccttaccacatgctttctgtgagggggttgggggcagggactgagggtgccagggatgtccataggctccttgcctctttgttgggcagatggttttttgttggcttcagctgagctggtggaacttgtttggaagttgagctgttggggcagctgttcttgtcttccatgcatgtgaccacgacagggccagctcagcaaacgggccaagccatgaacacagcgttgtggccagagatgtggatactggggcagcacactcattccctacctagttatgaacatgtctgtccagtggacctctgagggtggaggtggggaaattgggcaggcaggcagtgtgggcctaattcctagaaggcaagtccctggataggaaaggtggggaagagaagtccccgttgaggagtggctcagggagggagtgttcaggaagaacgggagacactggcatatggtgggtccagatatgttgggtgccatgtgccatctctggtgccatctaacttccctgtggaacagcctcccaggctgggcagctgctctggtctcacctctctgctttctgtaggtattggcaagcttgccagtgtacctgctggtggggctgtagccgtctctgctgccccaggctctgcagcccctgctgctggttctgcccctgctgcaggtaagtggtggcctggtgagtgggcaaggggctggggctcagacggtgttgctgcagtggggtcttcatggggggactggcctggcacttgggcagtgctcaccatgcctctcctctgttccacagcagaggagaagaaagatgagaagaaggaggagtctgaagagtcagatgatgacatgggatttggcctttttgattaaattcctgctcccctgcaaataaagcctttttacacatctctcaagtattccatgagcactttgtcaagggtggcctctgcccaggttcttatccaagagggcaggtgtggagctgaagtgtgggcaacatggtattggggaagcgtttctggtgcaaaatgagcatgaggaggggagtctgggcatcacagctgcctggggtcccttcctgtggccttgagcagtatcctagctcctgagtacaccccagaagaatgcgaacgggctgggcacagtagctcgtgcccattatcccagcactttgggaggccgaggagggaagatcacttgaggccagcagtttgagaccagcctgggcaaatagcaagaccccatctctaaaaaacaacctaacaaggcgtggtgtgcacctgtagtcccaactatgggaagttgagatggaaggatcacttgcccaggaggttgaagttaacagtgggccgtgatagtgccactgcactccatcctgagcagcagaaaccctgtcttgaaaaaaaaggacagcagagaagc

SEQ ID NO: 945 - DNA, 2213 bp, Homo sapiens; identical to SEQ ID NO: 944

SEQ ID NO: 946 - DNA, 1211 bp, Homo sapiens
gagtcctctcctgccacaggcgtgaatctcagcggcaggatttccttcgtgctctgcgattccgtccagcaggacttgattgagaacccatgagatgctgaatacaaggctcctctgcctctgtgttttcatccacattttcaagctgggtgtggtggcacctgtggtccccgctactcctgaggtggaggcgggaggatcacctgaggccaggaggttgaggctgcagtgagtcgagatcatgtcactgcactctagcctgggcaacacagcgagaccctgtcttaaaaaaaaatcagcatttttggtagagtcgtttggtcttgaaaataactattggccgggtgtggtggctcacgcctgtacaccttgggaggccaaggcgggcggatcacctgaggtcaggagttcaagaccagcctgacaaacatggggaaaccctgaccccgtctctactgaaaatacaaaattagccgggcgtagtggcgcatgcctgtaatgccagctactccggaggctgaggcaggagaatcgcttgaacccgggaggcggaggcggaggttgtggtgagccgagattgcgccattgcactccagcctgagcaacaagagcgaaactctgtctcaaaaaaaaaaaaactaaaatgcccgtcctgcgcggcttctgtggcctgcctgtccttgcagtggtggcactgtagccccaggtctgagtgaggctccagccgtctgcgctggggctgcacaaatccagactcctgtgggcaaaattcttttaattgtgttgcattttgagcccttgaattaatcctttgtggcttggcttttttgggtgtccctcttgatctctgggaaggacgggatctaggccatagcttaatgtcccgtgttgtttttattcacaaagtaggtgtgcacacttgccagatagctgaagctcatcaaacctgtacgtgtgaaagactgagcatgaaccaaaacctgagggaagaaacccttgtggaggccacatggtcagcagagaagagggcctgaggcctccaccacactcacaggcctctcaggctcaccgtgtctgtggatggtggggtttaagggggaggcccggtgtcctcgcgtggggttcgccactgtgaccagccaggaccacagcctcttgttgaggctgagacagcgcctccgttgtatagaaagcgctttgttatttgtttt

SEQ ID NO: 947 - DNA, 1194 bp, Homo sapiens
atgatcccctgtgagaaggtgtccaccctgcccgcgatcacactgaagctgggaggcaaaggctacaagctgtccccagaggactacacgctcaaggtgagcgggcaatggggtgccgcacgccccaggtgagcgggcggtgagggggcgcacgctccaggtgagcgggcaacaggtgggggggcgggtggtgctaggcctgggtactgaccaccagggccgtcccaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgtgctggtgtgctcttgtgcctggtcaggggtggctccaacttgggatg

SEQ ID NO: 948 - DNA, 1197 bp, Homo sapiens
taaaaaccattgtttaacacaaggtcaccaagatttattcctatgttctttcctaaggattttattttttcttttctttttttttcttttttttgagacaaagtctctctctgtcgccaaagctggagtgcaacggcacaatctcagctcactgcaacccctgcctcctgggttcaagcgattcttctgcctcagcctcccgagtagctgggattacaggcgcccaccaccatgcccagctaatttttgtgtttttagcagagacatggtttcaccatgttggccaggctggactcaaactcctgatctcaggtgatccactcgcctcggcctcccaaactgctgggattacaggtgtgagccactgcgcctggccttcctaaggatatcataattttagtgcttacatttaggtctacgatccattttgagttaatttttgtgcacagcatgaggtaggggtccaacttcattcttttgcacatggatatctagttgtcccagcaccattttctgaaaagactattccttcccccattgaattgtcttggtacccttgtcaaaaatcaactgatggccggtctgaaggtagtgagttatctcaattgattgttcacagtcagttacagatggaacacctcgttctactctttcccgccttctcactgctgcacttgaacagtctttaaaaaaatcaattgaccataaatgcaaggatttgttcttggagtctcaactttactgcattgatctgtaggtctatccttatgccagtaccacattgtcttgattactgtagctttgcagtaagtttgaatcaggaaatgtgagccctccggttttgctcttctctttctagattgttttggctattctgaaacccttgtatttccttatgaatttgaggatcagcttgtaaaaagacagatgggattttgatagagattgtgaagctatagatgaattcgggagtttggccatcttaacattatgtctcctgatccatgactgcaggatatctttccatttaattcgatactctttgattcctttcaaaaatattttgtatttttcagtacacaagttttatgcatcttttgttgcatttatttctaggtatgttctttttgccaatattataaatgagattgtcttcttcacttcatttttggatggttcattgctagtgtatagaaa

SEQ ID NO: 949 - DNA, 1299 bp, Homo sapiens
cccgcctgttccgaggtgggtagggggtggggggctgttcccaggattcccctctacgctttctgtggtgaccacggattactgcgtgacaacgggaagccgggagccgaggcccggtccctgaccacgcgtgcctggccacccctgcaggaggactgccaccagaagatcgatgacctcttctccgggaagctgtacctcatcggcattgctgccatcgtggtcgctgtgatcatggtgagcgggcgggggcggagggcctgctctctgggctgccccttccgcggggccttgtgctgactgcgccccccaccaccctcctgcagatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcagtgccagtggtgtctgagacctaggggttggccggagggcaggggaatctgacatcggtggggcttggctctgtggactctgtggggtccagggtgagggtgggtgggtcgggatccctggtgttcaccaaaggagtcactctgtaaaatttggggagttatttattctgagccaaatatgagcaccggtggcctgtgacacagccccaggtcctgagaacttgtgcccaaggcggtctggctacttaattgtatacattttagggacataggacattgatcattacatctaagatgtacgttggtttagtcggaaaggtgggacgatttgaaggggagggactttcaggtcataggc

SEQ ID NO: 950 - DNA, 1098 bp, Homo sapiens
tgcagccaggtgggcaccaatgcaggagtcaggctgcaactcctgggctgtagtggtgctgtccactgtgccaggccttggtcttgtagtttgtttgtttactctgttgggtggagatgataccattcttttcccaagtgtctctgaagtttgcatgcatctaatgtatatgtttaacgtttaaaaagatgggagctatgtacacataatgatcagcacttattcagaaatctgaacctactaggttttaccctaaaaaaaaaagcgcaaataagactgaaaaatgttttcctgctctttgatttgtcctgaaacacgtctttacaatatgcttgccatggcatatcattgcattagtaatgttagtggcatggatcagcctaccagttggtaagataagcttgactaggtcagcccttacttttatctgaggaaccatatgctcatcttcaaatggccttgccagactgtctcatcccagcctggttctcccagggagcactgttcgtaacccgttagcctggctgtagctaatgggttccattccggtgcaatagcatttccagcgacacatgactgactgactggtggctttcagtttcaggtcttggagacaaatgctgcatgacgggctgtgggttagggatcttgggtgtgggtgatggtggtaggggcctggggccagtcaccagtatcttccttcctccccatctcagcactggggcctgggctaatggatgagggccactaggagtgggatttcttcactgcaagtgctgcaagtaatgcctggggcagcagcaggggtgggcagtggatgtacctgtatctgtctcttctactttttcctgtctgttttccactatggaaggtgacattcaggtgtccctctctaggtggggccctgggagctgggagtgatgcctgctcaccagctgggggctgccctccagaggggataccccatcttccttgccccatgtgggttatagcaggtccttcttcctgggcttgcatcacttctgtttagactttatcacagggcccccaggagccgcctgggcacgtctgcctagtttgccctcgttggtgtgcatt

SEQ ID NO: 951 - DNA, 1176 bp, Homo sapiens
taagtatttcaacctttgaacaagagcatgctcaaatgtgttgtttaatttccatatatttgtgattttttttgtttttctttgttatttccaggttcatttcattttggtcatatatagtaatgcagaagacttcaattttttgaaatttgttaagacttatttatttgtttaacaggtggcctatcctagagaatgttttctgagctcttgggaagagtgtgtctcctgctgtgttgtgtggagtgttctctctatatctgtgaggtggaattgttttgtagtgctttcaagtcctctctacaattattaagtcttgctttatcatttattactgaaagtgggttgtagaagtatgccaatattatattgctgtctgtttcttgctttgatgctgtaattgtttataaagaacttgcaaaattgaagcaaaaaatagcagtataataggaagttacttcaatacctaaatatatatacgaatatgcacccacgcttgtcataggttcccagttcattctcccttctgttactgttttatgttcttgttttttgtgagctctgacttaaagtatgttttaggaagtatgacattttttgacttaagatgtattttgcataatacaattgtaacctcttctgctctcatttcattaacatttgcatgaaatgtctatttccatcttgccactttcagtctctttttgtcattagatctcaagtgaatctcttgtaggtcagctgtagtttgatcttagtttggttttaaattatttagcatatgccttttgattgagtagtttagttcctaaataagcaatttactgaaatgaaaagatgtactttagccattgtattttttttacttgattcttgtagctttttctttctctctttcctttttgtgtcttgtactttgtataataagctttgactctttttaaattttcttttgtgtgtcttataggtattttctttgtggttaccatggaaattatataaaacatcttaaagttacaacaaggtattttacactggtaaatacttaactttagttgtatacaaaaattctttcttattaaatctgccctcaactttgttactgatatccctaaatcatttaatgttgtatatccattaacagttatttatgattatttttctactttcatcttt

SEQ ID NO: 952 - DNA, 1203 bp, Homo sapiens
agtgattttcctgccttagccttccaagtagctggaattacaggtgtgcaccagcacgcccggtgatttttgtatttttagtagggacggggtttcaccatgttggtcaggctggtctcgaactcgtgacttcaagtaatccacctcccttggcctgccagagtgctgggattacaggcattagccaccatgccgggctgttttcctccattttgtagctgaggtgtcttgcctagtatcacagaagtagtggtagatctgttgttgatgtctatatgctattcagtctataggtaatttaggttaaactactttgcaaattttctatccaagcagaaaatggtaagtttttgatcaatattttggcactactgcagaaagcagttaacaatgttaaatcctcccttctgaaggctggaagaaatgaagataatgcccccaagtgtttgacgaagtccataaacccttagtaataaccaaaaaacttccatttctcttataggggatcatcgtcttgctcttcttttatctcagtttgtgggtagccagtcagtccgggagctgctcaccatgcagttggtggactggcatcagctccaagcagactccttcatccaggatgagagactgcgcatctttgctctgttggctggaaaaccggtatcttctacttttaccataatatctcacattggttttttcataaattgaagctggtttgaggttgaggcaaggagtgatctttgtaaattgtgcacagttacacaaaatgttttacacattggacaattttcaaattataaaggcaggcatgcacacttttaaaaatctagttgtatagaaattaaaatgttaaaatgtatcatatcccatatcatatagtggtaaacaatataaataattttatcttcacagaaatattctagtttagttaattaatttttttgagatagggtctggctctgttgcctaggcaggagtacagtggggtgatcttggctcactgcatcctccatctcctaagttcaagtgatcctctcacctgagcctcccaagtagctgggactacaggcacacgctaccatacacagctagtttttaagtctacatccacatatatgttgttcctatttacatgtttgtatatacaaatgaaataaattatacataggagttctgtgattttttttatttatattttgt

SEQ ID NO: 953 - DNA, 1099 bp, Homo sapiens
tagaattcggctcatctccttagctgcccagaaattcatctcagatattgccaatgatgccctacagcactgcaaaatgaagggcacggcctccggcagctcccggagcaagagcaaggtgtgaggggaggcttaatgaatcagtaattaccttccacaacagtggaggcttatcctgccacccctttggggaaactgaatcgtaggggaggtgtaagacttactcagggtcacccatctgggattgaagtccgggattcctgtgctcagttggtgctcttccctcttccctcaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcggggctgatccctcccatgttgggagacaccatgtggcaagtgacaaagctctgagcccgcccctcttggggccacagtggtagggatgggggaaggggatggaccccatggctggggtagtaccatgactggaggcgggggaggcaaccagaggcctgctgctttggggaggtgcattcccccaaccatgtcccgacacctctggagttcaggcaaggaccttccagtcctacttgtcctgcatcttctcaaggataggcacaatcatgtcaaatttgggtcgctttgcagggtcttcattcatgcagatcttcatgagcttacacacatgaggggaaatacctggtgggatggtaggccgaaggccttccaatgccacctgcgaatacaagaaaaaaagcagcctcacaatttgagtctgtcatgtagagagaagccactggcccttgggacaggattactgtatatccgaacaaatatgtgaggagccaaggcccactacagttattttcaccatcaccaaccactcccgcaacacaaatgtatgctgttgtgctctcaccttcattccaatctccatattggagaggtcagcaaagggtacctcccgtgtcaccagttcccacagaagca

SEQ ID NO: 954 - DNA, 1139 bp, Homo sapiens
aaaactcttggcctctgctttctcctgtagcacaaagagggagttggctggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaaggttgtttttttttttttttctccattctgaaaatagcaggacatttacctcttaaataaacttagcatttagaggtaattctaaatttaaca

SEQ ID NO: 955 - DNA, 1140 bp, Homo sapiens
aaattctgggttgaaaattcttttctttaagaatgttgaatatttgcccccactctcttctggcttgtagagtttctgccaagagatcctctgttagtctgatgggcttccctttgtgggtaacccgacctttctctctggctgcccttaacattttttccttcatttcaactttggtgaatctgacaattatgtgtcttggggttgctcttctcaaggagtatctttatggtgttctctgtatttcctgaatttgaatgttggcctgccttgctaggttggggaagttctcctggataatatcctggagagtggttttccaacttggttccattcttcccttcactttcaggtacaccaatcaatcatagatttggtcttttcacctagtcccatatttcttggaggcttcattcgtttctttttactcttttttctctaaacttctcttctcgcttcatttcattaatttcatgttcaatcactgataccctttcctcctctttatcaaattggctactgaagcttgtgcatgcgtcacgtagttctcatgctgtgattttcagctccatcaggtcatttaaggacttctctgcactgtttattctagttagccattcgtctaatcttttttcaaggtttttagcttctttgcaatgggtttgaacatcctcctttagtttggagaagtttgttattaccgatcgtctgaagccttcttctctcaacttgtcaaagtcattctccgtccagctttgttccgttgctggcgaggagctgcattgctttggaggagaagaggcactctgatttttagaattttcagcttttctgctctggtttctccccatctttgtgtttttatctacctttggtctttggtgatggtgacgtacagatggagttttggtgtggatgtcctttctgtttgttagttttccttctaacagtcaggaccctcacctgcaggtctgttggagtttgctggaggcgtactctagaccctgtttgcttgggtatcaccagcggaggctgcagaacagcaaatgttgcagaatggcagatgttgctgcctgaccctttctctggaagctttgtctcagaggggcacccggctgtatgaggtatcagttggcccct

SEQ ID NO: 956 - DNA, 1173 bp, Homo sapiens
tggctcatgcctgtaatcccagcactttgggaggccgaggtgggcggattacctgagctcaggagttcgagaccagcctgggcaacatggtgaaaccccgtctctactaaaatacaaaaagttggctgggcgtggcagcgtgcgcctgtaatcccagctactcgggaggctgaggcaggacaatggtgtgaacccgggaggcggagattgcagtgagccgagatggcaccactgcactccagcctgggcgacagagcgagactccatctcaaaaaaaaaaaaataaataaaaataaaaggaatatgccatcttggaatccaatctccatgctatgagcaagcccaggcagtcacatggagagtagaactgaggtttctgcctgacaaccagtaccagttgccagccatgagtgaggctgttttggactgggccatctcagtatcccagatgacatcactgaagcagaagaactactcagtcaacccatggaatcattgaaagtaataaacttctgatgttttaagccatgaaaaaaaaagttccagcattgttgggttaatatctagaatatataaagaactcctacaactcaacaataaaaaaaaaaacctgattttaaaatgggcaaaagacttgaatatacatttctccaaagatgaagtacaaataaccaataagcccaagaaaaaatgctcaacatcactaatcactagggaaatgcaaatcaaaaccatgatgagaaaccacctcaagtacattaggatggctatcaaacaaaccaaaaaaatcccagaaaataataaatgttgacaagaatgtagagaaattggaatatttgtgcactgttggagggaatataatacagtgtggctgctgtggaaaatatggcagttcctcagaaaattgaaaatcaaattatcctatgatccagcaattccattctggatatatgcttaaaagaatttaaagtagggacttgaagagatatttgtacacccatgtttctagcagcattatttgcagtagccaaaaggtggaagtaacccaagtgttaatcaacagatgaatggataaacaaaatgtggtatatacatataatggaatattattcagccttaataaggaaggaagttctgacacatgctacaacatggatgaagctttaggacatt

SEQ ID NO: 957 - DNA, 1202 bp, Homo sapiens
tgtgagactgatcactgtcgcccaggctggagtgcagtggcgaaatctcggctcactgcaacccctgcctgccgggctcaagcgattctcctgcctcagcctcccgagtagctgatattacaggtgtgcgccacgacgcccggctaattctttttctatttttagtagagtcgggggtttctccgtgttggccaggctggtctcgaactcctgacctcaggtgatctaccccccctcgtcctcctaaaatgctgggattacaggcatgagccatcacaccggccccacgtagctttgtattcctgcaggcaagcaccggaagcaccccggcggccgcggtaatgctggtggtctgcatcaccaccggatcaacttcgacaaatagtaagtgtccttggactgcttttattgacacagcttgggaggtaggggcagagagagggctggcttaaacaaaaagtttagaagcaagccttgcctattgctgttttttaccaagttaacacttggtgtgaactgagaacctgtcatcgaggctagagtcacgcttgggtatcggctattgcctgagtgtgctagagtcctcgaagagtaactgctgaccttattcactggctgtgggccttatggcacagtcagtcaccaggttagagacatgcttcacattcacctacccacaaactagtggatgataaattttggctattcagaagacgtttattataggagtatgtagattttccatagagtgctgttatgtgacttgaattttagtctcggccctgcctctgacattgtcggtggtttatcctggttccaggaaataagactagccttttcctcatgatagtctttggtggtttttaaaacagttgtttaagtcaacagatgtatcatatgcctgacactgctctacaccagtgaataatttacactctaatagggggtggtaactataaagatgataaacatagcatcttaattggagtgtgtatgaaggtggttgttacctcttcctagccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcggtaagtt

SEQ ID NO: 958 - DNA, 1202 bp, Homo sapiens; identical to SEQ ID NO: 957

SEQ ID NO: 959 - DNA, 1219 bp, Homo sapiens
atgtttttctgtacttccataccttcccttacaaaactctggcttaatctaatccacttatataatctgtacttcccagttacctaccagacattgatattcttcctgtggtagaattatcataggtagttccctatccgtagcagtgcctactgtcactgcccaggttgtatcaggtttgcatttcgtgcttgaactatagctggttttcactgagcacagctcttggcccttcatgttctccagataatagaatcctaatatgttccattgatactcagtgccatgcattatctgaagagattttcccccaaaacagatgtattatgtctgtccttgcgggggttctggtccctgtgtcagtcttaactctcatgaatatagaggtagtgttaagaggccagaaccctagggacgctttaaattcacttcccagcctatttaatgtccattgagtagttctggtggtcaggaaggtggttgtcttcttttgcttagcagggggtatttgagcaggaggaggcttatgctttgccgagactagagtcacatcctgacacaactcttgtcctggtgtgctagagtactcgaagagaatctactggtcttgattcactggtgggggcagtcggtgcccccgttagtgcccagatcagaaacatacataccctgcctagggatttagaaagtgggttggcagtctttcctcacgcccatcacgcagttggtacctactacagtgtattgtaaacttttttctctgttcttctagggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaacacagacgttggccagttaaacatttctgtttataaagtcagaataatacctgttgatcactgaaaggcctgcatgtattgtactctgaattttacagtgaatgagagaatgtaccctaattgttcaacagggctcaa

SEQ ID NO: 960 - DNA, 1219 bp, Homo sapiens; identical to SEQ ID NO: 959

SEQ ID NO: 961 - DNA, 1175 bp, Homo sapiens
ctcctgactttgtgatccgcctgcctcagactccctaagtgctgggattacaggcatgagccaccccacccggtccatatagtacaatcttaacccaaaaagtgtgtgtgtttgtgtgtgtgtgtgtgtgtgtgttttgtttttgacagagacatgtaggagacaggtggaaaatttgaggctgatgaaccaaagagaatttcgagtttttagtactatatgtggttgatacttgaagccatggaaattgccaaatttatcaaagaaaagggattgtgtggccaacagaatgttagagaaatttcaagagttgagggcaaagagaaaaatctagagaagaaattacctgtaatgtagaagaaaaagtacagttcactgaagccatgtttcatgcaggatgaagtctaatcctatgcagggatcactgaaaggtgactattgagaaaaagttattattggctgtgaggaagtttcaatagcatagtggaatagtaaagcaggtcacagggaacgaggagagaatctcctctgaggaagtgaagatgagcggtagctggataggataccctggttgaggttgttttttaagttatagacaactgagtagttttgtagaggaggcatcctgtgaaagagaacagagttgaaggtgaaaaaacccaggaggaaggaggaggagattgaaatgagaacatgagtaaaatgggaactagagaaaaaggaatagttaatgagtgaggatagatggagagatgttgagggaattcactttgacttgtgagtaaatcatattagaggggaaaaaggttcagatccaaactgggaacgacaggaaagtaaaaaaaaaaaaaaatctattttaaaaacaagatttgtggcccgggtgtagtcgctcatatctgtaacctcaacactttgggagtccattgtgggaggatcgtttgagcccaggagttcaagactagcctgggcaactcagccagacctcatctctacaaataataaaaattggtgtggtgacacacgtccgtgatcccaactacttgcaaggctgaagtgggagaattgcttgagcttgggcatttgaggctgcagtgagccatgagtgcgccactgcgttccagcctgggtgacaaagcaagaccccttctcaaataagatttgtgacttttact

SEQ ID NO: 962 - DNA, 1101 bp, Homo sapiens
aaaacttcatataaaacttgtgggccgggcacagtggcctcagcccccggagtagctgggattacaggtgtgcacgaccaggcccagctaatttttgtgtttttagtagagatggggtttcaccatgttggccaggatggtcttgatcccttgaccttgtgatcttcccgcctgggcctcccaaagtgttgggattacaggtgtgagccaccgcacccagcctaattgatgttctcaaatgaaacttgtttattgatgataggaatgaaaaataaaacacctgtatttgtaacatttgctggttttcgtttgctcagtgacttattctgaatcatatatattctgtgtacatctaaaatcactgggttattttgaaattagattttgtctaaacagctattttcctttctatgggttagcaaaatcttacctagttaggattttttccttactgtttttttttggcttccagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtaagtgtttctttcaactcctatagagctttgagaagtaggaaaagttgggaaaatttaagccaatttgaacatgtaaaattatatttagcatagataataaaattagtgaattatatggtaatttcaatttattattttctttttgacatagcattctaactccgcagttgcttttctttattctactaagaaactccttgcacccttttttcttaatcaccgtctctttacctattcaaaaactaagttgtctctaaagacggcctcctcaatgtgtgctgataaaagtccttcaggtaagtttttctaaaatgtgaaggtgatcagaatacattgaggattaaagctctttattacttgtggcttttttttctgtgaatttttatcttaatttaggctcttgattaacttcctctgattctttaagaagaattcattggaatttcatgtgatcttctttaatcagt

SEQ ID NO: 963 - DNA, 1334 bp, Homo sapiens
cagccagaaactttatcagacaagttttttccttataaaagtttcatagtaacagataaaattaaccaaacttacatcattcgaacactattgctggtaagatttggcataatggctttctaatcaaggaatataaaaacgtgaaaatgtgtttagtggtttttggtggtgaagttctggaatacgaaaattggttgtggattctggggttcaaagaatgagaataaatatatgtaacattaatagtcatttttaatagtgttatatctgtttggaaattgagatgattatatttggaactgtatcaaaataactgttgtttatatttacagaaaaagatctataaagatcagatggaatacatgttgcagaatcatgtattccctctcttcagcagtgaactaggctacatgagagcaagggtatgttttaaagctgcattatttatatacttttgtcttgtaatgaatgactctgtggacttttatattgaaacttttaaatgttcactttgaagcctgtgtcttattttaggtttctgtttaatgtaaatctttacatggctgctgtaatgtgtgcataggtttcatctgtgtctggtagcagtgtctgtctgtgtttttcattcagatcttgctatccacacaaacatcatgcggccaaagagtaacttgggatcatagtactggtctagtgttgtctctggacacatctaccactggccagcctccaaattcccacacacagaactcagggaatagagattagcttgggggaatttaaggtaaggtatctacagtaactcactgtgtttttacaaaaggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaaggtaaaggatttttgtatgtcaagaaaagtgaatgttggccaggtgcggtaggtcacacctgtaatcttagcacttcggtaggcttaggtgggaagagcgcttgaagccaggtgttcaagaccagcctgggcaacatctctacaaaaaaaatttttaaaaattaactggacatagtggcatgtacctgtagtgccagctacttgggagtctgaggcagcaggatcactagagcccgacggttcgaggctgcagtgtgctacgattgccactaccctccagcctgggcaacagatcaaaaccctgcctcttataaaatatatatatatatattaattgtaaaaagcc

SEQ ID NO: 964 - DNA, 1334 bp, Homo sapiens; identical to SEQ ID NO: 963

SEQ ID NO: 965 - DNA, 1114 bp, Homo sapiens
aattctaaaacctaagcatacttgcactataacattatgttaattaaatgttgataaatacattttatctataagactgtacactatcagtgtataaattgataaaatattaagagaaattattataagggtttcaacataagatagctattgctatttttgtcttttatcatttactaacttagccagccttttaaaaaaaatcttacaaaaggtttggtgggtgtaacggtagtgtgttcatactgcgcagttctttttcagatgtctagtattaagaacacattaaatcaaggttggttttcttggactcctatggaaattttcatttctattcattattgaacatgtatttaaacaccaattcctggagctctctcttgtcacttgtgacttgtaatttactgacagtgattgagatgattgtcaatttgttgagtaacaaaatatgtcattgttataaaagtacttatattatgacttggcagaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaagtaagtcaacttgttacatgtggatccatttcattgaacaaatctgttgtagtttctgcctgccctttaaaggaagagtttggaggatatcaaacccagactagaaaaggctggttaggcaaagtaaccaaaattatttctaaggttgccatagtttctgagtattctttattcatcctgttattttacatttagattgtaattttggaagattataggaaaataatgtagttcaaaaaagtatacagtgacagtgcctctttgctacttctgattcccaatctcccagctttcctcagaagtaaccactcttacgtgtatacctgtttgttgtatgttattatttgtgtgtatccttttttcctgcccaaacctatacttaacgtgttaagagtatattagcatttatggcatatgat

SEQ ID NO: 966 - DNA, 1215 bp, Homo sapiens
aattggagtttttgaaattattatttatttttaattttttttttattggggataggtttgtctggaaattgtttattattatttatttaaaaagatggggtcttgctctgtcacccaggctggagtgcagtggcactatcatagctcactgcagcctcaaactcctgggcccaagcgatcctccagcctcagcttcccgagtagctgagactacaggtgtgagtcaccacatccagctcaaattattttataagaaccaaagtcattactagcatctttactacttgttttcaagtatgtgtgatactgtaattcaaaaagcataaaataaaataatttcataaatttaagttgttttaatagaagcttcagtttcctgttttatttttcaattacatcttagaataatgatggcatgcaaatatctcccaatcgacaatatagtttgtgttagtttcttagaatctcttcctaggaataataccttgttttctatttttatgtcagagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattt

SEQ ID NO: 967 - DNA, 1223 bp, Homo sapiens
gtcccaggagggaagtaccacttggtcatggtttatgatcttaacatgctgttgaatttggtttgctaatattttgttgaagatttttgcatctattttcagggattttggcctgtagttttcttgtgtctttgtctgtctttgatatcaggttgatgctgtccttataaaagaagattacaaatttccttgttttcatttttttgaaataatttaagaagaattggtgataattctttaaatgtttggtagaatttatccctgaagtcatctggtcttgaccttttctttgttgtttggtttttgattatagattcaatctccgtatttgttattggtctttttggccttttcatttcttcttaattcagccttggtagattatacatttctaggaatttatctgtttaggttgtccaatttgttggcatataattgtacacaatcgtcttttatgatgttttttatttttgtggcatcaattgtaatgtctcttcttccatttctgattttgagtcttcttttgttttttttctcttagtctagctaagggttttccaatttaattttttcaaaaaactctttattttgtcattaaaaaattttttttctcgtctctttctcatttattttgactctaatttttattatttgattcatttttttaactttaggtttggtgtgttcttttttttctagacccttaaggtataatgttaggttttgatttgagatcttctttttttaatgtaggcatttatcattataaacttcaatcttagtacggcttttgctgcatcccataagttttgagatagatttttgttttaatttgtctcaagatattttctaatttccctttttggtttcttctttgacccattagttgttccagaatatattgtttaatttccacatatttttgaatttttttctttttgtttttgatttagtttcattccattgtggctggaaaagatacttggaattatttcaaacttcttatatttgttaggacttgttttctgacctagcatgtgatcaaccctgtagaatgttctgtttgcacttgaggacactgtgtgttctgctacttttgggtggaatgttttatatctgtctgttaggtttatttgatctatagtgttgttcaagtttgatattttcttttgatcttctgtctggatgatttgttcattattttaagtggtgattgaagtatc

SEQ ID NO: 968 - DNA, 1170 bp, Homo sapiens
acagctttaaccaaatcatttacccaaataaagtataggcgatagaaattgtaaatcggcgcaatagatatagtaccgcaagggaaagatgaaaaattgcaaccaagcataatacagcaaggactaatccctgtaccttctgcataatgaattaactagaaataactttgcaaagagaaccaaagctaagacccccgaaaccagacgagctacctaagaacagctaaaagagcacacccgtctatgtagcaaaatagtgggaagattcgtaggtagaggcgacaaacctaccgagtctggtgatagctggttgtccaagacagaatcttagttcaactttaaatttacccacagaaccctccaaatccccctgtaaatttaactgttagtccaaagaggaacagctctttggacactaggaaaaaaccttgtaaagagagtaaaaaatttaatacccacagtaggcctaaaagcagccaccaattaagaaagcgttcaagctcgacacctgtcatctaaaaaatcccaaacacataactgaactccttgcacccaattggaccaatctattaccctatagaagagctaatgttagtataagtaacatgaaaacattctcctccgcataagcctacatcagaccaaaatattaaactgacaattaacagcccaatatctataaccaaccaacaagccattattacccccactgttaacccaacacaggcatgcccacaaggaaaggttaaaaaaagtaaaaggaactcggcaaatcttaccccgcctgtttaccaaaaacatcacctctagcattctcagtattagaggcaccgcctgcccagtgacatgcgtttaacggccgcggtaccctaactgtgcaaaggtagcataatcacttgttccttaaatagggacttgtatgaatggctccacgagggttcagctgtctcttactttcaaccagtgaaattgacctgcccgtgaagaggcgggcatagtataacaagacgagaagaccctatggagctttaattcattaacgcaaacaacacttaacaagtccacaggccctaaactatcaaacctgcgtgaaaaatttcggttggggcgacctcggagcacaatccgacctccgagcaacacatgccgagacttcaccagtcaaagcga

SEQ ID NO: 969 - DNA, 1170 bp, Homo sapiens; identical to SEQ ID NO: 968

SEQ ID NO: 970 - DNA, 1360 bp, Homo sapiens
gttccaggcctattcctagagattctggtttagtaggtctgtggtacaaaatccaggtgattctttctcatgctactagttttccagggggcccaggcttgagaaacattggtcctgcagcatcttcctacctttttattgctgatgataaacaagattcacgaggatcatccttgcaggattaaatctttagctctgtgttgtcccaaatctggataatataccactgttcgttaacttaatatacaaattgttggtagggatatccttgtttcatattctaaaactgtgtagtaccacctaaaactttttggatggatttctgtttatatcatgaactattttaatttacaaatcttaatttataggtgaatcagtggctaacctggttagaaactgctgaagaagaagaatcagaggaagaagctgactaaagaaccagccaaagccttaaattgtgcaaaacatactgttgctatgatgtaactgcatttgacctaaccactgcgaaaattcattccgctgtaatgttttcacaatatttaaagcagaagcacgtcagttaggatttccttctgcataaggtttttttgtagtgtaatgtcttaatcatagtctaccatcaaatattttaggagtatctttaatgtttagatagtatattagcagcatgcaataattacatcataagttctcaagcagaggcagtctattgcaaggaccttctttgctgccagttatcataggctgttttaagttagaaaactgaatagcaacactgaatactgtagaaatgcactttgctcagtaatacttgagttgttgcaatatttgattatccatttggttgttacagaaaaattcttaactgtaattgatggttgttgccgtaatagtatattgcctgtatttctacctctagtaatgggctttatgtgctagattttaatatccttgagcctgggcaagtgcacaagtctttttaaaagaaacatggtttacttgcacaaaactgatcagttttgagagatcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgatgtagtgatgtgtggctgtaaatggcatccatagtctgggagaattgtcagctttgtttttgaggtataggagacccaccttagtttgacttaaggacttcccaatttttgtttttctgctgtacaagcctgggttccagaaggaatttttagactcttcaaga

SEQ ID NO: 971 - DNA, 1203 bp, Homo sapiens
ggacgtcatcgttcaaatcaactcttcaatggccatgggggacacatcatgcctcccacacaatcgcagtttggagagatgggaggcaagtttatgaaaagccaggtaagtaatatttgagtgtgcatgttttctaaaccttatctgcaacatttatttcaaactgaaatgtttatccttaagattagtaaagtattagtaaaatcacatcactttatttgataggttagatttttattcttccctgtttcatcttttactttctctgggcaaattcagttaaactaactttatggcttggctcatccctttggtacttgattaccataatttgtggacccctttttatctagactttctttctccttttctgaaataggggctaagccagctctaccataaccagagtcagggactcttatcccagctgcaaggacagtcgaaggatatgccacctcggttttctaagaaaggacagcttaatgcagatgaggtacatttgcctatgttacttatataccatagtttgtccattcagaaatttattgcccgatgattataaaaagacgcgttattaagaggactttatgctggagttcttgacgtttttctctcttttctatacttctttttctttctttgaatgtccagcgtcctgtgagcgaagattatgagatatgagggcaagtctcctaaagtctgttagagcaagaaaactggttgtcaaaatattgtggtttctttctttgtaagggtgatttaactaaggataaaacagggcattttctaaactgtagttaaatttgcagttttttatttgaatattttagtcatgctaattctaagagaatgtaagatttataatagtatcttactactgtatgcatcagatctttaaattttttgccaaaaattaaacctgttaatgtggagtaccttctttagtttttcaaaaagcttaatgtttccctagattctgtcactgtataggattttagaatgttgtatttaatatgttcgccaactgcatgttgttaatttagatatattttgttttcaattccagattagcctgaggcctgctcagtcgttcctaatgaataaaaatcaagtgccaaagcttcagccccagataactatgattcctcctagtgcacaaccaccacgcactcaaacaccacctctgggacaggtacagaccat

SEQ ID NO: 972 - DNA, 1203 bp, Homo sapiens; identical to SEQ ID NO: 971

SEQ ID NO: 973 - DNA, 1292 bp, Homo sapiens
tttctctctcgctacaagtattctttcactcagcactggggaagttgggaacagctggtcaccatcatccctttaatcaactcacacctgtttaaagagtgtttctgatttgaccttcatcccttagtttactggcgttaaaaaaagtctcagcaattttcattatttctcgtgggtctcattatcaaacctttacttatttcggcatatttcctctgggcttcttctagtttctgccttacaagcaatgctgttctgtaaatttattgaaacctctggaacatttcacctttagagatggaggatggaaggattggtaccagaagagggctaagatacgttttctgtcttgagctgaaagcacagtctactctccttcgttttgtcgatgagaaagttgaggccagaggggaggtgacatgtttagagtcacccagctggttagtgacagaaaaagcgtgagagttgtctaggattcctgccactttggtccctggcctctcctgggggaggctgctgttcttaggtgctctaagcttaatccctcagaatgtgtggacaggtcagcttagaagagatggggagattcaggatccccctgtgccagagcacagcctcaccggatgctgcttcccacactgaagtgtcctgtccgaccattgctatctgaggcatccacaagcaggtaggaaagctggcgagccattttacttcctgaggacaattccccagccacaggctctgagtcaaatttctatttggtaagcatcctagcagcaaagtcctgcactcagaccagccaaaaaacagcccccattccaagtacttggtgtcaaaagtccccgaacgacttttaaacccaagtcttcttaaggtttcagtactgtggtggctttagcagttgtttttgtgcaactataaattatttaaatcatctgagatgacagtcaattttacaaaccaggtacatattaatttgtataattttgtatatgctctggtacactacctgaactaacgaagggtagaactaattctgtttgtcagtgttcacacctgtaacattaggaggatatgtctgcattgcttatttctttatgttggtgtttctgtggcaaagccctgcacatggcatttctgaaaagccttaaatctttaagatgttgcatgtagggtatgcagtgcaaaaggctgcctcagaactgtgagcccttttgtaagctggaagcatttctcttactactgttacttttgtaggaagttttcaattcagagctgccaaagtgttcccg

SEQ ID NO: 974 - DNA, 1134 bp, Homo sapiens
agtattaaaagaagaatatctaatggtatgtcttattttacatattttaatacttgaatatgactataattctgtactaaaaacctcacattttgttaaattatctaggtagtatttaagataacatatcattcaatttccttactttttaaaaaaatgtttaaaactttatgatggtttcgtagaaatataacttgtagaaggaaaatacatatgcattggtgtgatgtcataaagaagacatgaattaggtaacagggagccctatattcaaatcttacctttgcttttaaataattttatgacaggctaagtcggtgaattcatttggacctgaattttccttataggtaaaatgaaaaagtagttaggtgaacggaggtctcatctaagtttaaacttccacatttcagagatgtcagagttctctactgtttctgaaaatgttaccagcccttccttaataataagttttggctaccttatgctccagatattttatgctttctttacttttctttttccaggattactataaaacaggaataatccgttgtcctgatggcatatctattcctgaactgagagaagcatgtgactatctttgtatctcttttgaatatagcactattaaatgtagagatctcagtaagtatgatgttttgtgtgtaagtggtttgtagaattagaatatattggaacaaaaagcctgaaattagtgctatttacctagttagacttaaagtatttaattcaattataaagcattctagtaccacaaagattattaatgaaagcttgcaaagaccttgatgatctccttgtgcaattttccaaatattttttcaattttaataattttcttttttgacaaacccagatttcctcctagacagttttctatattatttatttgttaccagttttatctcctagatttggatccttggctttggtcaagtgtggtcatttggctgcatttctttgattacatcatccaaaaatttataattttttgtattaccacgtgtgataatatgagcactatggaaaacacaaataattctcaaaaacaatacctatcattaaagatcctagattgaatgtctagccctcatgtatacataggattaa

SEQ ID NO: 975 - DNA, 1181 bp, Homo sapiens
gtaattaggacagcttaaattggtattcttattaatcttttactgtaataactttcaaagcatatttattttacttgtgagaatattcggttccttgggtttctatttttaagtggagtaataacataaaattttccttagtcttgatgttagtttgggttagcattagtcagctatacatcttttttaaaagtctacaaataaagattttagaaagcattttgatgttttgggttgtattcctgggaactaaatgaatgtttatggtgttctgttaacatcttatttgaaattgaaaagtagaaatgctgtgacttaaaacaacttttataaatcaaacatttaaaaagatatatataaatcttgaatttgtaaaagaaaatttgcataacttcgtctaacatctttatttcagaacgagaaaaagatcacagttcctctcgtccaagcagtccgcgtcctcaaaaagcatccccaaatggttccattagcagtgctgggaacagcagcagaaacagtagtcagtcaagttcagatggtagctgtaagacagctggggagatggtgtttgtatatgaaaatgcaaaagaaggagctcggaatataagaacgtcagaacgagtgacactaatagtggataacactagatttgttgtagacccatccatttttactgcacagccaaatacaatgttgggcaggtttgtattattgcagttatttgcattactaattataatgtgcttttactgccattatttttttgtttaagttttacagtaattctctgttgaaatgtaacatttctgttttacagatgaaagaactgagctttggaggctaaattacttgtcccaagttaatacagcttagaaagtgatagagtaagagcttgaacttggttttatttctagtgttctttgcagtaccagtagaaatagcaaatatattagttattgaagtcaggatactaaaatatctttacagattgagactgtaaattgaatccaaccaggtgaatttagcaatgataatatgtttcctgcacttgggttcccattcaatcacaaaatataaacaatcagcattgtttaaaggcggaaaaaaaacccaataggtagtttagctgtaaagtcagcatgaattgtcagttcgatgtagatacttttaaaaaaaaaaaa

SEQ ID NO: 976 - DNA, 1220 bp, Homo sapiens
aatctagtgactaattagctgggtgttgtagcgcacacccggtaatcccagctactcgggaggctgaggcaggagaattgcttgaacccgggaggtggaggttgcagtgagctgagattgtgccatttcactccaacctgggtgacagaatgagacttcgtctcaaaaaaaaaaaaaaaaaaaaaaatctggtgacggcttgaaaaatctagcactgaaaggtaattaccagtaaagtttggtaagtctgtttggtatgtccttgattttattgttgataatggtgtcattgaattgaattggggcttaataatatggaataacctactgattgtacatagtttaaataattataaatatcttaatttttctttacagggaatggccttaagtcttggagataaaatcaacttgtcacagaagaaaactagtatataaaaataaacaaaaagtccttgaagctttacagttaatttaggtatgggcttactggactccaacatcttttgtactctttcatgcttatatagaatctgagttcatgctgaatacttttcagccaataatttatagcctttcccttaaatcaagattgagtttaaaattatagtttgtcttttgtcttaacagttctgaatgctgtcctcaaagtatataatgtttcatgtaccaagacccttttcacagtacaataaacagatctattcataaatttttgttattttataaataaatgattacataattttagttatatggcaatggatttcttttagttgggttataaatttctattataaatttaaattactgagttgtgaatatatgcagctttattaagagaatttacaaattcaatgatataaaataaggtaggccttgattcacttggttgttttttacttatttaatattccaacattgctatctctaaaaatgcattatcatgttttgaagggatttgctcttgaatttagctccagggagaaagtatcaaaataacttttttttttttttttgagatggagtctggctctgtcacccaggctggagtgcagtggcgtgatcttggctcactgcaagctccacctcccgggtttacaccattctcctgcctcagcctcccaagtagctgggactacaggtgcccgccaccacgcctggctaattttttgtatttttagtagagacgggctttcaccatgttggccaggatggtc

SEQ ID NO: 977 - DNA, 1188 bp, Homo sapiens
tcttttttattcgggccagtatgcaatgaatcagaaaactacaactcccaaagtgccccggggcggcgaggggccgcaacggtgacgactgtggcagagaaggcccggaggggctctgcgttctgtagtggcgctgcttgggcccttggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatgtaaataataatggcggagtggctgagggttgaggcctactaaagcctggagtaggccgggaagggtggttggaggaggacgcgcctgaggtggcctgcagcgggagagcccagggaagaaaccagaagaatgagtgggaaatgcctcccttaatctttatgagggtcagaaggtttgaagaggcccacacgctgagagccggagacctgcgtaggaagggggattgaggaaggaaattctgagagggtcgaggagtgaaagagcttagtcaagggatttcgtacgtgcgttttggggggccgatgagagtgctttctcgggcctttgtactcagtatagagacggcaagactctccctgttttgggttctaaatgttcccgtgacaatgtcgaaatgttcgtgcacgtttgtacagatttttcctgcctggatgatttttacaatgtgctgttgagagttaactttagctgcactagtaagggtaaaccgagaacagtattgagccgaaaattgtgccacgggtgtaatttggtactggctctggtggtgaggtctaagacgttgagacctagaagcccattttgatgtcggatattaatacctcgttcttcttacctcgtctccccatcaaatgccgttcccttcctcagccctcacctcataggttttaatagcaaacggtttatcccttaaagtaacccgttaaatatttactgcactgccgggtgttgggaattcggagagaaatatgatgcttattttaggcctttttgtatatttgtcctagctcctagcccagtgtcatggaaacggtaggtaaccagtaaacgtaaaactaggtccttcatacaatggataagtgtcttggcaacgttgatggggaaaattgttggaga

SEQ ID NO: 978 - DNA, 1331 bp, Homo sapiens
acatggaacccatggatatggagagctgactgtgtatttgaaaaaatatacatgtccttaatttatgtttatctcatcagttttaatggctgcatacgatttcattatacagttgaattacgatttacttagccagtaatcgataaaattttttggagttgtcttccaaaagggagtatctttattgtggtagctgatcacaaaataaatacatgcttatgttgaatttttaaaaaagctagtctcaaaaggttgtatagtatattatttcattgataaaaaattcttgaaatgacaaaattatagtaatggagaacagatcagcggaagacttagaagagggtacatttctttgaagtggtggaactgtcctgtgtcctgattgtggtggggcacacatgaatgtatgcatgtgatgaaatctcatagaactgtacatatatacatagtatatataaaaacctggcttctttccgcgccgatagcgctcacgcaagcatggttaacgtccctaaaacccgccggactttctgtaagaagtgtggcaagcaccaaccccataaagtgacacagtacaagaagggcaaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaaaaaaaaaaacctgtgaaatctctgtgaggtctgtagtttagttaatagtattaccatgtcagtttttctgtttttgacaattgcactattgtaatataacatgttatcactgagggaagctggctgatcggtacacaagaattctctgaacaagaagattagcatggcccctgcgcaaggatgacacgcaaatttgtgaagcgttccatattttgcgcagtctgtcaagatcatttcagtatctgctaattagcactaaggaactagtgtgaatctaagcaaaaacgggtggcacccaatgacgaaattgtggttttcattaccaaaaaaaaaaaaaaagaattctctgaacaattttttttttttttggagacagggtctccctttgtcacccaggctggagtgtggtggcacaatcctggctcgctgcagcctcgacctccctgggctcaggt

SEQ ID NO: 979 - DNA, 2466 bp, Homo sapiens
ctcttgtcgcccagtctggagtgcagtggcgcgatctcagctcactgcaacctccacctcctggattcaagcgattctcctgcctcagcctcccgaataggtgggattacaggcgcccgccagcaggcccagctaatttgtgtgtttttgtttgagaccgattctcactttgtcacccaggctggagtgcagtggtatgatctcggctcactgcaacctccgcctcctgggttcaagcaagcaattctcctgcctctgcctctggagtagctgagactacaggccgcaccaccacgcccggctaatttttgtatttttagtagagacgaggtttcaccatgttggccaggctggtctcagactcctgacctcagatgatccactgcctcggcctcccaaagtgctgggattacaggcgtgagccacaccacctgatcccacctcttaaaagggggaggggggtgcaaaatatctgtactcctggagcttgtagtctaattggaggtatgacacatcaaaagaaaatatgtcatagattgtaagtagtcagagctcattagaggtttaaaagaaataacgtgtaaagtttttagaagaatatctgaccagagttctcagtaaatgttagctgtggaatctcattaatccctttggtcatctgtattccagcaagctcactgtgatgatggttttccaacattcgcagtttccaccagaaaggttttccttagtgttgggtaaaccttccttggatgtctgagtgagctttatgtgcattctcacgttggtttctgtgatgtataaaagtatacccccatcttacagataggaaactatgccctgatttctgagccttgacatcatcacattctccagtttgtgtttcgtgttgaaagttaaaacgtgattcccttttcaggtgtaatcctgagagattcacatggtgttgcacaagtacgttttgtgacaggcaataaaattttaagaattcttaagtctaagggacttgctcctgatcttcctgaagatctctaccatttaattaagaaagcagttgctgttcgaaagcatcttgagaggaacagaaaggtaagctaataaataaaacctggtgctaagtaggactgcttgtactaaattttttcggtaaaatgtaatgcatctggtttgaattatccaaggcttagtacacaaaccagtgtagtgctgctttgaagttcaaattctatccaaagagattttcattatagaaagtgcatggtagctctacattctcttattaatgtttgataatgttaggtcattttgggtggttttcttgaattgcaccaaattttatttttaggataaggatgctaaattccgtctgattctaatagagagccggattcaccgtttggctcgatattataagaccaagcgagtcctccctcccaattggaaatagtaagtatcaactcttttgtcgttgttatcaagaataggagtcagccagtagtaaaagtcctagtagtaaatatgttcagccttgggggctagtagtaaatatgttcagccttgggggctattttgttaactgctctttgagctctggcctggtagtgggaaagcagccacaggcaatacataatcgaatgggtgtggctgcttgtctttaataaagacaagcagagggccatagttgcagaccccagatttagaccatgaataagccctttgactctcttttagatagtaggtagattttcctttcatacctctactcccaggagtttgaattaattttcacatgaattgctcactatgatgattggttgccagacattcgcagtttccaccagaaatgtttttccttatgttggccagttcttccttggatgtctgagtgagcatcttcattcattgtgcttgaacacaatgagttggttcaggtattcagaagtttggtgcactttatatagtttggatttattaactgtttgagaatagcaccattagtggggagattctgttaatgaatgtggagggactagtattaatcctgattttctttctttccccttttttctttttcagtgaatcatctacagcctctgccctggtcgcataaatttgtctgtgtactcaagcaataaaatgattgtttaactaaaagcatgtttcatatttattttcctagaagaaaaattatatatatcagtggttcatatgtgttgatcttgtttgatggggaagtgttttgggtgattgatgttaggattccagggagcagtaagatactgtccatcacatcccttgattggccccttaaaccagttgagcagcttataacctcataggtggttgctttaaacatggagaactggaagacactaggaaataatgcctttgtgtttgttttggtgtcatggcaaaaatgtttctaagtatttttgatacatttaatgttaaaagactgagacagat

SEQ ID NO: 980 - DNA, 1139 bp, Homo sapiens
gtttccactctcgctctcctttcgttgcctgatcgccgccatcatgggtcgcatgcatgctcccgggtgagctcggggcatcaagccggattgctgggcggggggtgggaggaagacagggagtgtgggcagcgggccgaggggatgatgttctgggctgctctggcactagccgccacctcacctcgagactgcttctctccccaggaagggcctgtcccagtcggctttaccctatcgacgcagcgtccccactgtaagtagcgcgctgggaccggggagaatccggggagggggttggcatttgtctcgggtgaagcgacgccagggtgaggaacttgcgtgtatgaggagcgcggttttgcggaaggagagaccgctgttctgcggcgccattcctgggttctcatcctaaggctgctttctattccataacagtggttgaagttgacatctgacgacgtgaaggagcagatttacaaactggccaagaagggccttactccttcacagatcggtgagtgtttgtgtctaacatagcctatttcgcctgtcctcgtgtgacttgtaggatctagtaggtggtaaagttattttaaaaatagccaaaactctggtctcgccaccgtgctagaggcatcattgtaagcacttcacatgtactgatttcgtttaattctgaccacaatactttgaaataaatcttcatggctttcaccccagtttacagttgaggaagcagaggcacactgccgctggatactaaccagccccaaatcacacagctgtcaagtggaggagttggaattggctaagcagagtgcctgacacagttcctcacagttaggtgtggtttgaatctcagctgcgtgtgacttcgtgcaagtggcttcattcagcaaatgtttaccttctatgtgctgaacatggttctggggcctgagaacatactactctccgactcccccgcccaaaaaagccagccgcaatgtgcctgtagtcccagatacttgggatgcagaggtgagaggatcaccagagcctagaagtcccaggctgcagtgagctatgatgaagccactgcactcctgggtgacagagagaccccacctctttttttttttttttttgagacagtc

SEQ ID NO: 981 - DNA, 1185 bp, Homo sapiens
aggtgtgagccactgcgcctggcctatgcattgtattaatttagcatattccaaaaataatttaagacaggcaaatgataaatgtggatgtttctggtggtgcatcacattgtaggtgatttcattttagtagttgtacctgcatagggctaaaaattaaccctctcaaagctctgagagtgccggagggcctgaaagagtgcctggtacttcaaaggttcccagggataagaaaaatgaatgagacagtgcttgctctcaagaatttctcatccatttggaagacaacgtacattttataacagtataattataagggcaggctaaataggatatggtcacctgggctgggagatggaaaaggaatgagggggtttgaggaggaagaggatgctcaagttgagtcttaaatgattaattccttctattcataagggcaggatggataaacgtgatcaggttctaggccctgctctgcttctatcaagcggtgagatattgagcaaactgcttaatacttctggtatccattttccttattcaggattcgactacatatataaagcagtgctgtacatgagaaatatgtgagccaaaaatgggagtcacataggtaggagattttacattatttttttcccctaaatcttttaaatctggtgtatgttacacttggtacatctcaatttggaacagccacatttcaggcacttaatagctccatgtaactagtaactgccatattggacagtatagatctagaggctgggtgcattaatgcatgcccatagtccagtgctttggaggatcgaggcaggaggatctctcttttttttttttttctttgagacggagtctcgctctgtcgccaaggctggagtgcagtggcgtgatctccgctcactgcaagctccgcctcccaggttcacaccagtctcctgcctcagcctcccgagtagctgggactacaggcgcccgccaccacgcccagctaattttttatattattttagtagagacagggtttcacggtgttagccaggatggtctcaatctcctgaccttgtgatctgcccgcctcggcctcccaaagtgctgggattacaggcgtgagccactgtaccctgccagcaggaggatctcttgagcctaggagtttgaggctgcagtgagctatgatcacca

SEQ ID NO: 982 - DNA, 1100 bp, Homo sapiens
ccctagcctagcgtcttttctagtgagtgtgctatctcagatgcgctgaacaaagaggtctatcatttccatgccctcatatggagacttaactgaaagagaagattgggtaggacctgcacatgacaatcctatctcagaaaaaccatggataggggattctatagtcagaggcctattctggtttgctggtattcctctccttgaaaaatcagtacttaatatttctattatgatgccacaagggtagaagctaacagtaggagccatagaagcacaacaacaattcataaactctttagcctcagtagttatgcaaaatagacaggccctagatatccttatggccaaagtagggggtacctgtgcacttttaaaaagaagcatgtcacttctagatcaatacctctagtcaagtagaagagaatgtacaggtgcttaaagatcaaattagaacattgacagattaagagagaatgcgggctccagtcccagttggctacaatccctcttaaatggattccagtcttctttgtggaactggttagctcctttattaggcccccttttgctcgtgtgttttgtactaatgtttggactttgtatattcaatactgtaactcaaattgtttcctctcacttagaggctattaaactccaaatggtgctgcagatagaaccacacatagacacgccattcttctggggacccttagaccaatctcaggaggagccctaactgctgtaaccccaacgacgcccccttccagcaggaagcagccaggagtggtcatcgtccactttccccaacagcagttggggtctccactcctgaagcagggaatgagaaaggaggaaggaagaaaccagtcagacaggcagttagggtgggtcctcggtaaaattcttccaaacaaaagaacagcttgaaaaatcaaactgcaggcacagagaagagaacttgtacagggaggcttgccttagacatgtccacagctgcctaggtaagaaagactacacaggagacttgcccagagatgcccacaatggaaaattccattccctgagacatgcgcagtaaggggaacaaagccatatgg

SEQ ID NO: 983 - DNA, 1277 bp, Homo sapiens
gaggccaagaggtggatcacctgaggtcaagaatttgagaccaacctggccaacatggtgaaaccccatctgtactaaacatacaaaaattagccaagtgtggtggcgcacgcctgtagtcccagaaggctgaagcaggagaattacttgaaccctggaggtggaggttgcggtgagctgagatcgtgccactgcactccagcctgggcgacagagcgagactctgcctcaaaaaaaaattaaaaaaaaaaagctttataattatagagactgtaagtcttgggaaacctgggaatgcatagacaaaatgtgagattttttttttttcatttcatcttcagggtctttacggaataaaggatgatgtcttccttagtgttccttgcattttgggacagaatggaatctcagaccttgtgaaggtgactctgacttctgaggaagaggcccgtttgaagaagagtgcagatacactttgggggatccaaaaggagctgcaattttaaagtcttctgatgtcatatcatttcactgtctaggctacaacaggattctaggtggaggttgtgcatgttgtcctttttatctgatctgtgattaaagcagtaatattttaagatggactgggaaaaacatcaactcctgaagttagaaataagaatggtttgtaaaatccacagctatatcctgatgctggatggtattaatcttgtgtagtcttcaactggttagtgtgaaatagttctgccacctctgacgcaccactgccaatgctgtacgtactgcatttgccccttgagccaggtggatgtttaccgtgtgttatataacttcctggctccttcactgaacatgcctagtccaacattttttcccagtgagtcacatcctgggatccagtgtataaatccaatatcatgtcttgtgcataattcttccaaaggatcttattttgtgaactatatcagtagtgtacattaccatataatgtaaaaagatctacatacaaacaatgcaaccaactatccaagtgttataccaactaaaacccccaataaaccttgaacagtgactactttggttaattcattatattaagatataaagtcataaagctgctagttattatattaatttggaaatattaggctattcttgggcaaccctgcaacgattttttctaacagggatattattgactaatagcagaggatgtaatagtcaactgagttgtattggtaccacttccattgtaagtcccaaagtattatatattt

SEQ ID NO: 984 - DNA, 1225 bp, Homo sapiens
atttcaaaagctatataaattacactataagtgcaatgaaggggtaaaaatacagactgtgaaggaaatatacaaaaagagctacaaaagcatatagcaggggaccttgctctagacacatagtgatagaaactaatacttacaaagtgttcgctgtttcaaagcactgagctctgcatgtatcagcccatttataatcaccacgactctatgtagtgggtgctattgttatccttattttacacatgaggaaatttaggcacagaaacataagtaacttgttcaaagtcaagccactagtaagtagcaaacctagatttgaaccaggtggtcttgctccagagtccatgctcctcagcacattgctaagagaacaccttctcctaccatctagagaggtggccttaggatgatgtgtcaggagctgtgtgaccctgggtgggccactacccctttggacttcagcattcttgagttaaaaataagactactggactagatcagagtccaatgtcttatgtagggaatgagggacccttagaaatcacatgaagaaatttgtgtgcatgcatgtctacgaccataccaccctgaatgcgcccgatctcgtctgatctcagaagctaagcagggtcgggcctggttagtacttggatgggagaaatttgtgtgcacgtgaatgtgacatgtttcttaagtgtggcactgcaatttaaattaaattttcagagtggtctgtggccccaaaggagtgcaggaaattattccttctagaatttagtgttccatgaaatataccgagaaacatatcttgtgtgcttttgtatggaatatgccacatgctcacgctcagaagaatgcaaatgtatacatagtgctccctgcagagtgggtgaatcctgagtccatcttaaataattttccctgcatcttctggattaccctttcttcctttgatttgcgatcattcctccttcaactgcatcgttctgtacattgaagatccagacatatccctgtctcgctctaatgtctaaggccaaataaagcttggctgcacagttgtgatttcataaatgtgcccagtaaatccaacagtgaaacattttattaggtgggaaatgccaaatgccatacataagttatttatttacctatcaacaccaataagacaatttcattttacaggggtacagttggattccaaggctggcaattcgtggct

SEQ ID NO: 985 - DNA, 1210 bp, Homo sapiens
tacctaaagttcttcctcattgtgtaggctaaacaaagaagctgggtaagaagagtgagtacgttttacagtttatatgtatcacttatataacgtaagtaaaattttgagcttatagctagttactaaaaacttaagaaattgcccagaaccgcataggttattgtggatttagagatgagtatacattgaccatgaaatatatgtttaaaaatagtctttctctgcatgtgtctttgtatgtctctctttctgtctttcacatatatacacacattatatgtatacatatatacatgtttttgtaactatatgttttgtgaattttgttttctcaaagttttgcctgaaaatttcaaaatattgaaaatgctttgatgtgtttgagattttataaaatattatccatcttatttaatcagctcaataacaaactgatcagtaagctttctgctgttttgccttttttttaatgcaggactcggaagatggaagaacttattttgtcaagatccatgccccttgggaggtattagttacctatgctgaagtcttgggaatcaaaatgcctattaaggagagtgatattccccgccctaagcacactcctataagctatgtgcttggacctgtaagactcccactgagtgtgaagtatccccatcctgaatattttactgcacaattcagcagacatcggcaggagctcttcctcatcgaagatcaggcaaccttctttccatcctcatcaagaaacagaattgtaggtagagaagacctttgggcacatcccttcaaatacgagatgtatgcttgtgtgtgcttttatacatgtgcagatgtcgtaccatttctgcaaggtgcttctgtataggatataagcatttggtgatattggggagtttgaaagtctaattagaccacataaacgtattactctccctaactctcaaactgttgtttaaaagtgagtggttgatggtatggatgtagtaaagaaagagatgttatacaatattggaaaaagcaattaattgagagctagaggactttgattttgtaagatctttgtaaaatggttttacaaacttggagtttggttttatacagtcagtgcatagtaaaggaactatcattccaaatggaaatgaaatgttttaattcctttatatatggataaaatttgagaaacctcaaaacttttttttcc

SEQ ID NO: 986 - DNA, 1210 bp, Homo sapiens
agcaatgaacagagggaaataagctgtggtgcccagactcttgaaagcattaccttcacattacgaagttcctgaaacttgtattgcttattgttgaggatggagagccgaatgcctcagtgtaaagaatccttgaatcctccagagtagtaaagattaaccaactctattaaggctgttgtgcagttctggttttgctttgtttataagcctttgcttttttaaaacagaagcaaagattcccaaatagatttgtaattgtaagactcaatgtaagataaccctaaagcattagcctataggtcaaaggctttgacattaagtgcattttgcttgggttctagttttatttattaattggacgtgtctgagccgtactttccttatctgtgaaataggattaataattacatatgtatagcttccatagagcattgcacaaaatagggctcttgataaaatctctttttgataaaatctcttttccttacgtgaaagataagagacccttgtaagtattttcgattaactataagaaaataaatactttatagtctacggccataccaccctgaacatgcccagtctcgtctgatctcggaagctaagcggggtcgggcctggttaggccttggaagggagaaaataaatgctttataaatgtttgtatttagcatgagagctgctatgtgcaaatatgtatacatttgccccaatctccatgataatatggaatattgagaatatttattgatcaaaagttatgtaagtactttccttttaaacagccatttcaatattataatttttataataaaactataaaacaaaaagaaaagaatttttttcagttagtaaaactgcagcaagttattaaacttgaaatagttccgtgaacctgagcaaatttttaactgaatataaagctaaatttttttctgattgtgataaaggttttagtataaaaccttaaatgtgttacttgaacaagtggaggtttaaaaatacttattatcatctcaccaaaaagtcacatgcacctgtatgttcatagcagcactattcactactgcaaagacatgaaatcaacctagatactcatcaacggtggactggctaagaaaatatggtccctatataccatggaataccttgcagccataagaaaccaaaatcatgtcctttgcagaaacatgggggcagctgaagg

SEQ ID NO: 987 - DNA, 1217 bp, Homo sapiens
gccttttgtgcaattttatgttcagtgatctccaaatttatttattctgttacaagtatttctctaaaataacccagagctctctcaacttactaggtgttagagctactacaaatgacttatcttcaaacatgatctctttctgattttcttaaagtgaagggctttctaaacaagacctatgtttcatgaaaatgtggttagtatgacattttaaacaaggcattttcttaaagtaacaactcctagatttttttggtagcaaagtgcttgaagattgggagaccaaaactgaattgcctgggcaagtactaaaggcagtatttggtatgttgactttaagaactgagattatgtttgaggagatatcaacttaacagcagagttaaggtagatattttcctttcatgaatctttcatgcagtacatttcttctggttaaatttggggttgaagttgccagtagagtttacctatcgtgattttttttttttctgttaatctggatttcaagagtcaagaaagggtatctgcagaaagtcatgtctgagatgagactcaaagaataagcacatgttggctaaacaaagtagaagtgaaagtgtttcaaccagaatcagaaagaaaggagacagcatacaaaaaggcccagaagtaacagaggaggagatgaggggaagagagagagagagagagacctcatcagaactgtagaagtgcagccttgagagttgaggacaaaaggaggagtgggcaacgagaggctggtgtagcaagggagacatgatgccaggcagacacacagagccagctcatggagagctacctgtatgatgagagctttggctttctcctgaaggcaataagaagattctaaataatttttagacgaggagaaacatgagtagattgcattttaaatcattcaggctgtagtgcagataatgaattgaaaaggtataaagttggaggacgagcattccaccgttttggcttggagagtgtggaggtcaagagggtggcagctcattctggggacctacctcttgaaattccaggtatatatattattatctactgtgtgaggctatcttgtgtcttggttatttaaaattgaaacaccgttaagtttatctttgtcctgcaaacgataacagaaaagcaacatgttgattttggcttattctgatacatctgcctggcatggaggaattggt

SEQ ID NO: 988 - DNA, 1220 bp, Homo sapiens
atccatggccgtgacagtgacaagcggccgtccctggggctggcacctgggagcctggccatggtaggacgcagcgctgggggcagggcctgaggctggcgcggcagtcgacagtggtaagaggcctctggcagccagcccgccaggcaccgtgaaggctgaggagcaccagccgcagaacatcaacaaattcgaacgccgacaagctcgccctgcagatgcctccgcagcccggggaggtgaggagaccaatgacctacagcagaagctggaggaggtgaggcaacctccaacccgagtccggccagtcccctccctggtgaccttgacatcacttgtcaagttcgtgggcaacatctacacgtgtcctcaaatgcaggttctgcgaggtggaattccagggccccctctctatccaggaagagtaggtgcggcacttacagcggcacatcctggagatgaacttctccaaagcggacccccagcctaaggagtcccaggtcccgcaggcacagacagtggcggcagaggcttcctaacacaaaagcattccagatcccctctcgtgccacctatgtctcctcttcttcctctgtgtcctcgtccctcttcctctttctttccatttccataggagtaagccaaaacctcaaaccagcgcccccttgggggctgggcacactacagccagggcgccgggagccagctagccgcccttcccccagcccaaagactctgggaccacagggtgtcttccttcagcctatgcccacctggtccagcaggggcagcagccaggtctcgggtggcagccgatctggtcacaggggaggacagcattcccccgtctagcagccaggcagggcgatgtctgccatcggtggccatttgcaaagaccccaaagacccctgttctggtttcctctcgcccccatgaatatcctctcaaacgcgtctacatgcgaacacacacgcacctcgtgagacctgggatctgccccggacccccagttccagggttgaacgaccacatcatgccacagtgcttgctcaggggaagccacgctccctctgtggggcccgctggagcctgggagccccccactgaccccacaatgccacggaaatccttgttggctgccccccagaggggccttcccaactgggaagagcctagagctgacagctggctcctgccatgtcaagactcccaaagagcg

SEQ ID NO: 989 - DNA, 1234 bp, Homo sapiens
atttcattttctctgacctctgctgtgcctggtaacctagcacctaggttttcctggttggtttctccagataatgaatttcttgtctcttaggaagcatgaggagaggaaggggttgtgggtgaagctgttagcggaaagggatctcaatccagaccccaagagagggttcttggaccttgtgtaaaaacaatttggggtgagtccataaagtgaaagcaagtttattaagaaagtaaaggaataaaagaatggctactccataggcagagcaacagcttgggctgcttgattgataatacttataattatttcttgagtatacgctaaactaggggtgtattatgcatgagttttctgggaaagaggtgggcaattcccagagctgagggttcatctcctttttaaaccatatagggtaacttcctgacattgccatggcatttgtaaactgtcatggccctagtgagagtgtcttttagcattcaaatgcattataaattgtgtataatgagcagtgaggaggaccagaggtcattttcatcgctatcttggttttggtcggttttggccagcttctttattgcaacctgttttatcagcaatgtctttgtgacctgtatcttgtgctgacctcctgtctcatcctgtgacttacaatgcctaacctcctgtgtttcagccttattgtacccagcccctattcaagatggagtcgctgtggttcgaacacctctgagaaaactaatccttatgcagaattccaaccattactgctttttctatcccatctcttctgtcttctggagaagctggccactacttcagctcccttggactattaggtttccacttatgttctgttccatctttgagcacttgttgacatctctcatctttgttcttgggaatttatacctttttatatttctttaagcttaagtggagttttgggagtgaatattaattttaaaatgagagaaagataaataatgcatggtagttgaagtgtcatgcggagaacactaaacttgagatcaagtgacctcagatcagtcttaactctttgtgacttgtagtgcagcactaggtaagtggcctggctttttaaagcctttgtttcttatttccatgatagaggcaatattacccatcatattaggttgtattgaggctcataagagaggatgtatatgaaaaggtttgccaaatgttcttaatgtaattttttaaa

SEQ ID NO: 990 - DNA, 1219 bp, Homo sapiens
gggtctgtatccttatattcacattctacattttgattaaactttaatacacaatcctgtgaggtgtgtacttattttagagatgagtaaactgaggcacaaagtgaacaagtaactggcatatggtctccgcttggccacagtgctatcctaagccccatttctaattgatcactatgtcctacttacactactttatagatggttttctaatccatacccttttttttttcaattcccattgccatttcttagaactttgctacaatcacctaattggtttgtctctaatttttcacccctcctaaatcatcctccacctgctacaacattgacctttctagggtgcacagttattattaatctctagtttatcatctttcaatggtcctaatttctcttagaatctaagtctgagttttgggtcctccatcatgtggcatctcatcttttgtctcctactttccctatttgttactttataagtgaattgaattacttgcagttaccagaatttccactgtaggcagtatggatagaaaaataataataatgaaggagccaggtagtgtattaggtatttatgtatgttatgaacctattcaatctttggaacaaccctatgtggtttctactactgtaattaccattttacacacaaggcacaaagtggcttacaaactgaggcaaagaagattaagtaacttgcccaatttcacacaacttagatttaaatccaagtagtcttggctccagagtgtatgctctttgccaacatgcttggaaaagcaagtagggtatgctgatgaagtgagaatgtatttaaagaaagaccagctctctacccaatcaggtgcctaaggagggcatagtctggtctacatccttgcaggtccagaaatctgatctcaatgctattcctgcccacattcacaatgacctgatttatgaagccagaatgccaatttactaagttacaatgagatctacaactctccgttgaactagatcgaccatagaaacacatcgtccttttgtaagtgcagtattagaggaggataaataagtatataattctcatatgctttatgcttcaagctctgatagcttacttcatccatctgcactactagaatatacctttgaggtggacagggtactttcgtttgcctaacagcctcctccccttaccactctgagagacaaggcttggatgggc

SEQ ID NO: 991 - DNA, 1253 bp, Homo sapiens
taattttaaggcagcattcaccgcattgcccttttgtgaaccaaaatgcttatctcaaatagcttctcaactgattaacaaatgattacccttttgccaaggtaatgtctgtaacttttctagtagctgtggttatgtgtgtacttgagagcaatactattgttcatttctttcaaaaaaatgaaatctgccaagtcagattgatttcttctccccagcaaccacacccccaccaaaccctttgggttatattatcaaaaagatttttgctgtatgctggaagtccagcagggtgcagactacatgagagaaattctgaaggtgatccatgggggctgtagtgtgtctaaggagccactggacctcatggaggaaaacctgtggctcttgtgggattgccaagatggatgaggtgagggaggggtcttcaacattatttgaaatagttgttgaatacagtatttccgttttagtttttcagaaagaggacagaatttgagattgtgctttgtcattcgtagtcagttttataatagagcaatcctcaacaggctgctgagcttcgtgcttatctgaaatctaaaggagctgagatttcagaagagaactcggaaggtggacttcatgttgatttagctcaaattattgaagcctgtgatgtgtgtctgaaggaggatgataaaggtttgtttttaatttttttctaatatttcctaataaaatcttttaaatttttcttgtgaattatagagtcgtccctcattatctgaggcaaggaggatttggaaccctcagatacagaaggctgactgtatttatatgttttgaatttcagactacaggacttttaaatagataggtagtggttgtatgtattttgggggcacaggtgatattttgatacatgtatgcaatgtgtaattatcaaatcagggtaattggaatatcacacatcttttctttatgttggaaacattcaacagttctcttctagctctttcaactatacaatacattgttaaccagagtctaagcactgttgttttcaatcttaccttcacacatgctttcagtttgtgtaatctattatacctataaagtaaacctattttgagaaaacctttattttatacataggtgtatttcttaagtgttattacactaaatgcttatagtcttagaataaaatgaaaaaaatgaagctctttcctgttcataagtttcagattaacatcaaatgggatacagtttca

SEQ ID NO: 992 - DNA, 1383 bp, Homo sapiens
tgttgctgccaccagctttgctggtgaatttcaaagagaataggtgtttgctgtttgatttctagtgaccttttggcgagctctgatttataggtagaacatttgtgtttcttttcattttgaggccaggtggtagagtggaaagactgggagctgtcaggaaaccaaggcttggatctccactctgttatgtaccagctggggcaaatcagggcccattcccaactcctttaaaatgaaaggactagacttggtctttaagctcccttccgattctaacatttggtggtagcaggattgtgcacaaagctcctaatttagagaaagatctgggttttagtcttttctcctctatcgccgccttaccggttgtacaacattggaccagccattctccccaaggcctcggcattttcattgttaaatgggaacactcctaattcacactgttgctgtgaggattacatttggtaatgaatgatagaatgctttgtacatggaaaaggactatacctttcttttttaactacaaaggcgaacatgtaaccctctacctgtgggcgcacatttgctgtggtgttacgttccactggtagcgcccaacctcccttcattcaagcacattttacgggcctacagggaaggttttcttcctgtcctctcctaagacttgtttatgttcatcatctcttctatactagagctgcagtcttacatttgcttacttcctgacatccacccccaccccagtgatttctccccatctccacctctatattatttgaactaaatgaattcatgaatgaacaaatgagtggatgaatgaatggtaatggataatgggctatgaagtcatatttaaaggcactatctcatttaaaaacaatctaaataaataactacaatgatatttgcaagtgtgtatttatattggattttgcattatataattattttaatggaaagcctttttagtcatagtattcaaagcaacttcaatgggtggggaaggggataatctttaagcccaggtaagctctgtttattaaacgatcaagtgttcactggtactttcagaaatagccagagttctacaaaatatgtgttaaaagtctaaacatataattctacttaaaactgtccctcatgtgggtttctgtcacacctgacttacatttattgcctaccgaacttaagaaccagaactaagctataggcctggttcgatggagtgtcacttttcttgacttaaaagtaaccttaaaacaagaggggctgggcaaggtggctcacgcctgtaatctcagaactttgggaggccgaggcaggcagatcatttgaggccaggaactctagaccggcctgggcaacatggcaaaacct

SEQ ID NO: 993 - DNA, 1515 bp, Homo sapiens
tttttgaagactggaattagtaaaaatgataataaaagttttaatgtgtcaataacaattggcaccaagtagtcattttcaggttattaatataaattaatgatatggaaggggtaagatgtaaataactgatatccacattaagctgaaaattatacgcatttctttttgtaacttatgcagtactcttatttttaatattaattttgtgatatagattttcagcataatcaagtacactgcagcctcaacataacattttctgctgtacctgaaatttgataatatttaggtctgttttggacctattcaaagggctttggtcatcagcagtactgaatatacttcagcacaacacagtgtcatctgtgatatgtcctcagaatggacccaaccaatagcagatttaaatagaggctacagtgtactcattgtatttgtgctatagtttagattgtattacttggtggggagggaaattactggataatagcaggaacattgtgtgtgttttatttttgtgtgtgtggttgtgtatgtggtatgtatgtttgtgtgtttgtatgtatgagagagattgtgccttatgtggagtctggtagttttggcccatgaccataccttaaagtttcatcacctatcctctgggaccatttctttccttaatatatttaaatcaccaaagtagcttggcacaaaacaggtgaggcctgtctgaaatatgctgaagcccgtgctgctttgtattaactcattaaaacaaggaacctggatcacctgcacctgatctgcattctagtctggctttagaaacacattagacttaaattcaaacgcaccagaaatgaaaataattgatatataattgtttttgtatagtgaagtagaactttctgagtttttgaaatttccttgtttctcaattattcaggcattattcatgcattttattatagcgtaagttaaactgaaataggcagttagatactccattctgtaactctgaacacaatgggtttgtttctccaatttcctagctgtaagttacaaactgcatcctaaaaaaaagtttcaggaagaccagatgttattccaaggggctgaaagttgtctacataacaggctcaattcatataatgaaatgaagagctgctagcagttgcctgatttatttagttggtaatatttgcagttacttcacacacacaaacatacacacgcgcacaaataggtatatataacatgtattaagaacaaatggtaaataatatatatgtatattttttaaaatttatatttttggtttaggaattaaggttttaaattgaatgctggttttagaaatgcatatcctgagctgtgtttttctctttcctggtttgctgtttattttttattttcacattctatatttttgtttagcctgtgagaggctaaagttttctttgatcatatcactcaatgtggccattaatatttctggagaagacacaaacctatttataatacttttta

SEQ ID NO: 994 - DNA, 1307 bp, Homo sapiens
aacacagttatttgtgaaggtttttctttgccttgttttgaaggtggcctgagaatggagcttctctttttcttgggataatagatacatcaacttttacaagaaaatctctgtctcttcaacaatgatgtccagtgtgtgctgctgagtggtacaaaaggaaatagtacttgattcctgttagaaacaggagtggtagaaccacagtcttcccaggccgcagcctctgtttatagaagcttctgaatgtagaaaagctgttgaatttcatttaaatgtaaataaccttttaaaaagcgtatggagttagccagttccccctagttaatggacataggaagacatttgctgaaatggtagggtggccactttgtgaccatgatgttgcaagttgccctccctggcatggtgagttggcttccagagctgtgggtagaggacatcgcctcacggcactgaggcaccagccgctgcctacccatcaatgcaagcaaaacagctactgactttgtgtagcagggagattggggactctggttccctcgccaagtgtggcagcctgtgcagtgttgggggcttacttggtatctgttggagaatgaggtcctgtcctgctttcacccatgacccatctagcttcagctgtatccattttcttctgagcccatcttccattgtcctcaacgagtttctttggtctttactgaaagaagatagtagaaatttaaaagttgagagaagactagaaatggaactgattagaaggggaggttcaaactgtcaatgcacagacttttcaaagaagttgtttatattttccaatggcaaactgccctttctggaatgttcagagatgatgtgtcatggaaccttcaaacaagtctcttgttcggatgataataggtagtgtccttttagtatgctggttgatctttcatagtgttagtgttttgttacttaaaaaggaaatcagctataaataaaatgtatttttgtaattcccgtgtgtatatatggtatatttctatcaatggccagttgttgtagtccaaaacctaaatcagtttgcaaaacactgtggacagtgcgagattttattgacaggttaacacaatgcctacgtctatccacataggcattcaatgcacttgaatgaacaaagagccaaagaaactcagcctgttcatgcaaatggtatgagtctgataaaatcagctacattgtcctgctttatcaataataatatttcattagtgcaatgatatcaaccagtactttgtctacttggtaaatgcctggaaatactg

SEQ ID NO: 995 - DNA, 1212 bp, Homo sapiens
cggtgcagcgggacagggcgaagcggcctgcgcccacggagcgcgcgacactgcccggaagggaccaccacccttgccccctcagctgcccactcgtgatttccagcggcctccgcgcgcgcacggtgagcgccacccgggaccgagccgctgcaggggaagagggccgctgcgcccgggtgtcctttatctccggacccgctggagcttccgaggggcttgcccccaagtccccccaccccaccccggtcatttcccatgcccttctctgcccccaagccccgacctctctctttcctcccttctccggaagccggcaaaagccggccctccccggtagggaccgttgcagtggccgttggcggccggcgcggcgatgccccgcctccggcgcgagcctcggagcccccgggctggtaggccgagccggcggctccgcgggggaggggcgggtcggggggcggtgcgaggcccagccgggcgccccgctggcgggtcgcgcgcgcgcccgcgcactcttcctgccctcgaggcgcgccgcgccccctcccccacccgctcgcgtaggctaccgctcgctgcgcgttttgtcccgcgtctcgccccgtccgtctcctgactggccgctcttgtccttcctcccgctttttcttctctctccttgcggtctgaagatgccctcggccaccagccacagcgggagcggcagcaagtcgtccggaccgccaccgccgtcgggttcctccgggagtgaggcggccgcgggagccggggccgccgcgccggcttctcagcaccccgcaaccggcaccggcgctgtccagaccgaggccatgaagcagattctcggggtgatcgacaagaaacttcggaacctggagaagaaaaaggtgccaggagttggcggggaagggaggggtggctgcggccgggctctgcggcccctccgaccctggtcgctggagccttcgcttcttttcgtctcgggagcgttactaggtcccctcctcccaccccctggcccacacgccccgtctccacgttcagcgggagcttcgtgcccagaaaacgggctcttggaagaggcacttgtcacctgactcggacgcggcactgtaccccaggcctctttattactcttccgctgtgggtccggctttttggcctttaggagtgggacatgtgagggtgggggcctgtcgtcaggacttc

SEQ ID NO: 996 - DNA, 1116 bp, Homo sapiens
atatttaaaagaataagaaaacttctaccactaaggagctttataatgaaaagaagtaattaaatggtacaaaatggtaatgtactaagagtaaatcttttgagttattttgggtctcttgtgctaaaaagtagatgcctttcagaagacgttaatatagcctttcaaataatttgtttggaaggatcaatcatgcaccctgctttcaaaggtttggaattgtggttggagaattttacccccaatagctgagtctaagggtaggagaaaggtaagagactttattcatgtgtagtttttcttatcattgtatgcaaatttaaggattaaactttaaggagactgtataagacacttcttaaactagaaagtgcgtgggagaacaaacggtaatgagctgtttatgtatatatctttttcttttttaaattatagtggttggcacttaccatggttccccagaccagtcccatcaagtgactggtaaccaccagcagcctcctcagcagaacactggatttccacgtagcaatcagccctattacaatagtcgtggtgtgtctcgtggaggctcccgtggtgctagaggcttgatgaatggataccggggccctgccaatggattcagaggtaaaaaaataaaaaaggaggttctaatgaccttttactagttcaaattattttttgatttgtaaaatatatcacacagtttttgggaaggatgtatctgcattagcctcctatgtgcaatttaaacaatgtatattttggtacaatttgtgtatttggtataatttgttatttaaataacagatcatggaatttttgttcatttggttatgtcaaattaatgtctaccactatctcctggaggataagtattttccacattaccaaaacttacggggattgtttattatatttgtacagatgtgtgtttacatgcatagatgggttaaaagtttatcttctgaggggcagttagtacttacagaaatttataaacagattggatcaagataggaaattggagattaatttgattaactagcctggcttataatttctagttcttcccgtcttcattaataaaaaagtaaaaattccttgtgaaga

SEQ ID NO: 997 - DNA, 1538 bp, Homo sapiens
tgtcagctttctattacctggatatggaaggaaactatttttactctgcatgttctgtcctaagcgtcatcttgagccttgcacatgatactcagattcctcacccttgcttaggagtaaaacaatatactttacagggtgataataatctccatagttatttgaagtggcttgaaaaaggcaagattgacttttatgacattggataaaatctacaaatcagccctcgagttattcaatgataactgacaaactaaattatttccctagaaaggaagatgaaaggagtggagtgtggtttggcagaacaactgcatttcacagcttttccagttaaattggagcactgaacgttcagatgcataccaaattatgcatgggtcctaatcacacatataaggctggctaccagctttgacacagcactgttcatctggccaaacaactgtggttaaaaacacatgtaaaatgctttttaacagctgatactgtataagacaaagccaagatgcaaaattaggctttgattggcactttttgaaaaatatgcaacaaatatgggatgtaatccggatggccgcttctgtacttaatgtgaaatatttagatacctttttgaacacttaacagtttctttgagacaatgacttttgtaaggattggtactatctatcattccttatgacatgtacattgtctgtcactaatccttggattttgctgtattgtcacctaaattggtacaggtactgatgaaaatctctagtggataatcataacactctcggtcacatgtttttccttcagcttgaaagcttttttttaaaaggaaaagataccaaatgcctgctgctaccacccttttcaattgctatcttttgaaaggcaccagtatgtgttttagattgatttccctgtttcagggaaatcacggacagtagtttcagttctgatggtataagcaaaacaaataaaacgtttataaaagttgtatcttgaaacactggtgttcaacagctagcagcttatgtgattcaccccatgccacgttagtgtcacaaattttatggtttatctccagcaacatttctctagtacttgcacttattatcttttgtctaatttaaccttaactgaattctccgtttctcctggaggcatttatattcagtgataattccttcccttagatgcatagggagagtctctaaatttgatggaaatggacacttgagtagtgacttagccttatgtactctgttggaatttgtgctagcagtttgagcactagttctgtgtgcctaggaagttaatgctgcttattgtctcattctgacttcatggagaattaatcccacctttaagcaaaggctactaagttaatggtattttctgtgcagaaattaaattttattttcagcatttagcccaggaattcttccagtaggtgctcagctatttaaaaacaaaactattctcaaacattcatcattagacaactggagtttttgctggttttgtaacctaccaaaatggat

SEQ ID NO: 998 - DNA, 1174 bp, Homo sapiens
aattctcagagatgctgacattttaattcttagttaatgtgtttccagagcattgataataaagatttcaagcatattaaatgcttaatattgtggaaccaccttatagctaattgtcttctgaattggagtccctaaggtgcagctgaattctgctgataataataaaatgtgataggtcatcaatggcttagctaataactcaggtgtcggtctttttccggactccagtgttatgaagggaaggaattttcttgtcacttgacaaagataaacttcatgaacatattgcaaaaatacatacacagtcatttgtagttagtgacttgaggcccacagtttcctttctttctttatttttattattatttttttgacacaaagtctcactctgtcacccaggttggagtgcagtgctgcgatctcagctcactgcagcctcctccttccaggttcaagcaattcttctgcctcagcctctcagttagctgagattataggcaggcaccaccacacctggctaattttcatatttttagtagagacagggtttcaccatgttggccaggctggtctcgaactcctgacctcaagcgatctgcccgccgtggcctcccaaagtgctgggattacaggcatgagccaccatgcccggcccatggtttgctttctaaaagtaagctgaggagagtcaggcccatgatggaaaaattaaacaagaaaactaaacttggaagcctggacatacaaggttagagttgaggagacattaaactggacctcaaagaggttgaaatgggcctctcagtgcacgaaaaccctccctacagttgaggccaagcttttattgaaacctttacaactttttttagtctgtacattttaaaatatgaaaattagtatttgctgtgaggagagctattaataaacacaagcctgaggctcacacaccaagtgggtgtacgtgcacaagcatccggaacaatccagtacagagctatgaggatttggatccagaaaattctggggtggagcttgccccgtctgtgacctggcatgaatcattccatctcttggatctctgtttccttatctgtggtgtggagaggtcagactagattccccaagggcttttctgtctctgatagtgtttctagaccccacatggacactg

SEQ ID NO: 999 - DNA, 1198 bp, Homo sapiens
gatgagaagagcaaggcttggggacattatgtaatttttccaaaccctagttcattaagtggaagaatgaatatatttaaccctttatcccttccacccaccaacaaatatttattgaacacctactatacgcttgctctggacactggggaaccaaatgattatctgaacccatatctatctgatcctgaaggccattctttttccattagagtctagtgaataaactcatttaaataatttcatagaaaattatattactctatgattagacaagatattaaagagatttttatggggtggtgagactatgggaacacataaaaataggcatgaaagactgaataatgctagatttagacacttggcagggaagacccaagccattttgcttgataggtacttaaccccagaaacaacaaaaataataacaaaattttacagtcacattttctgattatagaactttggaaaaaattataaagaagcaaaatttatttttaatgttataagccagagataataactgtaattattttaaagtatgttctagtttctcccccaacccttggctgcttcatatttagctggctttgaactttgtgaatctgtaggttgatgtctttcaccagtatgggaaaaattttagctattatttctttgcatattatttgtactccattttctgtcccttctctttcttggatgccaattacatttattttttagccttctcactctatcccctatgtcccttattttttcccatgtattttaaatctttttgtctctttttgcttcattctgagtttttttaagccatcttttagtttactaatactcttcagtggtatctgatttgctattaaacttatctactgagctttaaattcctgccattatacttttcagttccatgtgtttcctttgtttatttttttaaggtttccagtcttctgctcaatcttgttttatttcctcgaacatattcagcatagttatttttgagtagtgttagataacaacattatctgtattctttataaatgtgtttctattgtctgtatttctcttgattttcagtcttgccttctgtcttagtcagtttgggctgctacaagagaataccatagactgggtgacttaaacaacaaacatttatttctcacagttctggaggctgggaagtccaagatca

SEQ ID NO: 1000 - DNA, 1274 bp, Homo sapiens
cattgactgttaatccccattctctttcccactccaggcaaccactaatctactttctgtctctgtaaaattgcctttcctggaaattttgtatatacagaatcttacaatatgtgatcttttgtgtctggcttagttcactgcatcatgtttttgaggtccatccatgcagtagcatgtatcagtatttattaactttttatggctgaataatattcctttgggtggatgtaccacgttttgtttatccgttcatcggttggtggacatttgggcggtttccactttttggctattgtgaatagggctactgtgaacattcgcatgcaagttctggggctgatgttgaaacacaaagattagccaaactggtaaccttctctcttttctctcctctcttgggtttctcagaacccggcagtgggcaggtgtttgtgacttcagagaaccaacttgtgtattaccccagcatcacctatgccatcatcggcagctccgtcatttttgtgctggtggtggccctgctggcactggtcttgcaccaccagcggaagcggaacaacctcatgacgctgcccgtgcaccggctgcagcaccctgtgctgctgtcccgcctggtggtcctggaccacccccaccactgcaacgtcacctacaacgtcaataatggcatccagtatgtggccagccaggcggagcagaatgcgtcggaagtaggctccccaccctcctactccgaggccttgctggaccagaggtgtgtgctggatggaagagattgaggcgggagaggtcatccattgcggggaggggaataggtgcacacactgaggttcttaggtcttgccaagagcctggcttcagctgctataggcagtggcagcatctgacatttgccgagtcctcgcaaaattctctacatgtatcacctcatttaatcctcttagcacctcgctgagggaggaaactgataggaatgttccaaaactggattatggtgatagttgcacaaatcaggaaatttccaaattctacagatgaggaaactgaggctctgggatgttaaatgacttgtctgaggaacatacagttaggatcctggcctgctcctcctgggaatgtcacgctggtccatgttctggccacagactagctctgagcctcacctgctactgcagagcagtgcccagtacatgtgagaggtttggttaatatctgtcaaatgaatggataaatgaagaagtgaatgaatgagagaatcagtgagttcctta

SEQ ID NO: 1001 - DNA, 1178 bp, Homo sapiens
ctgacatgacaaatttttgaaaagtcatttggacaaaactggcactgaatcaagcaaaaattcaaaatagttctgcctctattaagggaatagaatttgttatccaagtatattcacaacaaaaaaagtcaaagctcaaatggtttcacaggttaattttaagaattgtttaagaaagaaataacaaccatcttagacagctacatcttatataatacttaggaggaaagagacttttagtagtgacaaggtttcatggaggtatctcaagaccaagacctaaagttgattatgattgaagttccattgtccttctactgaacactgaaggaagtatctttttatacaatcataacagaaaagccaaaaagataaataatatggtgccataatgcttacattattatggataagtaatatataatctaaaagtatattagcactgtatattctatttatagatttaaaataactacacactacatatgctaatacatatgatatatatttatatcatatatgctacttcgtatttgttttaacttaccattgtaaactatgactttcctgactcttgtatggtattaagttagagaaaaagtgatcatagtttttgccatttactgttttgccattaacagtaatggcaaaaactgcaattacttttgcaccaacctaataaataggtgatgattaatgcataatattctatcctatgctttaagttgtccattattattgaatatttagcttgttttattctctttaataatgtcagtaatgtatcttttttcatgtttatgactatttgacatatttaaatttcaaaagtgaaaatacataagcaaaacatactaagagctttatgactatttattgccaaatgacttttcaaaaataatggtttaataccatttctacaaacacatttttaatccagttcatttgctgaatattatttactattctttattttctaattccaagtttatattattgtgttcatcctttaaattatttttataaaagcgatattttacctaaattaaaaagccagtgtgattacccagaattagatgacctcattgatgaatcaacaagtatcaaaaatggaaacatatcttctcattgaaagcatattcctctatttacatgcctttgagatttgccagctcttg

SEQ ID NO: 1002 - DNA, 1145 bp, Homo sapiens
aagcaacagaatgggtaagtttgccaacttaattctcacaaaattgtagcccatgcctttcaggggatcctaatatgcaaagtgggaagtttctgttggatatgtggcactacttggctatgcactccaggacagccttcacattggaattttattgggaggaagcatttcatgttacttatgtattgctggctcttctggaaggcaggaggaaatgggatgggtgtgaagccactgtcagagcctgcagacttggaactgtccagttcagacatctttcttttcggtttcttctatacattcttcgagactaggttattttgttcatttcactaaccattttttatttaggtctttaagaattaaactcaaggagagaacttaacctgagcacagtacttggttattcttaaactagtattcacaaatcattgacagatttgatcactggtctcatttgtccctaacatgtttctgtttcccagattacattccaggtcaaacgtgtaaagaaacccaaaggagatcataagaaaactcctgggaaaaaagtagaaacaggtcagatagaaaatggacatcgttaccaagcaaacctagagatcactggccccaaggtggcatctcctgggccacaaggtaaatttgaatgtttaatatgccagtttcttgttttagatgtcactatctcatttctcacaaaggttgtatttgtaacttgaaatagttcagatgagatgataaaggggcaaagtgtggtcaagaaaccagtctatcttctgtatcaatgaaaaaaatgttcaaactctaaaacattatggaaatgcaaattccagtggatttaacattatgtgtaataaatcataaaggaagaaaaattaggtgaatatttacatgctctttccatgtggaaagaactttctaaggcagagagagggaaagaaaataataattctgacactggaaagtaccacaaaataagacaaaggactgaagcaaagtttttttgtagattatttttgtatatatttacagaatatatgataagcagagggtatcaatatcatttaaagagcacctacaaatcaatatgaaacatacagtatttcagtaaaatacgtgcagcgtacataggcagttcacca

SEQ ID NO: 1003 - DNA, 1287 bp, Homo sapiens
gggttcggatgttggccaggctggtctcggactcctaagctcaagcgattcgcccgcctcggcctcccaaagtgctgggattacaggtgttagccaccgcgccctgcctacgcccacttcttactataatctttccattcactagcggcttctctgatcccatttcctcttcgaacctgagctcaaaccagcctgggtctgaccggccaatccgagcgcagtcttccgcagtcgcgagtacggctgcagccaatgagagaccggggcgcctcggtggggtgagacagggcgctcactggcggaaccccgggggacgcggtgatgggaggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcaggtgagtcggatgcagcgccgcgtcctcgctcccgcggcggcccggaccaggcctgggccgtgatgactagttctggggtctgctcctggccttcccctccccagctctcctctttctcaggctcctgtgccccgcgggcccctcctggctcccttggctgtcttctgcttgcttagactacttgcagagttttaaggtacgaaatacactgctcgctcaatcctgggaatctaagctcagcttagggtgtaggagaaaactgccttaagtctctggggcttgtgccctttaagccattccgtgttcatggagccagtcagtcgccctgctgcctcctcagtcacacgctgtcctccttggttcgccccttgtaagtgtttttaaaataaagtttttcgctcggtttgaatattggccctgtgctaaggatgcagagcattctgttaacatgtttgggcagaggatggaaaggggtgtagggacacaatttcagaaggctttttgcactgcggaatcgtacctccccagttacgattaagatagtaatcgtatctggatttggc

SEQ ID NO: 1004 - DNA, 1207 bp, Homo sapiens
agtttcttatctctctgcttccaccttggctctcctgcagttgattctcacacagcagccacagtgatccttgacaagctttggtcagattatgtgatgctctgcctagatctctctagtggtttctcacccactcagattaaaactcagtatttgtctcgtggctttgaataaggctttattttattttattctattttatatttatgtttatttttattttttgaagctgggtcctgctctgtcacccaggctggagggctgtggtgtgatctcagctcactgcagcctctgcctctcaggttcaagtgattctcctgcctcagccccccaagtagctgggactacaggcgagtgccaccacaccctgataatttttttgtatttttattagagacggggtttcaccatactgaccaggctggttttgaactcctgacctcaggtgatccacctgcctcagcctcccaaagtgctgggattacaggtgtgagccaccgcacccggcctgaacaaggctttaaaccacctgcttcctgcttccattgacctctgacctcatctccactactcttactccgttccacccacatacacctcttgctgttccttgaacaaccttggcattgttgctttggggcctttgctttttcctcttcacggaatgctcttcccccagatatccatgtgactgacccttcttactctccttcaagtctttgcagaaatatcaccttttcaatggaaccgcccctcctacctataaactcacagtcgtttctccctcactcccactcctatccattaccctgccccacttttcctttttgtcatagcacttgtcaccatctcccctactgtatactttgctcatttatgatgtttctgttagaatgtgagcactgtaaggcaaggatctttgtcttttaatctcaagcacctagaacaatgtctgtacacagtaagtgccaatgtacctttgttgaattaatggaaatatctgttaagtaaggtattcatacatatatatatatatatatatatatatatatatatatatatatatttttttttttttttttctgagacagggtctcactatattgcccaggctggcctcaaactcctgggctcaagcaatcctcctgccttagcctcctgagttgctgggactataggcatgtgtcccagctgtgtctggcttcca

SEQ ID NO: 1005 - DNA, 1160 bp, Homo sapiens
acttttttccttgaggttctggtgtatttcaattggggggtcagatgttttgctttagttttctattttttgttctactttgcaaaataatttgtgaactgttttttctccttcttctgaaacctcaagtgctatacatctaaaaatgctagattgaaaataaaccaaggctggttagacaaagctggttacagagttatgatagcagggctgtcatactagttttgaaaatgtatagtgcactgagatcaaaaagatgtccttgaatagtattggtaacaggctaacctttcttcatctgtggtatcaggaaattacagggagttacagggaactgaacactctgccatatttaataaacattaaatataaatttggtagtatatttattattctttcccaaatctttacaaaattgttgtgagtagattttcctttagtaagaaagatttctccaattaaagttttagtaacaccttgctaattggtaaggcttattggtaagactaattcgtgaaaaattaaattctagagtgtgttgaccaaaatgtagtttttaattttgaaattgtgataaaataagtccataccttctggaactaccattctttttgaattgttgaagactctggaccaaattccctggaaaatctctttgatagtaaatacattgaatagtaagcatatagaaccagaaactgctataaagttaaccatagagcattgagtatatagtttatttgcttcatggaaataaatgaatactacagttggttgacaatttttacacaagtttagtcagccattttgtgaaaaaacttgagaaaatgaaaaaaatcaggaggcagaagagaatcatgatagaatagcagaactggaagggatgttagcaacctcttcacttcaattattagggaaatacatgctggaaaaggtaatgacttgcccaagattatgcatccagttagagaatggccaggccagacagttcagtggcaaagggcagaagtggtggatgcatctgtggtagattgattaaaagcaacgataggagcgatgagcagcaggctctgacagcaaagtggaagagatttgtctgggttgaattagaggaaagtggtgaggaggaaaagcagaggtgatttagtgatagtgatgag

SEQ ID NO: 1006 - DNA, 1199 bp, Homo sapiens
tggttacataaatgtacacatgtattagaattcatagaactgtatgacaacgacaaaaagtcagtacaaacaatgaggatcagagaggtgaagttgcccaaggacccaccccttgtcattggccacactgggatctgaaccttggtctgtgggactacagagcatcactctggaactttagaactagataaacattgggttcgattctttatcctgggggactttgcgctgagggggtgtgggacctggagctgtcagggctgagtgtctgggtttaaggtgctttacattgaacactgcatttccatcccttcttgacctccccttcgtaatccttcccaccacagcagccagctagaggagggactcaacagcatcctggcagcttgtggcctttttctttacagcatttagactagtgggaccaagtagagggttgatgggatattgatcttctggcctctttcacccaaacagactggatcaaccaggtgtacctgccggaaaaccatgcccggctcaaggctgcccacacctatgtctcagaagagcttagggcattggggatccccttcttgagtcgtggggctggcttcttcatctgggttgacttgagaaaggtaatgctggtggaggtgcgggctgagagggagtttcaggtctccctccagcaggtgaggggcagttggtgaggggtctcagctatgtcctgagccccttccaccctctcagtacctgcccaagggcacctttgaggaggaaatgctgctctggcgccgctttttggacaacaaggtgctgctgtcctttggcaaggccttcgagtgtaaagagcctggttggtttcgctttgtcttctcagaccaggtccaccggctttgcctgggtgagcagcctgcctttccagcccagtcctaactgcagccttcactgtggcctccgcttgtttgtccccacccacgtggccatcagtgccaactggcccctcacttccccttcccagggatgcagagggtccagcaggtgcttgcaggcaaatcccaagtggcagaagacccccgtccctctcagagccaggagccaagtgaccaacgcaggtgagctggtcattgtctcgtggccagagggcccagcagccactgtggacctggggcgttctggggctgcagaagactgactgtggatgtgccatttgccag

SEQ ID NO: 1007 - DNA, 1211 bp, Homo sapiens
tttcaaaggcattgaattcatgaaatgagtatcttctatataaaaagcacactgttagatgctatggggggtagaaacatgaaaagagatttgataccttccctttagggggtcttgtagaaagcctgaaattcccagacaaaataattccattacaaggtaggctgaggtaagtactgtaagagatgtcagacagtgtgccgtggtgtgtttacatagtacactagggcctaaagagacccatttgcaggaagtcacgttgttagctgtctaagggaagactttgacattgaccttgaacattttcagaaggccaacagtggtggcattgaagcaatactgaagagtagaaatattaatacaaaacattgcagccatttaaacttttcaagttttacaggtgtgagctgttgtcttttggcatttttgtgtcaagatgcctcagtattgcttggcgtcaacccttgtagaaactttgtggtctgtagggatcaaagttagtggatcagcaaaactagtttgtaatctcttgcctctttgtgttcctgcaggaggctactttctgtgtggttcttcgtggagctcggctgggccaggcagtattgagcgatgtgttacaagctggctgtgtcccggttgtcattgcagactcctatattttgcctttctctgaagttcttgactggaagaggtgggtagtacctcctagtaaactctacattagtggttctgcgtatattacaaataaaatctcctcaggtcattgtaatgtataccctggttcaagaactactacagatagtttttctctattttccattaggagagttagtacactggtctagagcagttcacaaaccaaggccagtttgcaggctggctgtttttgtaagtcaagttttattgaaacacagccgtgtcccttcctttacgtatagtctggctgttattgtgtcacattggtagagttaagtaattgcaacagaaattggatgacatacagggcttaaaatatcactatctggcctttcatcacaggggtccccaactcccgggctgtggcctgtttggagccgggctgcacagcaggaggtgaccagcgggccagtgaacattaccatctgagcctcgcctcctgtcagatcagtggtggcattaaattatcatagaagcgtggaccctactgtgaattgtgcatacaagggatctag

SEQ ID NO: 1008 - DNA, 1150 bp, Homo sapiens
ctgggcgtggtgacgcatgcctgtagtcccagctactcaggaggctgaggcaggagaattgcttgaacctgggaggcagaggttgcagtgagctgagatcgtgccactgcactccagcctgggcaacagagtgagactctgtctcaaaaaagaaaaaaaaaactgtgcctggcacatggcaagctctggatacatactcaggcccagtgtagggaagtgctttgcctaaggacaaccctgctatgtcagggagctggatttgaacccaacactcgtttctaaagtcttcctggtccatgactccaccacataaaggaagccaggtaggggctggtgagaagggctggccccaggggaatgtcaggaatccttaggggaggagtgtgctaagagtgacaggcattcactccccttcccctggagtgggccaggcagcccacaaagggcccagcctgataagccagttcctgctctttttctttttttgcagcttttcgccatgatctttgccatgtgcctcttccggggcatccagtagagggtatggcctgaagcctgaagactcgccccacccaccactgcccagcacccagtgtcctcccgtgcccctccccgctgtcctcttggccccaggggagaagatgaggccatcagagatggccaggagaagggccaggggaatagagctatttttttaacaaaacaaaatgaagacaaaaatatggactgatgtatcctcgcctggactcagggcaggtgccgtgggttctccagagaccccagcaactggcccaggatgcaggctgctctagagaccaaaggaacaccaggcccagcgccctctttggtccagccagaccctgggccctctctcctcactgcaccaggacctgatgccaagaaagtgaggatttaggcaacaaggaggcaaaagcaaatctcagagaagtcatcaaagcccaggggctgcacggagattcagctgccatgtctttgaggactcggaacccacagcgcaatccctggtccactggaggatggactgttccccccttcaggccggggccaagagtgagctgctaacacggcatccaagaatggcccagctggtaggatccttgctttccccatctgttggaccaaataatct

SEQ ID NO: 1009 - DNA, 1210 bp, Homo sapiens
cgttagtccctgatcccaaccttctccctcctgccagcacaccgatgcacacaccggaagtggcgagcccaagccctggggacaggtgtagggagaaaagcagccccaggcctcagactcgcttcccatcctggcatagagtgggggatggctggagggtgtctataggtacagcccgctctggctgctgccaggtgggcccctgccaggggtcctcacccctgtccaccctgtgcctggctgtccctgcacccagatacagcaacatggcctgtacccagcagagtggtggcaccaccatggttacagcggatgccccgagactctgcttggtaaacgtggcagagcagaatgggaggctggaccctgaggaagggcccctctcctggcatctgtctcttgctacctaagcctgtgcctctccctaaagagctgcctccctgctgccgagccctggtctggccacgagccaccactgcctcccgctgctgcccacaggtggtgccgccaatgggcagtgccctcaggccgaagcctcaatcccccatctgagccaggcctaatcctctaatagtgatggttggtttgtcctcccataactgcaggtggattccacctggggaatgaggctgcgtgtcgggcgtctgctggccctgagacatccagtcttccacactcaactgtgggatgggagggtggcgtggccttaccccatgaggctgtccaggctctggcacacagctgtgctcacaaaatactgggtggcttggttagagctaattgtagtggagcctgcaggtgagggtgagggagggggctgcaggtcaggtaagatctggaagacagacgtacagcttggagggcagggggactctaaggcaaggagatttacagttgggaaggaggcagtggcagaggggtgagggacaggggcccttaagtccagcgaggaaagctcggtgtgggcccgctctacgctccgtttggggtgacctggaacgcctcttctcccagctccctccagccatcagcagcctcttgtcaagcttctgcctcgccccagtctatccccaaccccaaatcaagaccacctttcttcacggtcactatttattctttgttcctttttctttttgtaagaaacattcacaaaaaccagtgcaaaaccatcagtgtgggcgtcctgttttatattacaaaacttcctctg

SEQ ID NO: 1010 - DNA, 1205 bp, Homo sapiens
cctgcacaggacacactgaataataattctctgggcaaaaagcacagttggcaggatcgggtgtctcgatcatcctcacccctgaagacaggtaagtcagggccctcttccttacctggacctccgcctgccctgactcagtccccactacagagagcaaaccctacagtctccaaagggctgagtagaggtgaactgcccacccacatccctgcacgagcccatccaggggctgagatcagtggtggcatgagtgagttgactggccccagagcctgcgaagggcctgttgcccagggaggctttgtcttggtttctgtgtcaccaagctgagagtggcaggtgcaggtagctgggagttgggagagagcccctgccttcatgacctgcctgctctccaggggagcagacaccaccgcatgaacacatctgcctgagcgatgagctgcccccccagagcggccccgcccccaccacagatcgaggcacctccaccgacagcccttgccgccgcagcacagccacccagatggcacctccgggtggtccccctgctgccccgcctgggggtcggggccactcgcatcgagaccgaatccactaccaggccgatgtgcgactagaggccactgaggagatctacctgaccccagtgcagaggcccccagacgctgcagagcccacctccgccttcctgccgcccactgagagccggatgtcagtcagctccgatccagaccctgccgcctacccctccacggcagggcggccgcacccctccatcagtgaagaggaagagggcttcgactgcctgtcgtccccagagcgggctgagcccccaggcggagggtggcgggggagcctgggggagccgccgccacctccacgggcctctctgagctcggacaccagcgccctgtcctatgactctgtcaagtacacgctggtggtagatgagcatgcacagctggagctggtgagcctgcggccgtgcttcggagactacagtgacgagagtgactctgccaccgtctatgacaactgtgcctccgtctcctcgccctatgagtcggccatcggagaggaatatgaggaggccccgcggccccagccccctgcctgcctctccgaggactccacgcctgatgaacccgacgtccatttctccaagaaattcctgaacgtcttcatgagtggccgctccc

SEQ ID NO: 1011 - DNA, 1152 bp, Homo sapiens
gttccatcggctcccatccgggctatcctgccaccttagcggctgctcctccccaggatgcgggcagggggcctctctcccactccccacacaccgatttctgagtagcgataggggctggaggcttattttatggggtagggggccgctggtaggcgaagattgtccgagggagagggggaggatgaagccagtgcgtggcggagacctgccagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccagagattgtgcctgccatcctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttatagccaaaaaaccttaaaaaaaaaagaagaagaagaagaagaagtggaaaagatcctcattgcctaatcgctgcagatcctagaggcactaggaacttgaatctcaccaggcgtagtttgcttttctctcgggtcattttattggcagaagggatgactaaggacaccttcatttgacttgggttgaggaggaagctctgggatagaatgcagttttgctcccccttctccatggaacagtattgtggtctttaagggaaagcctccaatacctaagggtcaattttattgaaagctttttctttgtggccatgtggtaaaaccgtagccaagagttgagtgagtgttacccagacaaatcaatagttcgtaggacacattgaaaagaaagtatccatctctct

SEQ ID NO: 1012 - DNA, 1190 bp, Homo sapiens
ttttggggatgtttcctttttgggctggtggatgattcttccttagtgactctcttatgtgtagtgtttttatttttttcagggacaatggtgacagatccaggcaccgagctccacgcaatgcccggatgtctgcaccttcgcttggacgctttgtcccaaggtaagaaccgagttgctagcaacagagggagccttcgttagagcctaggatttagttttaaacctactttctggtctttgaattgtccacatctggcattgtttcctagtgggcccatagcccagccctgctgtctaaactcttgacggatgatggttagccacattcaaaagagatgaaaaagtggtgctgggagaatcctgtttaagaacagaagtgttgggggaactttagaaggaagggcagaaaaagatagatacaaatctgcggaaggaccaatcttgggagattttatttctttctgggcatctgtggattcagtgggtcccttagcccagatttttcagtgtaggtagttagtatctgtttcgtggtagtctttagtcagcttttcacatgtgattccttcttgtaggcgtttcttgctgcctgagtacttgccttatgctgggatttttcatgaacgtggacagcctggcttggctactcactcttctgttaacagggtcctggcaggtaaggaaatgtttctttggcttttgaaaatgtgaagggccaaggagccagataaagcttctccctcctttacctatgttgatgtgatggtgtcttggcatctgtctgaaaattctattttggggtcctggtttgatattcagttccttacttgaaggcaggaaatggcagggttgaagaaaaatgtttctcttaccctattcccactttccctagacctttttttttcttttaaattatttgtttaaaccatttgtttcttaatccagcaattaaattctagctatgcttttaattgaatgataaaggtgccgtgtttatgttttggttggtgagatactcatgagccagatcctgtgatttaattaggagcttagtgcacacctctccactcctttggtactgccagcatgtggaatttccaggcagtgtggaatcttctgaggaaggaaaagagggagacgcccttggagctggctcagaaatctccacagaacagaaaatgggctag

SEQ ID NO: 1013 - DNA, 1146 bp, Homo sapiens
ctcttcctcctggcatcaggggccatgaagccccctggagagagatgttggagccacccatcaggcatgctctcccccacctctgtccagcccgcctcacggccctggcggcctcgctgttaccagaagacgtttttctctgccttacacttctcactgcctctctggacaccgggcttttgctgggctctccagagctgggcttggctcttccagctggagaaggactgagccccagtaacccctttcctgctttttcctgcctctgtttccctagcaagtgtggatgaatcaaatgactgccggctgggctggtagcaggggccagtcctcccctcttgattgctgggaatgagcagctgagctctttggtgtggacaccgccccaagctgaggtgcctccctatctggtaggctgccctgctttgcagaagccccactgcatgaaggcctgagtgcaagcacccttgctcctgtactgcccccagcagcgcagtctggggtatttcccctgctgaggagtgacagggctggagactgtgtctgctttctgcctcctcttccacacatcctgggtcagcctttcccaagtgatactgcccctggggtgtcctaaccccttggttgtgcagggactggtagcttggatgacatggctcagagtcccagcatccacttgaaacctccctctccacctccccgcccccgagagctacagcgtgtgatggaatcagtgaccggccaggttagcctctcccctcttggcctcctttcccacacgggcagatcatcagccttcatgttcttgtggacctgtctgttacggagtcacactggcccctgccccagccagaggtgactcagtgcctcaggatcttatggctccttcctccagctgggggactcttaaaggggctggggtagagactaagagtgcccgtaggaggggcagagattgtgctgataggtcagtccagataggtgggttctagcaatttccccaggggattaaggggctctagggccacctttttttttttttttctgagatggagtctcgctctgtcaccaggctggagtgcagtggcgcgatctcggcacacctccgccttctgggttcaagcaattctcctgcctcagcctcct

SEQ ID NO: 1014 - DNA, 1047 bp, Homo sapiens
ggaaagaagtttgaaacagatttcatttattttggggaaaaagatatctacagccctatgatatttggtctcttttgtgaaagagaccaaatgaacatatttataacattgtaatactgttattacactgaattagtatcagatattttgtccccttgcattagatttggttaagcaacatgaactactttactctcaggaacgaaggaaacccaagagagaatttctaccaggttaaatgatggcccctagctctggggagtgggaaggagtagagatggatgattagatgaatgactggacacacttcagctggtgtcatggtagaagtgattaaaaattttcatgttttagcagctgaacttgaaagatatgatgtgccacatttatagccctggccatcttttagaagtgagctcaaagcttagggaagatgaatggtgacaaattatcctcattcttcagtcactcctaactcttttattcttttttcaatagtgtctctggagaatggttcgactgttgcctgataccatcaatagcattaacctagacagaattcttctggatatccacattttcatgaaggtcttccccaaagagaaactgaagcaatgcaaaagtgaatttcccataaggaccctaaagaccctgctacacaccttatgcaaattaaaagggcccaaggtgagtaagaatcgcaactggtctctgagggagcttgagagaaaatcatggaaatggcagtgctatcagtcatgcatgtgtctccctcagatcctggaccacctaacgatgatcgacaacaaaaacgagtctgagctggaggcccatctctgccggatgatgaagcacagtatggaccagactgggagcaagtctgataaggaaacagaaaagggagcatctcgaatagtgagtggcctgacttgaaagattgagggacatgaggctacaccggaagtgatcttatctaaggtgtaggtcaccaggatatgctttccgaaggtccaaggtgaaggctcatggactggttgaatcagtctc

SEQ ID NO: 1015 - DNA, 1556 bp, Homo sapiens
cctggatggaagctaagagcttggatttctgggaacaaagggccatccccataagattgagcagaaattctggtcctcttccctgaaaaattttccccaccccagccagcatcttctgcttccccttgggttgtgaccagggagtggggagagaggctgaggctctgctcccctggagaccttctcttaggagttgggtgcttcatggaaaatccaagccttaggttcccttctgtctctggcaattagatgtgttcttggtgtcctccatgtcctttttgacttttccctgtgtccattgttagcatgtgcaaaagttccctgtcattacccaacccctgcccgcccacctcatttcagggctgtacacacagtgagtgttcctgttctctctctctttgtttggatgtattgctctgtgtaactcagtgggtctccctctttctggtttgtttttttttctagattcctgccgtttgttcatcgttgtgcctaaagcatgtcgatgtggcgtcaagtacatcgtccaaatccctgtctcttcagcttctctgatgcttgaactctcacctttgaccttgtgttgacctttgatgctgatgtgtatttttattatgtttgtttctttcttcgtttttttttctttttttctttcctttttttttccttttgtgctgccaaattggttttgctagaacgactgctgaaggggaaatatttaaacttgcatttgaatataaaaaaaatctatttttctagaacttcataagataaccacttgattttgtgattccaattctttgtaattgtcttcagagcagccctactagcacataccgcgtggtgtttgtatttctgtgaacacacagccagtccgtttctaggctttgtttctctgtgtgcttagttttaaagacaactttgaagtaaacaatgaaataaaagatgtcactaaaacctctgaggctcctgagcacattttgctgatacagtctgtggggcttgaggagaccgcatgtattgttctttcttttgtttttcttctgagttctcaactgcggagagcacctgaaccccctttcctttttgaccgcaggctgcactttgggccccagccagccctttttctttttctttttcttttgtggttcttccctggagcgactctggggagtcctggatatcccgcctgccccttcccctcagccccatgcttgttccaacagtctccacagcaaaatgtgatgctttgatttttttgttgttgtttttgtttttgtattgtttttgtgtttttgttttgaattttttcctttcctactaagattatgcccagaaaaaagttttgcatgtttcctgctgtttcttcacaccttcgtatatatcaccttcacctctctgttttctatagtttgtgcaaaaactgatcgatttaaaagggtttcaaagaagctgttttaaattgttgtagggttgattatttttttcaagattgtattgtttaattttgaagtggcaactttctcctctattgcccttagagcgtttgcctgtgc

SEQ ID NO: 1016 - DNA, 1194 bp, Homo sapiens
aagtaaataaggttggatagatgtgtagctggagtgattattagtcatgtggtccattgtgaccaataaagggtaactccaagaaatactatgaaatgtttagatttgatatttaaaatagttgtgtgaagtagaaattgagtatccagatggaaacaatctgcagagtgagatgtgtggacctaactaaggagaacttgggagagggtagctggaaatggcattcattcattcgcagacaataatcacagttgactgcgtagctcctcaagtttagcttattatcctgctgtagttctgtcctttgctgtgctgaattctgctgcccagggacttgagcttggctcagtattcagtgaacatactatcttctgggccagtgctttagctgtgttttttttttgtcctgtgctgtcataagcctcatgtttctgttgtgttggcttgggttcttgtctttgactttcttctctctgggggcctctgcactctcgctttgctgtgctgtagagttatcccagatgcagaaccagccctcactctcactcttgttctgttttttggtgtaatgtctagctttatttgcagctccttcagcagactgcctcctctgggaacctcaacaccctgagcagcctccacccaatgggaggtaagtgtttcactgctgcagaggagcagcagcacccaggccagcagacccagctaacaacagtcttgggagtttggcatcgtttctgtgaaaacatttttttgcttattatgtaaacctgacctaggataaacatcccaggactcaattttcttgtctctatacagtggctctatggctagttgatgccacattgctctgacgttatctggtgcctcctaaccttttaggtcactgttgaagaagaatatggaaaagggctgtttagctcctatagactgaggctgttctctgataaggggaaaaaattgcaagaactctttatttccattataaagtgacttttccagtgactgcagaaaagccaaagatggcttccatgcaaatgccctaccttgaagcttctagaacccaggcatttggtttacctgtgtatcttcttgtttcttaggtgaattcctattttgttgttgctattatcgtacacagaaaacttaaatggagtgccacaacaaacctgagctagggcccatcaggagtcg

SEQ ID NO: 1017 - DNA, 1310 bp, Homo sapiens
aaggaaacttcacctgtcattgtatacattgaagtgttctgaatcttatttgtaatcaatagtcctttgttattttgtgggcctttttttaagtgtttgttttgttaactatgcttaaaagttattaaaacttgatcttgttttgggagttttaccctttaagttcctcctctagcatggtaattctcatgctagataagaaatgtacactgtcagttccctggtaacagctgggatgtcccaatcagaatggtgactttagtttggcatctgatggaatgggtggccatggtgagggagaaccagggaactctggtaaactgaatggaagtagtgaaagaagtagattttttttcccttacgttctcagaactagttaagatcattaaagaaaagaaaatttcctctggaaagcaacattattacataatagaagtttcattttatctcacacagctcaaagaaaatgaacggcaccctggaccacccagaccaaccagatcttgatgctatcaagatgtttgtgggccaggttccaaggacctggtctgaaaaggacttgcgggaactcttcgaacagtatggtgctgtgtatgaaatcaacgtcctaagggataggagccaaaacccgcctcagagcaaaggttagggctttgggttttggtttatcttattttttccactgactctcagagcaggtgagggctttgggtttttaacaggatacaaaaaattggatttttatatgtaatttctttcatgtgcattctctctgtcattgccagaatactcctgtctgtctgtctattggaaaaaatctgtccttttatagtagtaatatcttgtaatccaaacatatttaatggctttaaaaagttaaggtgttagcatgaggataatttgtaaattgggtcttgggcagtcctttgtgagggttctaaatttaagagacagactcacgtgagtgtcttatttgaccttgggaacagataacaaagataaaattgaagttaaaccacataaagttttctttagtgtttgggctagcataagctgaaggagaaagactgtccacatacccattggtttcttgttagtattacagaggccttgcgggatagtttatcaaatagaaaggatttgtttaggcagcttgtttgctgttgccacaaagtgaacaggagaggaaaggcggagctgcttccagaattgcctagcagagtggaagtttcacaagactgatggtagataggtattaactttgccccgtatatacacacagacatgttcttattttccattttaccagt

SEQ ID NO: 1018 - DNA, 1228 bp, Homo sapiens
ccttgagtcgtcttggaaacggtcgccagggaaaccgttcttcccgctcaggcccgcccgccctcgtcaaaagcttggctcagagagcgggggaggggtgtgtagcgtagaacccaaaacgcccgccccctcccctcctctcacccgcctggttcttcagcgtcctcgccttctctctaggctctgccacaaggagctaggaccacgctcacctcacgatttccctacctgcctgtctcgctttctcacctgcgttccctcctttcatcccggagcccggaacctccgcttccggctccacgtccgcccggaagaagatctgctgcacacttccgtttccggtccgtgcccttggggctccgtgtcctgctgtctttccgtccgctgcctagtctgcatctgagtaacatggcggcggcggcggtagccaggctgtggtggcgcgggatcttgggggcctcggcgctgaccaggggtgagcacgggcagccagctgagaccggggtcaggcgcagcggcgtgcccagtgcagagagctcctcagggctcatcccgcgcgtctgtgccttttatctccctgtgcagggactgggcgaccctccgttctgttgctgccggtgaggcgggagagcgccggggccgacacgcgccgtgagtatgtgcgggcagcgctcttctctgaactatcggcggggccccttagatgcctgtccttgccctaggatgcccttccctacgtcctcctggcaaatcttggagatctgacttgcagtggtcttcaccctgcatgcagaatcgagccctccctgtgcccttaggcctgttatggccctgattgttccttgtccatttcaatcatcccctttttgtctgattaaactgtcagctctttgaaagcaagcaatataacctttaggcctcagagccctgtaataatagtacctagcgttaattgagtgcttaatgtgtgcctggaacctcgctaagcgttttagtgaatgatcttatttcgtcctcacaacagccttatggggtagatagcatcttactcttcttactatagatcaggaaacagtccaaagaattaaactgcccagggtcaaagacctagtgaatgacaaagtaggcctgcctgctgccagaggcagaaacacctaaccattattctgtagcttgtgatgtgtgattgctcagtggtttagggttgcatgaatgagtatgtacatat

SEQ ID NO: 1019 - DNA, 1112 bp, Homo sapiens
ttcacttggcagctaataactagttatatcagatgcagcatttctggttctgagaaaagagttagtgatccttttattagaaatactggtacgatttccatacttagaaaattcattcagaaaatgagactgaaatgttgtatataacagagaggcctagttttatcagtagagtcacagaggagactcctataacaaatggtgattttatgaagcagagtggctaacatctttataaggtggaatctacttggtgaagtcaaagttattaataacttcaatatttttccattgttgagctgttatgtaatgttttccttcttttctcttatagctgtcccagaaaatacttgacaaattggaggactaccagcaaaaagttgataaggcaacacgggatttattatatcgtcggaccttgtgatttggattgtcacctagcctttgtaaccgcttggtgcctcttaggacttaagactaccctacaggaaccctgtactcaaggccgatttttgtaactgtaaatgatgtgtacaacattcaagtctgcattctgcacaagataggagggcggaagagtcagaggaccctgtgcttgctggtggtgctaacacaatttctggtgttcaaccttggtctcaaatagctgcttttgtatatgattcacgagcttttttagagtttatatttttttaaactaccgaagacattcattatctgcaaattaagactcaccttcactttccaaaatagctgagggttgttggcttgttgtagctgaccaccaaaagcagtcactgcaaatcttttaattcttccctatcaccttttgtattttaatgcaattattttggtccagaactgacctgtattttctgtattgtacacaaaagctaataattttgtgtactttttatttattttggaggttttatatgatcttcaattgagtattaaataatttgcctagattaagcctaaaatgatgaccagctaattaaagaagatattttgaatctggttctgagctaaagttgagtaaattcttagctaagaaaaaattggaaatccatcatctatattagcaacagattctcagagtaaattgttaa

SEQ ID NO: 1020 - DNA, 1218 bp, Homo sapiens
ataaaatgcctccggctgattgaagagtcagtaactgtggatatgtcagttataatggaaatgagttgttataacctacagtctccggaaaaggctgcagagcagattctggaagatatgatcactattgatgtgtaaggagaattagggtaaagtgcatttcctaatggaaattcagcatttttagcgccaaagttggaattttaatgtatgttccagagcgtacagaatagtagcttaaagtcaaactgatgcgccatgattctaagtacatatttctacttttaacagaaaatttaacacgacttcaagtctagaaatagacttataaaatatgctttaacaattaaccgagctaaaaattctaaaaagcaaaagtgttcttctcatgtttgttttgtgtgttgtttatgaaaaactgagaggaaatttgctatgcatagggactgtatcttatatgccagagtgattatcttcattcctttatctggttctcttgtttcataatgtatttagcttataggacatatagaacttgccttacgtattctcggtagtaataagagttttgtaattgtccttatagagaaaatgtgatggaggatatttgtagtaaactgcaagagattaggaacccaatccatgcaattggactacttatacgggaaatggattatgaaacagaagtggaaatggaaaagggattcaatccaggtaaatgacagaacaacaaatgtgcctctttgattaaaacaatgatgcattcaactccatttttcttctttttacagctcagcctttgaatattcgaatgaatcttacccagctctatggtagtaacacagcagggtatattgtgtgcagaggggtgcataaaatcgccagtactcgtttcctgatctgcagagatcttttgatcttacagcagctgttaatgaggcttggagatgctgtaagtactgcttgagggaaaacttgtaaaatctaaaacctgttataggcctacaagcacttaggagcaaaatgtcagccctactagcacagatacttttgtcttggttcactgctttattctcccaagcttggccttatgagatgctctataaatatttttgaattaagaatgaataagcattgtaatccttgtgagagtatagattaagagcatatatggaggggacggtggggagggagaacatcagaaagaatagctaatgg

SEQ ID NO: 1021 - DNA, 1199 bp, Homo sapiens
atcatgccactgcactccagcttgggcgacagagaccctgtcttagaaagaaaaagaaaagaaaagaaagtgctaatccccctatggggatctcctcttctcctcccctctctggaacctcacttgtcagttcttcctcccacttccctgtatctttaaactatcccccgcttttagccccttcccactatcatttaaattactcaaacttcttctattttaaaaacctctccctaaactcagtgtgtcccctgctttaggtcccagcacacccactgagccatctgctccccctggtgccttctccacacagcagcctgagccatgtctctaatccattaatctcatcacgttactccaaagtttacatcacttctccttgtcttggggattaaatccaaacttcttaacagcccctgttctgccctgccttgcaaggcagcctcactgcttgcccctctccattttacctgctgtggagtccaactgagcctcatgtgccccatgaatcaggcattagattctcataatgagctgaatcctgctcttatgaaatccacactctttctcctctgggagtctctgaagtgagtgataccctctgcttagaatacacttccccttaaacctctactctcttcctggatagctttgggtcctctgtcacttgtctgctttggcatcaccccctcctggaagccttccttgactctccagattctcaggagcatgagaggtgaggtgctcctcccatgaatggatggagattagggagtatgggttattcatgtttaattcaacagttcttagctcagtacctggcacaaaacagttactgtggtggccaaagtaatgaccccaccccccaccccccaccaattgctcatgtcctatgttacacagcacaattacataggaagggggaattaagagtacagaaggaattaatgttgctaatcagctgatcttaaaacaagattatcctggagtatctggaagagcccatgtaatatcaagctttctttaaatgtggaagagggaggcagaaggttaagaaccagagacggcgggtacaatggctcatgcctgtaataccaacacttttggaggccaaggcaggaaattcctctgagtgcaggagttcaaggccagccctgacaatatagtgaggccccatgtctaccaaaaaaaaaaaaaag

SEQ ID NO: 1022 - DNA, 1121 bp, Homo sapiens
acttgattcatttgtccatccagcaagcagtgactgagcgcctgttaggagctggatgttggagatagctgtgaaggtagagtagagagtgcagggacgagtgtggtcagggaaggtgtcactgtgaagggcagaggctgagctgtgtgcatgtctggagagcagcattcttggtagagggcacagcaagtacaaaggcattggtgctttcctggcaaggaggccaggatgtctgcctggcagtgagagaggagttaggtggtagtgaggaccaacgggttggggggttggattgtgtcaagtctcgaaggcctctagaaagactttggcttcagtgagagcaacaggccatttgaagggtttgcaggagaggcatgggatgctgctgtcttagttgtgaagagtcacctggcccactggattaagaatcagttgcagggaggtaagatcagcagcatggaccagtcagggggctgttggaatagtccaagtgagagatgatgacggcttggaccctggaggtagcctacggtggagatggggagaagtggttggttctggatagaatttgaaggcatggtggaaaggactttcagatagatagagagcacagaatcaagggtgaccccacggcttttggcctgagcaaccggaaggatgagtttatggttgccgagacggggacttctaagggtgaagcaggatcgggggagatgggaggagtttgctttgtggatttgttgaatttgagatggttttcagacatccatgtggaaacgtcaagcggatggttgggtagtcgagtctggccttcaagggaagtgagcaaatttgaaaggaacacttgggaattgtcagagtaggaatgcttgtgaagactggctgagattactgagagtggggatggtgcaggaggggagggcccagaggcacagccaaggagactgggaggacagtgagagagtccaccaagtggagacagcctccaggactgggggagggcgccatcagctgtcagatgccactgacaggtcaagtaagatgagcacagagaattggattcagctccagggaggtcatccgtgaccttgacgagagtagttaggtggcaaggtaaagga

SEQ ID NO: 1023 - DNA, 1505 bp, Homo sapiens
ggtgacaggggacctgaaggcccagctcctcttccctcttgccaatacagggacaagtcaaagaagaagaagaaagtaaaggtaaagatggaaaagaaatccacgccctctaggggctcatcatccaagtcgtcctcaaggcagctaagcgagagcttcaagagcaaagagtttgtgtctagtgatgagagctcttcgggagagaacaagagcaaaaagaagaggaggaggagcgaggtgcggcaggaatgtggggcctgtgggctgggcagggtgaggggcatgtgtgtctgtgtggggttggtctgtaagagtaatgagttggagtggatggtggaattctgaggttctgaaggggggtgctgtagttgggggcggtagggaattgcgggcccttcactgaagagtgggtggggcacccaggactccagcttttcccttaagacacctttggttttcaggactctgaagaagaagaactagccagtactccccccagctcagaggactcagcgtcaggatccgatgagtagaaacggaggaaggttctctttgcgcttgccttctcacaccccccgactccccacccatattttggtaccagtttctcctcatgaaatgcagtccctggattctgtgccatctgaacatgctctcctgttggtgtgtatgtcactagggcagtggggagacgtcttaactctgctgcttcccaaggatggctgtttataatttggggagagatagggtgggaggcagggcaatgcaggatccaaatcctcatcttactttcccgaccttaaggatgtagctgctgcttgtcctgttcaagttgctggagcaggggtcatgtgaggccaggcctgtagctcctacctggggcctatttctactttcattttgtatttctggtctgtgaaaatgatttaataaagggaactgactttggaaaccatgtcctcatgctttctttgtagccttggtgtgttgctcccacttttattggtggtgtttactgctctggtcagactgggcagggccttcctggccagccgggaagcaagtctcgaggtacatcctgttctgttcccggctggacgagcattggttttcacccgcctctgcccggatgggccacctgagagtctagaaatgagagctgatctgattaggaagtttctcccagttacactccattagccaaccaagctagggggaggcagctcttggctgcatccttacctatgagtcaagggtcttccaaggctttcgataatgaaatcaggattgactgtccttcccgcagccgggggagtggaaacctgagcctggagagtcggggaggatgagcgtgtgcgtagagtggtggtggttgcagcctggtggtggtgcaacaaagtacggagttatatgtgaagcttttgttcttacgggaagaagggggtatacaaacttcagtgtagggaggaacccatgtctgagaaggggcctaaaaggagataaag

SEQ ID NO: 1024 - DNA, 1168 bp, Homo sapiens
agagacactggagttcaacgacgtctatcaggaggtgaaaggttccatggtgagaatggcttggacaggtgatacaagtagagagaaggaaggagggtagagtttttgtccattaatgagagcttgctttggtaacgttattttggaaaaagaagactcagtataatgtgtacctagtgtctccaccaactcaaggcaatactgagagatagtctcagagttatagggaccgtatatgctgttcagttcccaattcctgttttacaaatgaggaaactgagaatctgttaagggttctagataccagagtctggtttagaatctagactccttggcaccctcagctgttgctcctgcattgataatctggccagtccacttgcagcaggaatgtgtgttaggtagagctgtagaacccaggacatgctgtgtactgtctccatgcatctgggcctgcttttcttacagaatgatggtcgactgaggttgagccgtcagggcatcatcttcaagaatagcaagacaggcaaagtggacaacatccaggctggggagttaacagaaggtatctggcgccgtgttgctctgggccatggacttaaactgcttacaaagaatggccatgtctacaagtatgatggcttccgagaatcggtgagatgtcccatggctataagcctcctttttactgcatcttcttattttaatcttctagagactcgaggttccttcctcatgtaaccctgtgattgctagtttgggctccttagagcagggctgtgaggccatcaggcaatcagtgtttggctttgagcgttgaagtcttgtgaatttctgtgtgccttgactccagaagattttcttctgtcttgatttagatagtagtttctgcctgtggcttttatcaaggttcagaatcttagcttgatttctttgtgtgtatgtgtgtttttggttttttttggggacagggccttgctctgtcacccaggctggagtgcagtggcgcaatctcggattactgcagcctccgcctcctgggctcaagtaatccttccatctcagcctcctgagtatctggtaccacaggcacatgccaccatgcccagctgatttttaataatttttggtagaaacggcgttttgccacattacccagtctggtctt

SEQ ID NO: 1025 - DNA, 1167 bp, Homo sapiens
ataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgtggccaactgtttcactggagcaagaaagagatctcataggacggagggggaaatggtttccctccaagcttgggtcagtgtgttaactgcttatcagctattcagacatctccatggtttctccatgaaactctgtggtttcatcattccttcttagttgacctgcacagcttggttagacctagatttaaccctaaggtaagatgctggggtatagaacgctaagaattttcccccaaggactcttgcttccttaagcccttctggcttcgtttatggtcttcattaaaagtataagcctaactttgtcgctagtcctaaggagaaacctttaaccacaaagtttttatcattgaagacaatattgaacaaccccctattttgtggggattgagaaggggtgaatagaggcttgagactttcctttgtgtggtaggacttggaggagaaatcccctggactttcactaaccctctgacatactccccacacccagttgatggctttccgtaataaaaagattgggatttccttttgattgcgcgtttgtgtgtttctgtattagaaaagcctgacaactgcagaggaattgcccatcttaagggcaaaggccatcctatttggtttcaccaaatgccgggcattgatccccaggactggcaagagttggagaagtctagtttccataaatctagaatagcggccacatgttgttaggtggtgggtttactctgggattggcctgcggttgccagggaggagagtttggcggcagatggtggcacacaacatttagcgccatgcaaaggtacagaaaagattgcgcgaagcgaggctagcagtcggacctagtctccgccccttcctgctgtgttcaccatcccagcgtcccctgtcccctccacccgaagcgatgggtggttccgtcaggcgcttcccgcaccttcccgctccctgcttgcaaagtgg

SEQ ID NO: 1026 - DNA, 1167 bp, Homo sapiens; identical to SEQ ID NO: 1025

SEQ ID NO: 1027 - DNA, 1188 bp, Homo sapiens
gcaggtaagactacctaggcctcttcataggcctaactaagatcacagttggaaaaaaaaaagtatagaaaaagaaaagaaagttgttttttttttctaaaatttaactttttgtattcattgaagaaggaagtaaaacatctccattcaaaagaaatttgagagtctgtttatgccatacactgaagtacaacaataaacaaaatagacctactgtttgttctcaaagagcttacattctagttgtgagagacaaataataagcgagtaaatatgtagtatgtcagagtgtggtaatattattgagaaaaaagtaaagtagaatgagtagtatggaggaaagaacgtctcagggtgggggtgaggttattttatatagagtggtcagggagggtctcatgtgtaaggtatgtttgagagagaccaagagaaatggaggatggagtcatgtagatatgaggagtaggaagtgcaaaggccctgaggctggttattgccaatgaacaaaagagattgaggggagggaaggagaagtaagagacctgtccagagaggaccaatgggaatgtattttgggggaaggggaataatgtagggtcttgttgtatactatattgtacaaagaaaaattatctccacttcaaaccccagagacaacggctgttaccgaatttttgtgtctttcttgtaacttgaggtagcacctgacccaacctccatatttctcccattgtggaatctccatgaaagtatagttagcagataatttgcatagtagcagattttgcataggttgattacctttgtcttagagaatgataataaggcagctacttagaataagctgatatgtttttgggaagtgggatcaaaatttttctttttcttttttttttttcttttttgatacaaggtctgtctcggcagtgttaacaatctcagctcagtgcagcctccgcctcccacgctcaagccatcctcccacctcagcctcctgagtagctgggactataggcatgcactactacacccagctaatttttgtattttttttttttttttgtagagacagggtttttccctgttgcccaggctggtctcaaacttctgagctcaagtgatctgcctgcctcgccctcccaaagtgctgggattacaggtgtgagctactgtgcccagcccccaaat

SEQ ID NO: 1028 - DNA, 1207 bp, Homo sapiens
gatttgagatgaggaatttttaaccttgagtgctgtcaatgagctaaatggagcccctgagcgctcatggtagaaccaaaggcaaagctatgggagaggaggcaagaaggaaggaaagagaggagttgagtataatgagttgatatttgttctactcttaccatggattcattattcttaagacatggaatttggcctctaagtttgctgtagagagtgtgagagagtttagggaacctgatggtatagaagcataaatccatcaactgagagtactaaggctggactccagccagctagagcctggtttattggtactgattagcaccctctgcttctatttctcttttgtgcaggctatgagctcttatttcagccagaggtggttcggatatacatctcacttcttaaggagagcaagactcctgccatcctagaagcctcagctggagctatccagaacttgtgtgctgggcgctggacggtaccttttagaaaagggatttggagatgggaaaacttagataactagtttgctgccatttgtaatttgttccacccctttctatttgctattctagtatggtcgatacatccgctctgctctgcgtcaagagaaggctctttctgccatagctgacctcctgactaatgaacatgaacgggtggtgaaagctgcatctggagcactgagaaacctggctgtggatgctcgcaacaaagaattaattggtgaggagttgaatgctaactgttacctcaaaatttagtacagtgtttgtagtccagcaggtgcctaataatttattgaatttattgaaatgactgaagggaaggaccctcccccgcttcatagtttatgaatgcgagagttggtaagggttttagtttaatggttcttggaaagaaaacaagtgacaactcttcaaaaataaaataataattgctattatttattgagcacttactttgttactaagcgttgttaaacacttctgtgtttccatttaatcctcaccactttacaaaggtccatttttttaaataggataaggaaataactcatggaagttaagtaaattgcccagagttaatgtagctagttagtagcagaacccagttatttatttatattttaaattcataataactcttctattaaattattataatattcaagatattttcattagagtatctgaaagga

SEQ ID NO: 1029 - DNA, 1207 bp, Homo sapiens; identical to SEQ ID NO: 1028

SEQ ID NO: 1030 - DNA, 1082 bp, Homo sapiens
atctcaaagtaaggctggtaagagaagtgagtggtgtgactcttactccttaggtgcccagaatttaccatcatctctgaaggagttacagggaagtggtctccccaattctcccctccctccagtattgccccctctcactttagcatatattaattagcaggttgggctagagaaatcagctgctatgcgggttgattattattattatttctaatccttttccttatttgccttctactccccttaatctaatctaaaagctctgttccatgcaactggagttccttatccctctcttccccttcccttatatattgaggctatggggtaggagaaaagtgcacaacccaccaccccctttactcgtgcattaaaatttcttatttacccttttcccccttcccatttcttcccactttcatctaccttttctggcaaaaaggagccttttgctctctgtgaccctaagagcacactgcacagggaaaattgccccatccagacctggctccactcttgatctctcttgtcctcttctgctcttttcctggtgctcttttttctcggtggggtgtgggtaatagaacagccgtgggcttttggggacctttaacttttttttctctcttttgtttataaaaaacactaaacattcaattccagagaaccaaaaatcccaccttcccaccgaacactactaaggggcttgtgttctgctccataccttttctcttttctttctgtcttgttaatgcttttaaaaacaaatgagttttttatataaataaagtttttaaagtgtgtatgtggggggtctgtgtcatttcttcacttcaagctgttatttcttccctgctttgcatctttgttacttccttatgtatcagtgtcctttccagagcaaccagaaggaggttataccaggatttattttgagctcagccccaactctttatcaagcaacattcttgttaactatatgtgaaacattttttcttctgaagattcttaaaaattgaatgtggctgaagttgaacatgggagcttattgctaatttagagataggaaactgaagcat

SEQ ID NO: 1031 - DNA, 1082 bp, Homo sapiens; identical to SEQ ID NO: 1030

SEQ ID NO: 1032 - DNA, 1340 bp, Homo sapiens
agcacacacatacatacaccctccacctccccatcccctgttctccctctgttgctccccttataaaattgatgttgtctttaccagaaaggtagacaaaaaagaagcagcagcagctcttaaagtgagggttattctcatactcggttccagccatcagcagacttcctgctcatcggcagatccccctttccaacctgtaactctgatgtgctctggatcagcttttaacttttaatcatatattactgtcttctaaatcccttctcctcctctactgctgccctatggttctggctcctaccccctgcggcacacttatcttcaaataccatagaattctaatctctggaggctggcagcttgacttggcactttagggccccttagcagggtgagctgttaaaacagcacacatctctcatcccctcttcctttattcccccctgggtttcagaaaggaaggatatatggggaccacctcccccttctttgatcccagcatctcagtccccctcccaaccctccatatggctctcaatggtgctcacttgcttggaagcaggctcccaatagggagggggctgccctctacagtctctttgactgtaagacagggctctgtatcagtgagacgatgagaaaagtcccaggctaatggcagaaatttgcactttgaacatgtgtgtttttgtgttgtggaacctgagattccttatttattaacaggaagtctgattttttttttttggagtctttgttgctatattttgtggggctgggagagagagattagattattttgacatgggatcccttccataacaggtactttgaaggcaagacatagggttgaagaagcacagccagcctctgaaatcatagctctccagtggcttttaaagaaagctggtcctcagcactaacaaaatcactacaatagcctagtgcttttttggaagcctttttagggaagaatgttaggttcatggtaactagtatgctctttgagatttttacagtgttgaaacttaagaattttgagagggtgaggagggttgttcagaatctaaattacagatagatgattgtttcttgtgaatttgtttcttttcctttttttttgtccctaccatttccttacatttcccttggggcccatctctggctccttgctttttgtttcttgctttgctttatcagttcattccagctccctgttagtgaaggacactgctgttagtgaaggaacaaagtctatgagtcctaaaattttaagtcaaagaaaactgctctgtttcccctttagtaacacttctgaagaggaaaaacttcaatag

SEQ ID NO: 1033 - DNA, 1194 bp, Homo sapiens
tccccaaaagtctgattggcctttatctgaaccaatcaaaggtgggtctggcggacgcgtcccaccccaggctctcactgggcgctgtagaatgacaggcccgagagaaatgccaatatccgcggggtcttcctcaagtgacactcagcggcaccaatcgacgtccttcttcccggcggccgagccctcctccccgcggctggccgggcggggcggggacgctgcgcggcggtggctgatgcggtagccgtgtggggcgctccgggcggcgacggcggctctcgtaggcggttccggtcttgtatctccaggcggcggcggctcatggcggcgacggagctgagaggagtggtggggccaggcccggcagccattgcagcacttggcggcggcggcgccggtcccccagtggtgggaggaggcggcggccgcggagatgcggggccaggctccggggccgcgtcagggacggtggtcgcggcggcggcgggaggcccgggcccgggggccgggggagtggcggcggctggcccggcccctgcgccgccgactgggggctcgggcggctcgggcgctgggggttcgggctcggctcgagagggctggctcttcaaatggaccaattatatcaaaggctaccagcggcgatggttcgtgctgagcaacgggctcctgagctactacaggtaactgcttccggggcgctgtcgctcaccttgcctcccccatatctgccaacagtcccagctccggcattaccgccagccggcaccgcagccagggttgccccaggccccttttcgtcatctgtgcggattgacagcccaggggtcggagcccactgtcacgaaagtgaaaagcccctggacgtacacctcccctcccctcgggttacccactcttggtgccttatcttcccttcgctcccggcctttccagtcattagtcgtttggagagcgtctgtgcttccattgtatttccaccagcacatgggtgcaattattaattctgcaagcaaggcactggtgtaggtactaagggaacacatgcagcagaacaaacccgaggcactcctcccaaggaacttacagtggaagtcccaagttgtagctgtcagtgcccagtctccaaaactcaaggttattcgtagctctggatgtacccgtccttgctcccttcacattcagacataa

SEQ ID NO: 1034 - DNA, 1229 bp, Homo sapiens
gtgagaagggggggctggcattgctttattcattcatcccaccagtgaaaaatgccaggcactgagggaggcactgggggtagtgtgcaggtcagcctagggaaaacaaacaggagcctgcggtgtgataaatactaattagagaaggcctggttgtttgggaatctgttattagggatcagtgttcagactaaaggaggaaaagccttctcacagttgcctcttatctttctcctcagagcatagcggcctgaccacaggggtggccttcgggcatcacgccaagttcatcgcttcaacaggcatggacagaagcctcaagttctacagcctgtaggccctggcccttctgatggaagctgggcctcatctcagtagaggggtagaattagggtttgggggggggggtggggggaatctatggggggagggggctctgtggggtgggacattcacatcatttcactctggtctgagtggtggcctgagaaccatggtggcatggaccaccctcatccatgcaactccaggccccatgggaacggatgtggaaggaagaactgtcaccctcttaaggcccagggtcggagcccagggcctctcccttcctgtcgttcaatggacgtggtggtggctgttccacacccattttgttgcagttcctgtgagacaggagaggctgagccaagggaactgtgaaggggatgggcaggagggcttgtgcagggttttgtaagcagtgatctagtttcattaaaaaaagaaaacaataaccataaccacctccccgtgtctgtctgcaccaggagcacctgggactgggaaggtcaaggggagggagcacacactgggacactggcttccgggaagcccatcttcctttcctttcacagctcttaccctttttttttttttttaattgcacagcagaaataaaaacaaatctgcagatgaaatttgccatgtccctgcggttcttgaccttgtgtctaaaggcctcaagtcactagtcctgccacttgccttgtagacttggtttcctacacaagcctggaagggagggagacctgcagggaagattagctggatcttgctggtggggaggtctgagcatctccatcagggttctttagttgtaggctttctagcctgtcctcagctggcataagtcaaaaaggagatttttttattgactctggcgattgaaaagctgtggtaggactggtttc

SEQ ID NO: 1035 - DNA, 1214 bp, Homo sapiens
tttgttgtgattttgtcttttgacaaagaagaaagggcaatgtgaattgccccaaatcacagagcgaaatggtagtagtcaggaccaaaacactttcttagccgttttcttagttcttgtacccatctgtttctgtattttcttcaccaggccatccagcagtgtctcttaaagggtagcccgagaaacaactgacttagaaaagcgtggggcacagtctgtctacgcagacccgaggaatctgcattttaacaaactcactgggaaattctcgcgcacgccaaggtttcaaagaccagggtcccgtggcacagtgccgcacagttgtcaaaacaagtgctgtccaattgttttggttttaaattctcactgcgtcatgggaaatgtagtttcgagcctcctctctcccgacgccccagccaatcctccggcgctttacggaacgagccgagtcaatccggaaataaccgagtgttcgtggcgggccctttcctgcccggctgcattctgggaaagggcaatttccgttaggtgctgaaggctgtggcgcgcggctgtccccattcccacgtgaagcgctacgctagcatcgctcggctggcggctcccagctcgccgcggagcagtcccggcagcagcgggggaccggaagtggctcgcggaggctcagaagctagtcccggagcccggcgtgtggcgcctcggagcacggtgacggcgccatgtccctaatctgctccagtgagtgttggctgcggccaagcgcgggtctcaggaggccagagagcggcgcgggagcgtgtgcggtccgctgcggcgcccgggccggggtggaggcgggaatggggcgctccggaggccgagcggcggcctgtcagcaccggagccccccccgtcggagcggggtgcatttgcgcagtgccccgcagtttacatagtgcctgaggtttattgtcgcagacattactgaggccggtcgcctcattctacagagtggaaacaggtctggacagagagagctggtgcaagggaagcagccttaatgtaggagtcagaaaactcgaggtcttgtccagggtccgcctcccattggctttatgaattggctcaaggctctgggcctcggtttccccatctgcaaaatcgagagcattgcagtggatgttttgcgaggcctcgctcggatagtcggagcttttgcaatttgcaaaggt

SEQ ID NO: 1036 - DNA, 1339 bp, Homo sapiens
tcaaagcgatgtcctctttgggtcggtcaatttctttccttcctgattgcctgctaggccaaatggctgatttttttttttttcctgcttctatgaggatgcgcatatgacagtccattttggtggcacatggagagggctgcagttaaggggaattctggagggaaacctgaggtttctggagcactaaatataacaagcagtgacatagttgaaccagtgatgtcgaagccagcaaagcccccatgtgtggagcttggtgtatttctggttcagacagaaatagacacctaccagagggcatgatggcatcagtgcttgcgggcagccttgggccaaacttagtctccatccctgctgcctggccctctcctcctgccttttcctctctgctccttggggagctccatctagcacccgaggattgtggttttgcttctggctgcaagtactttcacatatcctgttgctcatgagagggtggagggagcagctccttgatctccctggggagggggtgggctgagccgcaggaatgtgctctcagagatttctgcctctcctcgagcctcccggtggagtggtattatcgcaggaaaactccagtttgtttttgataaatcatatgtacaggctcgggggtcccttcgtcttgggctgcctgttcgttactttggtgtcactgtgttcacagggaaggatggagacgctgaaggataagaccctgcaggagctggaggagttgcagaatgactcggaggcgattgaccagctggccctggagtcccctgaggtagagggaggctggtatgggacccaacagaggccagcagatgaggcttgttaagaggcgctttttaaggatgctggcttattggaagttttggccaaattcatctcccttttctgtgaacttcatcctggtttggactcagaggaatccctgaggcttcagaccagttcctgggagttcttgggagtgctggggagtccactgcctcctggtgccttcccaggacccagataccccaggagtccccacactgtcgttccagcccaaatctggaggcagctcctcaaagcactggtatggttttgtacccacttttccccaagagccttgtgcgatcccatatctccaggtgactctaaggcttctaggagccattcttgggctgagatctagctcgtctcccatttgatcctgtttctcctcataactggcccctaatcctctagttcttaatcacagactccttgaggaaagaaacagaatcctgcctgtgcagagatttacacttaataaaggacattccctgcccctagcatctcctgtgac

SEQ ID NO: 1037 - DNA, 1159 bp, Homo sapiens
aggcattcatgcaaaaatgacatctattgtaatcattagcaggactttggggaataagaaatagaagcctcatgtagcttattcgtagggctctattagggctgcatttaccacctttccactcctgtgtggaccctggcagatgcttggagacatttgttcatctgctgtttatctagatcacttcagcatcggtgaggttggtctctcaagaacccaaagctctggtcagtgaatggaaggagcctcaggccaagaacatcagtgtggcctcctgcaatagcagccaggtggtggtggctgtaggcagggccctctactatctgcagatccatcctcaggagctccggcagatcaggtgtgtgtgtttttctgtctgctcgctttcctcctcttttctctaggacttctttgagccttggattccttcctctgccatattcttctttgttcagccacacagagatggaacatgaagtggcttgcttggacatcaccccattaggagacagcaatggactgtcccctctttgtgccattggcctctggacggacatctcggctcgtatcttgaagttgccctcttttgaactactgcacaaggagatgctgggtggaggtatgtgtcatttagggacctgggttgggacagagtcaaaatgtggaacaagaacataatgtccccctttctcacagagatcattcctcgctccatcctgatgaccacctttgagagtagccattacctcctttgtgccttgggagatggagcgcttttctactttgggctcaacattgagacaggtgagagtagtattttgagtgagggactctttcaaaaatagagtattagaattacacagaattcttagtcccagggttctgcttttgaactttcacaggccagctttttgtcctgttttctttcttcctttctcctgatgtcattctctctgtaggtctgttgagcgaccgtaagaaggtgactttgggcacccagcccaccgtattgaggacttttcgttctctttctaccaccaacgtctttgcttgttctgaccgccccactgtcatctatagcagcaaccacaaattggtcttctcaaatgtcaacctcaaggaagtgaactacatgtgtcccctcaattcagatggctat

SEQ ID NO: 1038 - DNA, 1131 bp, Homo sapiens
agattttgtttgatcttacttagtatgagttaaaataaaaacttagaatttctctatgttctttagttttgtaatattaggtcattaaaactttgatgttgttgattattcaaggctggttgttctaagcttcagggctgccagctgtgatcagatcttcatttctgcatgtgtgtctcagaggcccaaatccacacttgaactttttgcaaagttgtgtcataaccctactcattgatgggaaaatgttttcatcagccaaaaattactatcttctgttttatgccagaaattcaatttgacaaatatttaggtacttagtgctatgtgaaaggtattcatgcttcaggagctgtaacagtgactaagatgtgatccctgccctgaaacacattgctgaattccttccataacttctttgttgaagctgtcttccactggctgagtgtagctttcttctggtccctgctttttagcatcttaaaggtgaccttggcagtcccaggactgacatgagtcataattcagaaaaaggaggggaagatgatgttgacaatggcaggactgaaagttttgacaactttagcggagcaatcaattgtgttctctctaccattattccatcagaatgcttttaagaattgtatcaatttaaaaaaaatctcataggtgtagcttatcagtgcgtgtttcacttagctgttttgtaagtttctcgaggctaaggaacacacacaggcacacacactgtatctcttttttttttttttctgagatggagtcttgctcggtcgcccaggctggagctcaaccttcgcctcctgggttcaagtgattctcctgcctcagcctcccgagtagctgggactgtaggcacgcgcccccatgccagctaatttttgtatttttagcagggacggggttttgccgtgttggctaggctggtcttgaattcctgacctcaggtgatctgcccacctcagccttccaaagttctgggattacaggcgtgagccactgtgcctggcacacagtatctcttatagtacctagtgcagtgtgacaagttcatttttctaattctttaaacctttcttggttggttgaattgttaagaatggtagatctcag

SEQ ID NO: 1039 - DNA, 1195 bp, Homo sapiens
ttagtttgggtttttttttttgagacggagttttgctctttttgcccaggctggagtgcaatggcgcaatctcggctcaccacaacctccgcctcccaggttcaagcaattctcctgcctcagcctcccgagtagctggaattacaggcatgtgccaccacgcccagctaattttgtatttttagtagaaatggggtttctccatgttgatcaggctagtctcgaactcccaacctcaggtgatccacccgccttggcctcccaaagttctgggattataggcatgagctaccacacccggcctgttgggaagattaaatgagacatgctcaaaaacacttagaactgggcctggctcttagtcactgctcagcaaatggaaccaatcttattgttcttcttgctccctacagacctaggctactctgaagcaggtggcttagccctggccctggctggatgcaggacaggttggcagggaggcagcagagccaaattttgtacaaaggagctggtgctagcaagctcaggaagaagccacagccggaagttcaccttgccaggacctggctcagctgcaggttcccaccgggccaccaggtggcggtgggagcccagccctctgagtccacgttgggccccagtctcactctgtcttcaggacaaagccaggggctgcagcccttgttcagcagactctggcttttcacagcctgtttgaaaaagggagtagcttcatttgattgagtttccactatatcatgggcatatactctgttctagtaaatccctattttacagaggaagaattttagctcccgacaatgatgtatcttccctgagttcctgcagctaatgagaggcagaagtgggatttgaacccaagtccctgtaacagcagagctcaagccacactccattctggcccccacgctactcacttctgtctgcaccctgtatccactcagccaagcctggcggcactgctctgtaaccctccaccagcctgtccacaacccctcctgaggctgcctgtggccagtcctctcctccccaccccttcctgctggtcacccgtgcttcctggcaccaccacactattcactcatccaggccttggcttatgctccccctctggctggaagagcctcccttttccctcctcccatgtctcctgccccctttttccctaccc

SEQ ID NO: 1040 - DNA, 1177 bp, Homo sapiens
tcttgctgctcctgtctgaagaaatcagactgatttcctcttaagactcctagggatgtggtgaagagctgggactcaagtgcagtccacggtgtgaaacatgagggaggtgaggtgtccgtccacttcccccataaaggtgtgcatttcagttaggctgccccgccacagagcaggcttcatctgctctgccatccagccccatctggatgtgaggtggggtggagacatcatggggtgattgcagaaagggggagtggcggcccacgcagcttctgctgaggagctgaccgctctgagctgttctgtttcgtattgctgctctgtgtctgcatgtattgtgaccgtgcggctccacctcttccagctgctgctacagctgaggcctggatcccggcctttccctgtgacttacgtgtctgtcaccggcaggcagccctacaaatcctggtgacctgctctcccaagaacagagcctgtccccagatgtcccagtagcgatgagtaacagaggtggctgtggacttcctctacttctccttgctggatcagggccttcctgcctcccgctgggcaggtctggccttgctctcttggcagggccccagcccctctgaccactctgcagctcaccatgcagctgatgccaaagttgtggtgtccagtgtgcagcagccctgggagccactgccaccttcagaggggttccttgctgagacccacattgcttcacctggccccaccatggctgcttgcctggcccaacctagcgttctgtgccatgctagagcttgagctgttgctcttcttcaggggaggaaatagggtggagagcgggaagggtcttgctcctaagtgttgctgctgtggcttttttgccttctccaaagacgcactgccaggtcccaagcttcagactgctgtgcttagtaagcaagtgagaagcctggggtttggagcccacctactctctggcagcatcagcatcctactcctggcaacatcaggccaacgtccaccccagcctcacattgccagatgttggcagaagggctaatattgaccgtcttgactggctggagccttcaaagccactgggatgtcctccaggcacctgggtcccatgaccagctccccatctccataggggtaggcatttcactggtttatgaagctc

SEQ ID NO: 1041 - DNA, 1175 bp, Homo sapiens
ctgtcattcagaaagtaacctctaacttgtgttttctttcttttcttctgatgttctcattgcaggagtctggttggaagcaaatgtttttttaatggacttgcatctcctcaccttgatcaggactaaaggacggaggccgccccacccccttccctttcctccaaacccctaactccctccagacacccagggaataccctctgccccacaggattgaagactgcttggcagtcctcccaatcccacacctcctgtttgccaggggaaagaacctaaagacttcgtgtgattgggaggggtggcagacaggaagaaaacatgtccaggcccctggtctccatagagaatggtgctttgtccaagaaaacgtatgagtttctgattctccgggagccgttcaatggtgaggttgatgggaagacttccttcccaaagaaaatagatcctccatgcaggatctaggagagtgactgggtgtgccaaaatatgcccagggtcctgccctcagcactagatttaatggggccaagagggtccaaaccccttgctaacataccacttctttgtttaactcctttacctttccagccctttgaggagggaccatgagaacagaaattaccttatgaaaagctacttctgttcctgctttccctctcacgtattgacggtttatttctttgacctcccagagggctgaactctttcaactctgcgctgcccagccttctcagtggacttgcccctcctaagcagagaaggcctatgaggttgcttgctgctgggaagcctggcagagccaattaccaccctctgctgcttagtgcttgggtacctcttgcaataaccagctcttagttgttccctttccctggggcttttccatttaacacatggagcccttcccccagaaggctacttccttgttttagaggaaggtactgcccattgggagatggggacattgggacctcagcaatgaagaacccttgtgaagtaaccaggaggaatggggaaagaagcaagttgggcaggatatggcctacttccataggcttttcttttttcaggtttgatgtaagcatgggcttacatcccccaggtacatacttttacttattgtgggataacctggcactagtaggcaggtaaagtcacaaatttggtgtctt

SEQ ID NO: 1042 - DNA, 1271 bp, Homo sapiens
tatctctaagtgggacgaaatgatttgagcttagcaggcagcctgattcccaatgtgtaatttcatgcggtcagtgtctccagaggttcttgtactgggcataatgccagggggctgagttgggaatggggaagatgaatgagagacaatacctactttcaaggaaacttctgatgaagcagaatgtggttattaatcagaaaagaggtacaggcaataggttctggggactccaaaaggggcctgactgcacctggctttgtgaagtcacttttctagctggccttgaggctgggcagggtttctgacaggcagaggtggagcaggggggatgaactctgagcagagaagctggaaatgaggggtaagtttgaccaccagacatattgtggaggactagtgtcaggggaagagtatggtgcttggttcagtgatgagagatttgatcagggcactggcatggactgagccatggtcctggcagattcatttggcggcatgctgaaggatttagattggctaggaagagctagaggcaaagagaccttgtaggccttggtacttttgaaggggacatgcaagaagggctggggggtgccaatgggaatggaagaaaggagcagtggcactagatactgcaggattggacccctgagaagctgaagatgagtgagtctggataaccaggagaatggctgcaccatgcaaacaaagagctgctgagaggaagaggaagagttgttcgtgactgttatgctcgctgcttttctcactataggacttggcctggatgattaccttctacgtccgcttcttcctcacttatgtgccactattggggctgaaagccttcctgggccttttcttcatagtcaggtagtattcggtgggggcggatagggactggtgaaggaaatgttggggagtgaccagtctggtctaggggccgtgctggggctttgggtaacagtgggtgtttcaggagttggcttgggaaagtagacaggctggagcagttatctgaggggggaatcagaattctgggctctgtgtgtactgtttttgtctgtgtaatacatctaacaggttcctggaaagcaactggtttgtgtgggtgacacagatgaaccatattcccatgcacattgatcatgaccggaacatggactgggtttccacccaggtaagggacagtcactcagaagactggagcataacacaactattgaaaaggatgcgtaggtgaaaacagcaaaaacaaaaagtccccc

SEQ ID NO: 1043 - DNA, 1457 bp, Homo sapiens
ttctccctttctcctctcctttttctcttcacatctcccccatagcaccctgccctcatgggacctgccctccctcagccgtcagccatcagccatggccctcccagtgcctcctagccccttcttccaaggagcagagaggtggccaccgggggtggctctgtcctacctccactctctgcccctaaagatgggaggagaccagcggtccatgggtctggcctgtgagtctccccttgcagcctggtcactaggcatcacccccgctttggttcttcagatgctcttggggttcataggggcaggtcctagtcgggcagggcccctgaccctcccggcctggcttcactctccctgacggctgccattggtccaccctttcatagagaggcctgctttgttacaaagctcgggtctccctcctgcagctcggttaagtacccgaggcctctcttaagatgtccagggccccaggcccgcgggcacagccagcccaaaccttgggccctggaagagtcctccaccccatcactagagtgctctgaccctgggctttcacgggccccattccaccgcctccccaacttgagcctgtgaccttgggaccaaagggggagtccctcgtctcttgtgactcagcagaggcagtggccacgttcagggaggggccggctggcctggaggctcagcccaccctccagcttttcctcagggtgtcctgaggtccaagattctggagcaatctgacccttctccaaaggctctgttatcagctgggcagtgccagccaatccctggccatttggccccaggggacgtgggccctgcaggctgcaggagggcactggagctgggaggtctcgtcccagccctccccatctcggggctgctgtgtggacggcgctgcctcaggcactctcctgtctgaacctgcccttactgtgtttaacctgttgctccaggatgcattctgataggagggggcggcagggctgggccttgtgacaatctgcctttcaccacatggccttgcctcggtggccctgactgtcagggagggccagggaggcagagcgggagggagtctcaggaggaggctgccctgaggggctggggagggggtacctcatgaggaccagggtggagctgagaagaggaggaggtgggggctggaggtgctggtagctgaggggacgggcaagtgagaggggagggagggaagtcctgggaggatcctgagctgctgttgcagtctaacccactaatcagttcttagattcaggggaagggcaggcaccaacaactcagaatgggggctttcggggagggcgcctagtccccccagctctaagcagccaggagggacctgcatctaagcatctgggttgccatggcaatggcatgccccccagctactgtatgcccccgacccccgcagaggcagaatgaacccatag

SEQ ID NO: 1044 - DNA, 1214 bp, Homo sapiens
ttactcttgggttcaatccagtagctcatctgccccccagtctccttaggcactgattccttcatgctgtgctttgagaaaggaagcctaggctgacgagaccatcttgcctccctgtagatcgtcacagctacctgtctctggggatccctagtataacacattcagtgttcccctttcagtcttactactttgaccgcgatgatgtggctttgaagaactttgccaaatactttcttcaccaatctcatgaggagagggaacatgctgagaaactgatgaagctgcagaaccaacgaggtggccgaatcttccttcaggatatcaaggtgaacaaaagatcctaggggtgtcatacttcatcatctggcagtgttcgggtatcagaaatcacttaaactagcaattgcccttataaagtgatgatacactgggcttttgccttttgtgcttttttaggcttaccatctaaactaaattaggcaaatagtaatgtcccttttgccaaaacgtggtggttagagatgatgggcttgctgacttctaggttagttggtagagatgcattaacctattctcattcagaaaccagactgtgatgactgggagagcgggctgaatgcaatggagtgtgcattacatttggaaaaaaatgtgaatcagtcactactggaactgcacaaactggccactgacaaaaatgacccccatgtgagtattggaaccccaggaaataaatggaggaaatcatttgccttagggattgggaaagctgcccactaactgtcttccccattgttttgcagttgtgtgacttcattgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttaagttctttgatttgtaccattccttcaaataaagaaatttggtacccaggtgttgtctttgaggtcttgggatgaatcagaaatctatccaggctatcttccagattccttaagtgccgttgttcagtt

SEQ ID NO: 1045 - DNA, 1234 bp, Homo sapiens
gcctttgggcaaatctgctgaatgggagaatacagaacctgcctcccaggtggtggtcgggacaggttcaaggagtgcctggctcatgcgagctctcaaggactttgtaaggttaagctgccagaggaaggttggaaggatgtgacacaagggcgttctctgggtttgatggtggtacaggcaggggcagggctgaagagggtgacagagctctctgtagggaggttggagagggtgacagggctctgtggtgggcaagggatggggaggttcatggagagccccaaggcagtgtctggtctgtggtctcctgcaggcaccccgctcagccaggctatcattcaccagtactaccacccaccgaaccttctggagctctttggaaccattctcccactggacttggaggatatcttcaagaagagcaagccccgctatcacaagcgcaccagctctgctgtctggaactcaccgcccctgcagggcgccagggtccccagcagcctggcctacagcctgaagaagcactgaggctggcctgcggccttcttggcagcctcgcctcctgtccatgtctatctgtctgtctgtcggtctctgtcttggtctgttgccctccttcttggcatgccattgtggagggcttggccaggtgtatataaacgtcctctgtgctgggtgtttctgctgcaggtggcaggtggccccaggcctgtttggaggatgggctgggtgggtgggtggggaagaaatgggcccagccccacatggcctgcagacagtgctctgtaaatagttgttttaatttagctgaatgttagcattttagtctttggcattttagcgtttgggaggtagattaataaagtatattccttcaagcctgctgttgataccatgaagactgggcgcctcagtcccagccctgtagctgtgtgtcttgggccaccagtggcctgcaggacgaaggtactgttccatcacctgcggtgtgcctcaggatcaccaggtgcaggcccccaccctcggagatgctgctgcagtgagtggttccactgcctggataacccttgaggaacacgtcagttactgtcacgatggggcaggtggagctccttcctattttttggggtgctccctgtttgtaaaggggagtttgttcattgggaaagacctgggtcttgacacggccctgccacttagtcccctaccctctccattccccaggctccac

SEQ ID NO: 1046 - DNA, 1184 bp, Homo sapiens
tgaagaactcactcagaccttcatgagctgcaatctcatcactggtaagagagtgggtctgagaaggaaggagaacaaggtgtagcaagtgctgtgattccaaaggctgaatgttctcccttgccgcttcaggaatgttccagcgactggacaagctgaggaagaatgccttcgccagtgtcatcctttttggaaccaacaatagcagctccatttctggagtctgggtcttccgaggccaggagcttgcctttccggtgaggaaggtggaggagaggagtctctttagggtggggcagggatataagaagcactgtgttttatttctgagttgatggatgtttaggagggttcaggaatgcttataggaaggagcagttcatgttcacaggagacctggggtctgatgacatgtgtttgagctggaagtaacacaggtgtggggtggtgtctcataacttgaccacatgctggctttttatccccagctgagtccagattggcaggtggactacgagtcatacacatggcggaaactggatcctggcagcgaggagacccagacgctggttcgagagtacttttcctgggagggggccttccagcatgtgggcaaagccttcaatcagggcaagatcttcaagtgaacatctcttgccatcacctagctgcctgcacctgcccttcagggagatgggggtcattaaaggaaactgaacattgaaccctttcctgtcctgcctcctttgtgagtggtggcgtcttcaaggggagtagatatgttgaagcagggtactttctgtgttcgcagtacctcgatatgcaggagagaagacttcagaagaacagaaatagaggcctgtgttcacttgtgattttaattaccctgcctcctacggtgatgactgtcttctagctgggaaagagcggaagcagttggggcgggtagtgacatggggctttgtgactacctaattcttagggatcagattccaggcctttcccagtgaagggagagaatagctgctaataacaagagctaacgtgtataattcacagagcgcaaaggaactttacattatttcctgtaactgtcctgtgaggtaggtagctgacaatatgcaagggttgtagtttctttttctttttttttctttttttttttcagacaaggtctggctctg

SEQ ID NO: 1047 - DNA, 1184 bp, Homo sapiens; identical to SEQ ID NO: 1046

SEQ ID NO: 1048 - DNA, 1128 bp, Homo sapiens
gaaggggcttgactaacttttataccttggtttaggaaggggaggggaactcaaatgcaataattttacagaggtaaaaacatgcaagaatcaaaagaagcaaaatggttacagagagataaacaatttaaaagacaaatggttacaaaaagcaaccgtaccaggtgcagggctctaaatccttcattataattagatatggggctatgcgggacacaactcaaggctttatgttgttatcactttgagaaaaatcctgggaacttcatacattgtttgtgccagtaccttatcagttaattgggctcctttgaaatgctgaggatctgcttaacacaggtcaactccttgtggaagggggttgggtgaggagcccttagtgtcttgtaaattaaagggtcaattggagtttgtccggctttcccagctagagagagagtcttatttacatgagaagcaaggctaggtggttaaagagacaaacagggaagattcaaagtagtgagttagagtaaaaacaaggttaggcatttaacacatgtatgcacacacacatatatgtgttttttggttgttttttttttttttgttttttttttgttttttttttgagacggagtcttgctctgttgccaggctggagtgcaatttcggctcactgcagcctctgtctcctgggttcgagcaagtctcctgtccctgcctcccgagtagctgggactacaggcgtgtgccaccaattttttttttttttttttttagtagagataggttttcaccatgttggccaggatggtcttgatctcttgacctcgtgatccgcccgcctcggcctcccaaagtgttgggattacaggtgtgagccaccctgcctgtccttttttttccccccagacaggactcttcctctatcgcccaggctggagtgcagtggcgcgatctctgctcactgcaacctctgcctctcgggttcaagctattctcctgtctcagcctgccaccacgcccagctaatttttgtatttttagtagaaacggggtttcaccttgttggtcaggctgggcttgaactcctgacctgaggtgatccacctgccttggcctcccaaagtgctgggattacaggcg

SEQ ID NO: 1049 - DNA, 1204 bp, Homo sapiens
ttaggagagatgggggttcaccgtgttagccaggatggtctcgatctcctgacctcgtgatccgcccgcctcggagatcccagcagtttgggaggccgaggtgggcggatcacttgaggtcagagttcgagaacagcctggccaacagggcgaaaccccatctctactaaaagtacaaaaattagctgggtgtggtggcaggcacctgtagtcccagctactcagaaggctaaggcatgggaggctgaggcacgagaatcacttgaacccaggagatggaggctgcagtgagctgagatcacgccattgcaccccagcctgagcgatagagtgagactctgtctcaaaaaaaaaaaaaattgaaaaaaatgaagaaatgggaagtaatccagggaaggatgatgttgtatgaagctattgtctatagggtttgaaaagaaggtgagcactgggacttaggtagagcaaggactcttgctgtgaacagaactcttcagggcctttccactgactttgtttacacccttatgtcctggcaggttctagagccttctttccgccaggcctttcccaataccaaccgctggttcctcacctgcattaaccagccccagttccgggctgtcttgggcgaagtgaaactgtgtgagaagatggcccagtttgatggtgagtctgaggagactgggaggcatatggccaggatcagggtctggtttgctctgcatcaaccccttgatttcctgtcttgcttttgggttatggggacctgcagaatgtagggtgtcaatgtggtagctaatattatgtgcagtttcgtgtacactcataccctgactaatttgtattactatatagatttgcgatataaagtatttgttgctgagtgtgttgttgctggaggacacacagtgaactgatgagcagtctggggcctaagttccttacttgtcccattcgtcagtttcctctgttaccttgcttgctctgtgtggttttggaggggtgtggaaagaggcagaacattcgttcactttcctgccttcctctgcaccagctaaaaagtttgcagagacccaacctaaaaaggacacaccacggaaagagaagggttcacgggaagagaagcagaagccccaggctgagcggaaggaggagaaaaaggcggctgcccctgctcctgaggaggagatggatgaatgtg

SEQ ID NO: 1050 - DNA, 1109 bp, Homo sapiens
ggtagagggtggatgcccagggcacccaaacctcccttccctttcgtgtcgaagggagtgaggagtgaattaaggaagagagcaagtgagtgtgtgtccctggaggggttgggcgccctctggtgttaccacctcgagacttgtctcatgcctccatgcttgccgatggaggacagactgcaggaacttggcccatgtgggaacctagcctgttttggggggtaggacccacagatgtcttggacagttttggggggagggttttttaattttttaaaaattttgcctccctttgtgaaaggggatggggaggggaagagtaaacagataacaggtggtggtacctggttgggggaggggggcgtgcactgccatgtctttttttttttttttttttttttttttcctaattgggggtttctctttctgtccggtgtccggactttcctaattggagtttgaggcccctaagctggcatcaaccccaggccacgctcgctctttccttccctcccctccccctctgccttttgtacgccagttctcagaaataaagatcttttgtccgtttttttaacctcggattctgtaattggttcttatagtaacaaataaaaagctgttttcttcagcttctcctggctcagctgttctttgccatgggtgtgtgttgtgtgtgtgttgggggtgtctttgagagggaaaataaaggacaaaggacaacaaaggaggtacagatggttcttgccctgggaacagctttatgagataggcagcctggacccaggcggcttgctccagctaggcttcttgtgggacccaaactgctccccagctcccagtggtgctggagctcaagaaccatcttggcccagattcattcaaaggagttgagatgagctttctggatgactggtggcctccataggaaaggggaatgggggtgtttcttcctctgtttcccacctcttactcccctctcccttttgtttaaggaattctggaagttgctagcagccagggtaacatgtatacccccttgggggtggtggtggggttataggaggatcccctcacctagctgtgtggtgtatttggcagacgagaat

SEQ ID NO: 1051 - DNA, 1208 bp, Homo sapiens
cagggcgagattagagttggttgcaaataccaagctgagatcccagatcgcctagtagagggtaagcaacaggacaagactgtacggctaccaggttgtctaattccaaggggcactttaacattatagtctctgtgaatggcgtcacctggggttgtgcagtgcactgtctgcagggctctctgccatgaccctgacagaatgggcctgtaggaacctgaaaagggaaaatgggaacagttgggaagagaagtcggagagttgatagaatccaagcagaagaagagaaggaggaggtgctattgtgaatgaaaagacaccaactgttcccccctgccctctccctgttgatgccattgttcttttccccaggagaatctgataatcggaaccagcagaagatggagatgaaggtctgggacccagacaaccctctcacagaccggcagatcgaccagtttcttgtggtggcccggtgaggggtgggtggatagggaagatgggctgggggaggtgtggacattgttctgagtcccatggttcttagagatggactttatttctttcattgccatggatgttttccttctttctcctttggcttaatttcccagcccacttgggcttttgacttttctttcgcttttgacttctcaatttctcccttagagctgtgggaacctttgcaagagccctagattgtagcagctccattcggcagccaagcttgcacatgagtgcagctgctgcctcccgagatatcactctggtgagcagaagttggtgggtagttgggcaggctgggttttctggggacttgcagagcctgggaacagaagaggagggtatctctgagggagtgggagtgttttttttttgtttgttttgttttgttttgagaggagtcttgctctgtcgcccaggctggagtgcagtggcgcaatctcagctcactgcaagctccgcctcccgggttcacaccactctcctgcctcagcctcccgaatagctgggactacaggcacccgccaccacgcctggctaattttttgtatttttagtagagacggggtttcaccgttttagccaggatgatctcgatctcctgacctcgtgatctgcccgcctccgcttcccaaagtgctgggattatgggtgtgagccaccgcgcccggccgggagtgggagtgttttaaggagcaggaagg

SEQ ID NO: 1052 - DNA, 1132 bp, Homo sapiens
gggtgaggggctggaagcagtggggcagagtgagccaggtggctctttctgctgctcccttccccggaccacccctctgtttcttctctcccgacctccgttagatgcgctggacccgtggtgtctcagtgtggcctgtggggctggtgggcggcctgcgattcgagggccctcaggtacaggacggccgggtagtgggcttccacacagcatgggagcccagcaggcccttccctgtggatatggctggatttgccgtggccctgcccttgctgttagataagcccaatgcccaatttgattccaccgctccccggggccacctggagagcagtcttctgagccaccttgtggatcccaaggacctggagccacgggctgccaactgcactcgggtaagggaatggagatgggcatagaaacctggctcttggatggacaggtgatgggggaggtacagtgagaccctgggaatgggtggtttaaccaggagggactctccagatctctgatcagccttgctgactctactgaaggggaagctgggaactagcgggggaaagtggtctcctgccactctgccccgagttctgggaacccatgtggcacagagaggatgaaggaataaggccctgtttgttgtttttttttttttttcagacagagtctcgctgtgtcacccaggctggagtgcagtagcgcaatcttggcttagcgcaagctccgcctcccgggttcacaccattctcctgcctcagcctcccaagtagctgggactacaggcacccgctaccacgcccggctaatttttttgtgtttttagtagtgacggggtttcacggtgttagccaggatggtctcaatctcctgacctcgtgatccgccttcctcggcctcccaaagtgctggggttacaggcgtgagccacgcgcccggccaaggcccggttttagaggcactaagtcttcctccaccctgccctttacactttgaagcctatactgtatatgtcgatagggttagagaatccattccaggctcggggacccagaggcctggctgcagctgggcctggctctcactgcatccctcctggcacaggtactggtgtggcatactcggacagagaagc

SEQ ID NO: 1053 - DNA, 1226 bp, Homo sapiens
ctgcctttctcttctgggatgttgacagaggctggtgttcaggcctgtgcctcctggtggcacttattcctcattttcctttctcatttctctccccatcctttgcaaacttatctgctcattgtgggttccctctccaagctttaacatttagtcccttcctccaatgccttcgttcctttggacccttggctctctattccccaacccctccttccactagcccctcgtccctgccccctctggattggagcagacagctctcctaccttccaggcaaggatcaaaagacccagctgagggcgatggggcccagcctgaggaaacacccagggatggcgacaaggcaagttggagcgggtgggtggttggaggatagggctggctgggagggtggaggggagaggcccatgagaaacttgaacttagtctccccatcagggatgggatttagttgatgggagcggggaaagagagaactggtatgattggagagtggtcctcttttcttcttaacagccagaggagactcaggggaaggcagagaaagatgagccaggagcctgggaggagacattcaaaactcactctgacagcaagccgtatggtgaggggctcgggttccttgggctggggtgcagggctcctttccaagcagaagctctgaagcttgtttgtttttcttccaggccccatgtctgtgggtttggacttctctctgccaggcatggagcatgtctatgggatccctgagcatgcagacaacctgaggctgaaggtcactgagtgagtcctatggtgacatcaggaagatggaggtgggcaggaaggagtcaggcctttagggagatgggtgtgcatattggatactctaggcaagcatgggtcatttcttgtgtccagaatcacctttggtgatagaaaattttttgagaaaggacaagaggagcctttgcttatctctcacctgtgtctgtggagtggtgttagcatataacgcagcctggggccagttagcagcccaagtctgtctgtttgcctgcaggggtggggagccatatcgcctctacaatttggatgtgttccagtatgagctgtacaacccaatggccttgtatgggtctgtgcctgtgctcctggcacacaaccctcatcgcgacttgggcatcttctggctcaatgctgcagagacctgggttgatatatcttccaacactgccgggaag

SEQ ID NO: 1054 - DNA, 1334 bp, Homo sapiens
aagaacgcggacacagactatggtaggaacggcctttattggctgcagcgggaagtggaggagggtatacagcgtccgcagacctgaaatcaaatgagaaagtgtgagcaccccgatggaggagccagctggatctcggttgtccttctccgagattcccggtgtcccggcgtttgaggatagaaccagcggatgggaagccgccagcaccgaagacatgacgccgagggggccagagccctttccctcttcctccgtacattacggggagcggcaccacaagcccgatccccgccaagaaaaggagggtcctgagaccccgcccagagccttccacccggcacccccaccactcccggccgcccaatctggctactacagctaaaaccacacttactagctcaccaccctccgaaaggcctcccgcaccgcggagctcctttatatagcccgaggacccgcccccgagttgcgattggcccgcggaaggccggggcggagccccgcggatccggcgctgagcggaagtacggaccgtgaactggagtggaatcgcgactatgggagctccggggggaaagatcaaccggccccgaacggtgactgtgtgggggccgcgactttgtttcctcaagcgttcctgagcccttttatctcgcacgagatgggatcagtgaggggccggggctgcctggtggaggggccccgggtcgcggcgagcccactccatctgattcgcatctttctccccggcaggagctgaagaagaagctgttcaaacgccggcgggtgttgaatcgggagcggcgtctgaggcaccgggtggtcggggctgtgatagaccaagggctgatcacgcggcaccacctcaagaagcgggcgtaagtactagaccctcttcctgttggtcgtccccaccgagtcttccttcctccctgcagagctccggagcagcttcacctctcagctcaccttgtgcactgacgcttatgcggggaatgtctgtcggctgttagttcctaagctctgatagcctctcacaatacctgtagcagacaacctttctttgggttttggattctgttaagaatctcaggaaagccggggatggtggctcatacctgtaatcccagcactttggggggctgaggtgggcggatcacctgaggtcgggagttcgagaccagcctgaccaacatggtgaaaccccgtttttgctaaaaatacaaaaattagccaggcgttgtggccggcacctgtagtcccagctacacgggaggctgaggcaggagaattgcttgaacctgggaggcggaggttgcagtgagccgaga

SEQ ID NO: 1055 - DNA, 1196 bp, Homo sapiens
cttggtctatcacagccccgaccacccggtgcctcagacgccgctcccgattcaacacccgccggcgtttgaacagcttcttcttcagctcctgccggggagaaagatgcgaatcagatggagtgggctcgccgcgacccggggcccctccaccaggcagccccggcccctcactgatcccatctcgtgcgagataaaagggctcaggaacgcttgaggaaacaaagtcgcggcccccacacagtcaccgttcggggccggttgatctttccccccggagctcccatagtcgcgattccactccagttcacggtccgtacttccgctcagcgccggatccgcggggctccgccccggccttccgcgggccaatcgcaactcgggggcgggtcctcgggctatataaaggagctccgcggtgcgggaggcctttcggagggtggtgagctagtaagtgtggttttagctgtagtagccagattgggcggccgggagtggtgggggtgccgggtggaaggctctgggcggggtctcaggaccctccttttcttggcggggatcgggcttgtggtgccgctccccgtaatgtacggaggaagagggaaagggctctggccccctcggcgtcatgtcttcggtgctggcggcttcccatccgctggttctatcctcaaacgccgggacaccgggaatctcggagaaggacaaccgagatccagctggctcctccatcggggtgctcacactttctcatttgatttcaggtctgcggacgctgtataccctcctccacttcccgctgcagccaataaaggccgttcctaccatagtctgtgtccgcgttcttttttccgggactgcagagttcggggaagctgtacgccgcctttcgctacgcggaatttgcagatcttcccctggacctcaggcctctccggctggagtagggtggacgcttcacataagcttctctggtcgaacttacccgaatctccagatggccgcgctgcgtcgaatgctccacttgccgagcctgatgatggggacgtgccgcccctttgcgggtagggaggtgggggcagagtggagagggcaaggtgggggcagagtggggagggtaaggtgggttcctcgtgagtcaggagtgtagtccctgaaattgtgattctcaaaccctacggtgggccgtgcgtggt

SEQ ID NO: 1056 - DNA, 1196 bp, Homo sapiens; identical to SEQ ID NO: 1055

SEQ ID NO: 1057 - DNA, 1177 bp, Homo sapiens
tgctactcagttggtcacaatatctaatagttccctttctgacttggccaggtaacccagaatctcccaatgaaagaaggctgcacagaggtctctctccttcgagttgggtggtctgttgatttttcccgtccacagcttggtaaagttatttctttaagttcctcattagtgtttactaccatattgcttactctatgggaagtccggttgtaggtaactaatttgttgactgttctaggtgaagatgaattctcttacggtttcgatggacgaggactcaaggcagaaaatggacaatttgaggaatttggccagacttttggggagaatgatgttattggctgctttgctgtaagtgctcctgaaagttgtgggttataacaaggagcggatagagggcactgggaattcacttgtgcttcccatcaactgctggcttttatgcatgtgatgtgtgtggctcgcttagttactttgtgcagcagtctgtgtgaaaaaagaataaattgtaaagtttaatcaacccaaagcctcgtcagccaataagtgctcttgtcccttgtcattgtagaattttgagactgaagaagtagaactttccttctccaagaatggagaagacctaggtgtggcattctggatcagcaaggattccctggcagaccgggcccttctaccccatgtcctctgcaaaaattgtgttgtagaattaaacttcggtcagaaggaggagcccttcttcccaccaccagaagagtttgtgttcattcatgctgtgcctgttgaggagcgtgtacgcactgcagtccctcccaagaccatagaggaatgtgaggtatgccaaacagtatacgaacactgaggttgtatgctttgcagaggtgggtgcgtatgctctccagggtctcagagcgttaccaaacaggaatgggaggatgttcttaaattggttttgataaacatgaccctcatttatttttcattatatttctggttctgttttttgcaggtgattctgatggtgggactacccggatctggaaagacccagtgggcactgaaatatgcaaaagaaaaccctgagaaaagatacaatgtcctgggagctgagactgtgctcaatcaaatgagggtaagttgctgttggggatttgtcggatacagtatttggaga

SEQ ID NO: 1058 - DNA, 1177 bp, Homo sapiens; identical to SEQ ID NO: 1057

SEQ ID NO: 1059 - DNA, 1218 bp, Homo sapiens
tgccaggctagagtgcagtggtgcgatctcggctcattgcaacctctgcctcctgggttcaagcgattctgctgtgtcagcctcccaagtagctgggactacaggcacccaccaccatgtccagctaatttttgtctttagtagagaaggggtttcaccatcttggccaggatggtctggatctcttgacctcatgatctgcccacctcagcctcccaaagtgccaggattacaggcatgagccaccacccccggcctattttttttttttttttttttttttagagacagggtcttgctctgtagcccagactggagtgcagtggtgtgatcatagccttgaactcctgggctcaagggatcctcctgcatcaacctcttgagtagctgggattacagcttgaagcaccttgcctggccctaaataaatatttttaaaggaacctttggacagaggaatatgttaaatgaaactacggggatgtaagcagcaaactccagaccctcaacccgtaaaacaaccccagcttcttcaacaaataaattgcaaggaaaaagggaagggaaacctagtaaaacttaaggccaggttcagtggcgcacgccaatgatcctagaactttgggaggctgaaggggacagatcttttgagcccaggagtttgagaccaatgtgggcaacatggcaaaaccctctgtctacaaaagatagaaaaattagctgccactagggtgcatgcctgtaatcccagatattcaagaggctaaggtgggaggatcacttgagcccaaaaggttgaggttgcagtgagctaaaattgtgccactgcactgaagcctgggcaacagagtgagaccctgtctcaaaaagaaaaagacagttaagagacatcaatcaaataaatgcatgacactactttggattctaattggattctcattgggaaaaagagaaacttgagtaagaattattgtcagggccgggtgcggtggctcacacctgtaatcccagcactttgggaggcccaggcgggcggatcacaaggtcaggagatggagaccacggtgaaaccccgtctgtactaaaaatacacacaaaaaaattagccgggcgtggtggcggggcgcctgtagtcccagctacttgggaggctgaggcaggagaatggcttgaacccgggaggcagagcttgcagtgagccgagatcgcgccactgca

SEQ ID NO: 1060 - DNA, 1243 bp, Homo sapiens
agaagtgggaagattgcttgagcctaggagtttgagacagcctgggcaacatatcaagactctgtctctacaaaaagtttttaaaaattagcctagcatggtggtgtgcacctgtggtttcagcaacttgggaggctgaggtgggaggatcgcttgagcccaggagttcaaatttacagtgagctgtgatcgcaccactactttccaacctgggcaacagagtgagaccctgtctcaaaatttaaaaagcaaaaaacaaaaacacaacacttgaggggacaaagaaaaggcaagatcactcttttgttttttttttttgagacagagtcttgctctgttgccaggctgaagtgcaatggtgcaatctcggctcactgcaacctccacctcctgggttcaaacgattctcctgcctcagtctcctgagtagctgggattagaggtgcacgccaccatgcccggctaatttttgtatttttagtaatgacggggtttcaccatgttggtcaggctggtctgaaactcctgacctcgtgatccaccggcctcggcctcccaaagtgctgggattacaggcgtgagccaccgtgcacggccgtaagatcactcattttttttctaggttggactcttcacagaaattgggcccatgtcttgcttcatctctcgacatgtaagtctgggcacactgggtggggctgaggaagacagatactcattcatcaccatctattgaagcatccatttaaagtgctaacctagatctcactttcctttcagtccatcccttcagagatggagtttgatcctaactccaacccaccatgttacaagacaatggatgaggtgagtggacagaaagaagtcagggagacaaggagagaatcagccatcctgagggagaatattggcctggggatggctgagtacagatggtccccgaattaccatggcttgattcatgattttatgactttacgatggtgtgaaagtgatgtgcattcaatatgcccccgggcttacagtgaagtgattgtgatgtaacttctcataaactgaggagcatctgtacactgttccctcctctcctcaggatattgtgattcagcaggacgatgagatccgcttaaagattgtggggacccgtgtggacaagaatgacattgtgagtcttttccccacctctctacctataccaggttgagctgagaactgtcgatttcttttttcttttttttttttt

SEQ ID NO: 1061 - DNA, 1099 bp, Homo sapiens
gggggaaaatgtccccttgattcagttatctccacctggtcccgctcttgacacgtggggattattaaaattcaaggtgagatttgtgcggggacacagccaaatcatatcagtcatctcattttcacagcaaccctgtgagctagagagggcaggaattattgtgcctgttttacagtttaggacacaagggctcagactgatgaaggccttggccaaattcacatagaaggtgacagggcaggaatgggacctagttctgtgaaccccaacactttggactttgtctagcttcaccgttcttgacccactggccagtctgtttccttctctgagcctcactttcctcatctgggtactcagagctccttgtttagaaactccagagcacgagcagcaaggctggtgtggagggtgttggatcacactcctgggctctccgggaggctgggcagcttttccagtcttcattctccactcccagctccactggggccatgtcagagcgagaagagcggcggtttgtggagatccctcgggagtctgtccggctcatggcggagagcacgggcctggagctgagcgatgaggtggcggcgctgctcgcagaggacgtgtgctatcgtctgagagaggccacgcaggtacactcccctcaccccctgatacctccaactttccttgtttctgcctttttactaacctccaccctcgctgatttattcaagtgtacactgggtgcctgctccatacaacagagacagtccatgcctttacagaactctacttgtagctgtctgggcttccagcagacaaagcgcttgccaggcatcttcccatgtgctcctcacaacagccctgttgggcaggcagagcgggtagatactcacattctgcatgtgagaaactgaggtgttgacagaagatgtgacacccggggggtgtttttgtacaggagcagagacggaatctaggcttctgatccctaagcgtggtctcctgtttgccttctctccagtctggcccacttcatttggggtttcccatgccccctgcttcacatcctttgactctggcttttgttccctccctcccagaa

SEQ ID NO: 1062 - DNA, 1099 bp, Homo sapiens
actcggtctcaaaaaaaaaaaaaaaagttggacattcaggttgtattcagggccatatgcaggtatatgtgaatgagtttctgtaggttacatttatagaaatagaattgctagatcaaagaatatgaacattaaaattgtaaaacatgaataaggtgatacactgtcttccagaagaataccgcattcatgttttacaattttctggtggatccaatgcagtctgggcccttccttttaggttgcactccaggacttgcagacgaactccaagattggggcactcctgccttactttgtttatgtggtcagtggggtaagtgaccaggctgggacagggagaatgttttataaggaagagatgacccagcaggtgtagggctcatggcaagtgctgtcagaatggtgggctcctgcctgtcccctcatgtccctgtaagctaccctcttctcccaacaggtgaaatctgtaagccatgacctggagcaactgcaccggctgctgcaggtggcacggagcctatttcgtaatccgcacctgtgcttggggccctatgtccgctgtctggtgggcagtgtcctctactgtgtcctggagccactggctgcctccatcaaccccctgaatgaccactggactctgcgggatggggctgccctcctgctcagccacatcttctggtagccactgggcctaaacctgcgggtgggattgctgcagagccaagtgggttggggtaaggaaatggggcgaagcctctggctttgagagtctatgagaagatggggaaccttttccctaggagcgtcctagctggtgtgctgtgacacactgggattctgaaaatggattacaaatacgccaaggtattggttcttcagccctcaggtcctaggccagtcacccctggcagccttcttcacttaaccccagcactcccgagtgtgctgtacagatgctattctctttgtgttgtcttgtgccctgttgggtggcaccatgcctcattcccctccctaactgaatggtgctcccacaggactcatggggaccttgtaagtggcctctatcagcatatcctgctatccctgcagaaga

SEQ ID NO: 1063 - DNA, 1178 bp, Homo sapiens
aggtgggaggatctcttgagtccaggagtttgaggctgcagtgaactatgatcatgccacggcactgaacttgggtgacagagtgagaccctgtcccaaaaaaaaaaaaaaaagaaaaaattttaaaagattagaaaagatctcagagctaagcgtagggactgggggtatggggagccagctggctgtcttcaccagggtctcctccctttgttccttccaccctttgcagttgaagtctgagcgggaattggacaagataaaggggctgaagctagaagagctctggctcgatggaaactccctgtgtgacaccttccgagaccagtccacctacatcaggtcagttgtagcctgtgtctcccctcctggggaccttcaccccctgggaggctgagctaatgcatcctgaccagggcccgtctgcggagatgtgcagccctgagctggaaccacctgtcctttgagaggatcgcgtgctccccactttggtctgtctgtgtcttccagctttgtcctgagatgttctctcttctcttctgacttgactatctgtttgctgggtctgtggcctttctctttcttcctgaacacaaccttttctagaatctccctaccctgttgttccaggaaaggcatctcccctttctactctaaccagagggtatcttgtacataccctatagatggggttgccttgtgccaagagcctggtgtccatgggttgaggaagccctccctacctgggacttcctactgagatgggccttccctcctttgtactgtgatggcccctcttgcccttgcgccaagagggacccttttctcaggatccacttgcccagggctgttgctgtccatgctgaggttgaggcctcctaggggctggtggcatgcaatctgtctctcttgcccagtgctatgagctgggctctccctgaagaagaaacctgggttccccaagatgtgaccagagctggggccccgccagcaggcgagggaatcccaaggcaggtgctgggcgtggaggccacgggggcataggctaccaaggagacagagaactgaccccctcgggggcgctgcctctccctcactcacacactgcacgtcaccctgtttggccccggtggatggctggttagccagagacgggtaagattcctcagggaaggaac

SEQ ID NO: 1064 - DNA, 1308 bp, Homo sapiens
ggagagtgagtgtcaccatttcccccgtttaaatggggaggaaacaagagcctaaataccaagcccaggccattaagtcaggaactggagagcagggagcccaacctccttttttggactccaaaacctgtgctttgacaccgcgccgcggcttctcccaagaaaggtcccggagaggggcgccgccacctgcagcactgtcccgccgccccctggaaagccgaaaaacccctaggatgggagactaacgccacaatcggggaaaaggaggccacgcgggcattgaaatcacgactggtgtgtggaccaatcccaggatcctaaaaaagcgaaaggggcgggtttatgcaaaacaaactgagcagggagcaggcggcggaagaagtagaggacgtttaaatagggctgtttccaaaatatagccactactataaagaaagaataatgaaaactgtgtttcggaattataatgtattgggagataatttaacatttagtgcctggatagttaccataactggttggaagatgggaaggataaggccgccgaggcgaccgaagtaaaggtatcgcttctcggccttttggctaagatcaagtgtagtatctgttcttatcagtttaatatctgatacgtcctctatccgaggacaatatattaaatggatttttggaaataggagatggaataggagcttgctccgtccactccacgcatcgacctggtattgcagtacttccaggaacggtgcactctcccttcggggagagaacaaccgttgtttaatggaagatttcgatcagttagggtacaagctaaatagttatgttcttgttgtttgagttggattaggtgtttttatcgctagtgtgttgaatgacgcgtgtttgagtgtcttgttgagagaaggttttgttttataactgagcacggagcgtagtatctccatgtggtcttcagcaatcttcatacttcagcctctggggtagttggaactattgagcgcttgccaccacccccggctaatgttttccatttttatttcttatttattttttttgagacgtcgtcttgctctgtcgcccaggctagagtgcaatggcatgatctcagctcactgcaacatccgcctcccgggttcatgcgattctcctgcatcagcctcccgagtggctgggactacaggcgcccgccaccacgcccagcgaatttttatacttttaatagagacggggtttcaccatgttggccagggtggtctccatctcttgaccttgtgatccgcccgcttcagcctcccaaagtgc

SEQ ID NO: 1065 - DNA, 2410 bp, Homo sapiens
aactggagaacgcagggagtggggggtaaccatgtctgaggaatctttcacccacagctttgtttttctctaggtactactaaccaataacctgcttggctcaaaggtgagtaatttcacggtattcaatgcactcagtatatagggtaggaaaaagtgcctttttaggcctgtgtttgtgatgacttacatggaatctcgttcggctgatgacttgctgttgagactctgaaatctgattttctgagaatgatgggtgggaacaacataatgcgggatatgagaagcactactgacttggtcttcctcctttcagggccagcaccttctctctaaagcccaagaggagtttgaggtaaatggctttgcaatagttaccatcaatggctgctatataaaattttctgtgatttttgtgtgtgatagcactgtggtctgggtgaatgtacacagacataactggcttaacccaaagtctttgatctcctgaaccaccagtgatgaattgctgctcaccagtgatgagttgaataccgccccagtctgatcaatgtgtgactgaaaggtattttctgagctgtgagcctgccttccagtgacatgttctaaaaattgcaagttatttgaggaggctttacagccaataggaagttcttgggctaagtagtgtttcctataaaatgtgccctgaaacttctttctgccaagcaatagatacaattgagagattgtaaaatgtgacatagaatgaaagtctctcaagactacatttttctttcttgattttgcaggaaaactaggtgtctgtgttcactccaggctgaagttacaggtgagtaaacctaaatgtaaggtggactatgctaaaaattcccaatgaagaaactttcacatgtcttactctctgtcctagtcccagagcctgtaaaggtgaacccactgggactggctgggggagaagaggaagatttgttccagaaggaactgtctgagggatgataaagatttctatacagagaaagggagtaatcatcacttgttgaaaacattggttttattttttccaggtctgagcaaataaggtgtataaaaaatggtaggtatctgtttaaatatttaactgattttataatagcaaccttttgctcctaggttacatagtgttaaatattgtgttcatttgtattttccaatccaataagaacttttttttttacctctgcaggaatctgtcttggaggacatcagaaggtgaattttccaagttcttggacaacctagctgttgaaaagctttctgggtttggggggtatttcagatgtaccttaaagtgttagcagacacagattaagacactgggagccaatgaaacagcagttgagggtttgctgtgtatcacatttctgtattttatcacccccttcctgcaacattatttatctggaatctacctgcccttttgttttttagatacaagggcttggttttgttacccaggctggtttcaaggccatagctttaagagatcctctcaccacagatttccaaagtgctgggattgcaggtgtgattcatggcacccagactttgctgcctttcttacatgatccaggcccagaacccaaactcaggcactgtatagatgaccactttcgtaaactactgacctagcttgttgccaattgttgattgaacttcccataactccacttcgtgtctgttcctctgtatacagccaccttctgttcccgtcatgagcctttaggtctccatttgcatattgcaaatactatgttccatgtaggtagctcattcagggccttgctcttcacttcaaaaaaggttcccttgaggactggctgtcaatttgtgttgctgtgttggttgttgatgaaaataataaaatgattgattacatagtcctgtttactttttttgtgtgtatgtgtctcttagcatcagtgtgtaaatttccatgggaaactggctttcctctcatgctccctgaagtacctggaacttgaagggacatctgacagtttgcctgataggcagtgtgttaaatgagtaacctgagtagaacatccatcttttttttttttctcttgcctagtcttagagtacagtgacatgatcacaacctcactgcagcttcaagcttttgggcttaagcaaacctacttgactttaaccagcagctggggctgggactacagacaccacacccagcccaaatctgttttttcctgggggaagcaagggacaatggagtcaagctggagtgcagtagtgccatctcgcctccctgcagcctccacctggattgagtgattgtcctgcctcagccccgagtagctgggattgcagatacctgtcacgaagcaagcctagttattgggattttagtaga

SEQ ID NO: 1066 - DNA, 2410 bp, Homo sapiens; identical to SEQ ID NO: 1065

SEQ ID NO: 1067 - DNA, 2410 bp, Homo sapiens; identical to SEQ ID NO: 1065

SEQ ID NO: 1068 - DNA, 2410 bp, Homo sapiens; identical to SEQ ID NO: 1065

SEQ ID NO: 1069 - DNA, 2410 bp, Homo sapiens; identical to SEQ ID NO: 1065

SEQ ID NO: 1070 - DNA, 1574 bp, Homo sapiens
ccgctcctgccacatgcactgggtgagaaaaccaagccgcaatgcggtcggtgagccagcacgctcccgtaggacgcatgcgcgcctttttcgcgccgcaagttcaggtggcgctttgtctacgccctccttccctggaactctctacccacaactccccggggtcgcatgcggtcaacgtatgcgcgtgcgctcgccgtagccccgcccccaaatcccgtgggcctctgcggcatggtatttaatcgtctccccggggagattcgttctcatttttctactgctcgtggtaagtggcttcgtggtctttatagctgttactcttttgtactttgtctttttcttttattttcttttgagcgattgtgcgaacatagcatagcacgcactatgccttctgtgttgtagctgcctggccagggcgactggcggataaggtcttgtgcgtggcctcgaggcttaaaagtagcagtggggctttgtgaaggacaaaatggcgatggcgggccgtgtaggtcccccttcctatgatgaggaccttttcacagacctgtactgagctccgtgaggataaataactctgaggagatgggccctgcaagcctcttgcttagccgtctgttcagaaaatagcgttttcgaaatgccctgagttgacctaatgtcttattgggctcctgtctgcaggatttacgcgcacgttggaaccgaagagagctctgttgttgcagtaagttcttacggccatttcttaatctctgctctttcgttgagtgtgtggaagttgctacggggatgattttacgaactgaactctctctttctgatggattagtggagaaaacagaaaattctgagtagcactgtactgtacgcaacaaatgtcagggccctattgatttgtctgaggtgttagtgaagggtgttattttttcagatgttcagcccacaagagcttactggtgaaggaatgggacaagacccatctttatgcaaagccagcgttacagtaatgttccaggtaggtgtacatggtttatgctcttacagaggagaccttgtagataaccactccatgatgaacacaaaatgacaagcatatggctgaactttcaagtgatgtcatcttactactgagaagtgagagagaggtcttaaggggtctttgaatgactatttttaggtacataaaatgctttcctctgttgtctacagcatctcataatctatcctggggaattcagctgcctcccagggtgaatacaggtaattatccaaattggtgtatgtcatctttgtaaatgttcaagaaaacaagtggccggcggaacaatgttttttggcgccttccatcttgttcctcttgaaatgattttctggggagggagatcgcaacccggtactacagttcttgtaagggtgtgctgttaccctcatccatatatcgatcacgttactgtcagatgatttgaattgataagctgatgttctgtgaggtacaaaagttaatagcatgttagagttctgatggcagttgttgtttatgaataagcttcattccatcctaatacctt

SEQ ID NO: 1071 - DNA, 1574 bp, Homo sapiens; identical to SEQ ID NO: 1070

SEQ ID NO: 1072 - DNA, 1574 bp, Homo sapiens; identical to SEQ ID NO: 1070

SEQ ID NO: 1073 - DNA, 1574 bp, Homo sapiens; identical to SEQ ID NO: 1070

SEQ ID NO: 1074 - DNA, 1574 bp, Homo sapiens; identical to SEQ ID NO: 1070

SEQ ID NO: 1075 - DNA, 1175 bp, Homo sapiens
gagttctaggccaacgtatttttctcagtacttcaaaggtgttgcccctttgcctttttgctgacattgtttcttttttttttttttgagagggagtctctctgttgctcaggctggagtgcagtggtgcgatctcggctcacttcaacctctgcctcccgggttcaagcaattctcctgtctcagccttctgagtagctgggactacaggcgcgcaccaccacgcctggctaatttttgtatttttagtagagacggggtttcgccatattggtcaggctggtcttgcactcctgacctcaggttattcacctgcctctgtttcccaaagtgctgggattacaagcatgagccactgtgcccagtctgctgacattgtttctgacaagaaatacactgttattcttatttttgttcttttgtacctaatctgtcttttttgtctggttgcttttttctttaaattaaaaaaaattttattttcgtgggtacataggtatatatatttatagggtatgtctggttgcttttaagattttatcactgtttttgagcaaattattatgtgttttgatgtagttctttttttttttttgagacggagtctcactgtgtcgcccaggctggagtgcagtggcgtgatctcggctcactgcaagctccgcctcccgggttcacgccattctcctgcctcagcctcccaaggagctgggactacaggcgcctaccaccacgcccggctaagtttttgtatttttagtagagacggggtttcactgtgttagccaggatggtctcgatctcctgacctcgtgatctgcccgccttggcctcccaaagtgctgggattataggcgtgagccactgcgccaggctgatgtagttcatgttatttgtatgtgggttttgttgagcttcttgaatctgcagatttataatgtttatcaaatttggacattttaaggttattatttcttcaagtttttttggtctgttactccctttggagactcctattacatgtgcctcttgctgcttgaagttgttccacaagatgttcatttaaaattctttggccggcgcggtggcgcacgtctgtaatctcacactttgggaggccgaggtgggtggatcacctgaagtcaggagtttgagactagcctgaccaacatggt

SEQ ID NO: 1076 - DNA, 1221 bp, Homo sapiens
ttgctctgtcacccaggctgcgatcttggctcactgcaacctctgcttcccaggttcaagcgattctcctgcctcagcctcccgagtagctgggattacaggcgtgcaccaccatgcctggctaatttttgtattttttggtagagatggggttttcgtcatgttggccaggctggtctcaaactcctgacctcaggtgatccacccacctcgacctcgcaaagtgctgggattacaggcgtgagccactgtgcccggccaacactgccagattttgagactaaccaggaagttcatctcgggcaggcagggtctgggcctgggcagcgtgtgctgtgtgctcacctgatggggtgtcaccatgtgccaagccaggtatgagggatctcacgacttggtgggctcctgggacatgatcccttctccccatctgataagctcaggaggagcctagaaatatacagggtctttgtctaggggacattaaaagacaggtgtggtggacagaaggcagtggccaaggcttcaggatgccttgtatctagtgtggctcccccactgcatgatggcaggcaggcaggccggccacggaactcccatgtctcaaacaccattatccacagattggcaaaacttgtatcctacctgataggagggaataaataatgctaaaaatctggttctgcaagcacaaatactgcaaatggttttctctcatcctttcaatcctgtgacttgtgtttacatttatgccaatgtgcttttaaaacaacatggctgtgttgctgggtgtttacacttgagaaaacgtatgtaaaagtttgttgtaaaattgtgaagccaaatgcccctttgctgttctatgattaatggcttggccttctagactgtgagctcctgggcagggaccaggttgtattgactttgttttccaagtgtcctgcctggggcctggcacatagtaggtgctcaataaatgtttctcgagtgccctctgagtgtgtattcctgtgtgacatttttctagtgcatgttggtccctggagtgtggttctcagcacagggtggttgctacagtgactgtgcagggtgggaacttcatccccacattgtggccaataggggtctccccagcctcagccagggccctggggactatgtgagtgtgtgtggccagcagctgtgtgtggcacctctgggcttccaggaaagagttggaga

SEQ ID NO: 1077 - DNA, 1206 bp, Homo sapiens
cgcagcaccgggctcagagccagttaatcaagtcccagggagcatggcgcaggcatgtcctcgggcggggggaacccgatggggccgggccacctcggcctgcagtgggggcctacaggtgactccaagagcagaccacagactagggcactccacagcctccagggtgtgcttgctgccgggaggccccgcccccacccagagccaaagcgaactgtgccgctccaagctcccaggtccaggctcgggtcccccactcagccccacatggcgttcaaaggcccctgtttgctgggagcaggtctgggtcccttgggtggggctggatcatgagccccagcttggactcgcagtccagtgcccatcccccacctcacacagccactgcccgcctgaagccaccacgccttcagcaagaagagccctttgaggtgggcatgttgggggtcaagaaaaggagctgtgacaaccagtgctcctgggcccacctgcatctcccccagtccccgggtactctgtgagcctcagtttcctcctctggaaactgggttgatgacttgttgtgtaaggaccagagcctcccagcaaactgaggggggtggtgcagtagagaggggacttagaggctcaagccggtggccaggaactagctgaggtgaaaagggccggccacaggccaagatgttggggtgcacggaggcctgaggagcagggagacctgagaggccctgccctgggctgggcgggctgggtggccacacccagaagcctgtctgttggcattggctggcacagcctccctaggctcttctctgcaagcctccgggccattcccctgcacagcctggcccagctctccggccttggaggcagctttatgggggaaccatgtggcttggtgtcgaggcccaggggccagaacgggggcccagggaaaggaggagctgaggaactgggtcccagccaccaggttggccacctgacccccagagcccccccacccgtgggacgtcaggcacagggggctagagaagggggcacagtagactggcctcccggggcacccactgtgcgtgggtggcctgggaccaggtcctccgtgcatccaagtctgagcccccagcactgggccgcagccactctcctgcctgtggcaaatcccatctcctggcctggcctcccccagctccacccagcaaagtcttc

SEQ ID NO: 1078 - DNA, 1264 bp, Homo sapiens
ccagaagcccctgtggtagacatctgcccttacctacgggcttcaagaggccaggggacatagtggaacccttgtccacccttacctgatgtgtttctcaccatccgtgtcccgcagtgaggccatggggtgaaatcatatgggcagggccagtgggggctcccgaggagtgtcaggaggggatgacctttgcaaaaggttcatccttcgccctgcagcctccagtgcccagggccgagtggtgtggcaggatgctcaggttgtgatcttagtgggcccgaggcacacatgagtccagggctggggctgcgctccagccagcatgaacagatcacttcctccctcctcaggtgccggaagctgcgaaggtgacacatggcttttcagactcagcagggtgacttgcctcagaggctatatcccagtgggggaacaaagaggagcctggtaaaaaacagccaagcccccaagacctcagcccaggcagaagctgctctaggacctgggcctctcagagggctcttctgccatcccttgtctccctgaggccatcatcaaacaggacagagttggaagaggagactgggaggcagcaagaggggtcacataccagctcaggggagaatggagtactgtctcagtttctaaccactctgtgcaagtaagcatcttacaactggctcttcctcccctcactaagaagacccaaacctctgcataatgggatttgggctttggtacaagaactgtgacccccaaccctgataaaagagatggaaggagctgtccctgcctgtgtcactgtttgtcactgtccaggctggctggtttgggcatgaatgtctgcatcactaaatccagagcttgtcttgctccctcattgtgcagatggaggaaatgaggactaaggccccacagcagatcccaggcagggccagaattatgtattcatcactttcaagttattgccacgcatgggagtcagggatagcccagtcaatacagactgcctgccctcctgctcttcaccagggttcttttctagaaggagacagccttctgtggccagagagcttggggtaggacccagatctactgagtgaccttgcttgtcactacccctgcctctctgagcagcagtttccacatgtgcacatagagggaacagaagattgctgtggttggcgtcctcgggccccagagaagtttgagactatctttacgtaatagaaaagaacacttgttcttcctgccaggcagcgct

SEQ ID NO: 1079 - DNA, 1193 bp, Homo sapiens
atcttgccggtgggcggtggctgcccggggttggccgtttgggccggccgggtgccaccgctcacccccagccccggcttcttccgctgggggcgtgggacctgctactcggagagtctagggacccggacagctcctgcccgccttctccactcttcctttcccaggagcccagtccacgtgtcggtccgtgcggaggagcccgttcgctcctcgctggccgagggctggaggacctggacatcggggaccgcagcgtctcctcaccagactccctgtctgcacacgatgtccactcccctgcattctcagatagcccctattctcagatggcctcaatgaggacagaatgaggaagggtccaatgaagactagggtcctggcgtgagcgcaaatcgtcgtcctgagcgcttagaacgcctgggtttgggactggaaggttgcgtttggggagtacggacagctaggccaccccctgccgaatagaccctcccctacccctgcccgggggcggagtaggggagaggggcctgtagaggggctggccctttaagggggtgtggtcggggggcggaggaagagcgagacagagaaagcgcttcggcggctgcagctcgggcggcggccgcgggggacaaagggcgggcggatcggcggggagggggcggggcgcggccaggccaagcccgggggctccgcatgctgcagctgcccccgggcgcccccgccgccgccctcgccgcggagccgcgcggagcggagccggcgagctaacccgagccagccggcgggcgtcccggaggcggtggcgcagggaggggcccgacgctcgcacgtggccccggcggccgccatggcggacagcggcaccgcggggggcgcggcgttggcggccccggcccccgggccgggcagtggcggcccaggaccacgcgtctactttcagagcccccccggggccgcaggagagggcccgggcggggcggacgatgagggcccagtgaggcgccaagggaaggtcaccgtcaagtatgaccgcaaggagctacggaagcgcctcaacctagaggagtggatcctggagcagctcacgcgcctctacgactgccaggtgtgttcccaccccgcgccgacaccccaaaatcggtctcgcgccggtccgcctggcagctccactgtgagctcgcctgtca

SEQ ID NO: 1080 - DNA, 1146 bp, Homo sapiens
gcaaagcccccgacccgtccgcgtgcccctgccccaatccccgctccggctgcagtcgccgccccggccgccagggggagccgacgcggtgggagggggcggggcccgggaggccccgccccgtccccgccccgcccgggccccgccgaggctctggtcggtccgggacagactggcgggcgggcgggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggtaagcgcgcgggcccctgctccgcccaaatcccgggactctttcagtcaagctcgaccagacgctggggacccccaccccagcctcgcctgcccgtggcgccaccctcatcccagtctggcggcgccccggaaacttaagtccccgatcgtctccgtaatgaagactttgtccccccaactcccagtccctcagctctggaaaatttgcctccactccttggcgcagagactttgaaccccaataaaccccgtccccccgttttccattcgttcttcccaccgctccctgccagactaattctcgttccccgatcctggcctggtgcccagacccctgcccagcactagactccccggctgcaggaccctgacttccaggctggctgggggcatcctcattctgggtgtgtgccagggcgcccctactctccccggtgccctgcctgaacagtcctcgtccattcatcatttttccccctgttctggttggcaccccttcgccctgcttctggatcccagcccagctccctgttcagatgggagcacccagtcaccccctagtggagactttgccccccaagttcctccacccctgggaactttgctccccactccttaggcttgggaccttgaaccccaatacatcctggcccccctttccctgtcctgcccctggtgcttcccaaatgcctgtgtccccaccttcggctgcccatccccatcctgggtgcatcctcttctgccccctgggccctt

SEQ ID NO: 1081 - DNA, 1154 bp, Homo sapiens
aaagtgttgcaaaatacacattaaatcacttttaattagctatttcgcttcttgcttttattaacagttattacaggaaatggaatcatctcagaaaatctggggggaaggttgctgtaacatggggtgccaaattggagtcccagggagaagactaggggaaggggggtggggaccagtttgaaaaaaggaatgctggtctggggtgtttaggcctgcaaggagtggggagccatggagggtgttgagcagccactttaggaagattagtttggactaagtcttgctaatgaggacttcagtcagggggcgaagaggtgctttatgatacgccccacagacaccattctggtaccttgacactgctgcttggggaagagtctctctgacttcctctcacctagggcaagcactctcaaaatagtccctgcccatgggacctgcatgctggcgagagggggagacacccaaatagggacattacattcatttaataatatgtattggctggtccgaatacagtagtgtttacaactaattgatcacaaccagttacagatttcttggtcccttctccactcccactgcttcacttgactagccttaaaataataataatacttattgagaggtgctcaatcaatatgatttacactgcagcacagggtttggcttgggcttcctcaggggtgggatgtgtgtgtttttgtgtgtgcatataaacctcctaaaaattgggagcaaaattttgtggcatataaaccttcctggagagaaagtccctagctttcttgagattttctaaggaaagggactcaaattcagcttccataggtgcaatgggagtggtggggttggaaagctggaaacacagggtgtggtcactgcttgggaacttactcaacagtcagtgcttactttgttgcacgttcacaaaaaatctgggaggcagatgctgtcactatccttcccacttgagacatgcagaagctgaggccagagagttcacttgctcaagtcccatagcaccaacatttgaacccaggcagtctggtcccagggtctgtgctcctgaccatggtaaaagtggaaatttgttgtctgaagttaggggccagatactgaaaatgtttctcaaacattgtagaagtcaa

SEQ ID NO: 1082 - DNA, 1126 bp, Homo sapiens
agtatgaagccggccgggctggccccggagggggtgctgagcggcggcgggcgggcaggctgctgctcacgctaccgctcctccgccagacagcgggcaaagtgctggcccatttctatggggtgaagctggagggcaaggtgcccatgcacaagctgttcttggagatgctcgaggccatgatggactgaggcaaggggtgggactggtgggggttctggcaggacctgcctagcatggggtcagccccaagggctggggcggagctggggtctgggcagtgccacagcctgctggcagggccagggcaatgccatcagcccctgggaacaggccccacgccctctcctccccctcctagggggtgtcagaagctgggaacgtgtgtccaggctctgggcacagtgctgccccttgcaagccataacgtgcccccagagtgtagggggccttgcggaagccatagggggctgcacgggatgcgtgggaggcagaaacctatctcagggagggaaggggatggaggccagagtctcccagtgggtgatgcttttgctgctgcttaatcctaccccctcttcaaagcagagtgggacttggagagcaaaggcccatgcccccttcgctcctcctctcatcatttgcattgggcattagtgtccccccttgaagcaataactccaagcagactccagcccctggacccctggggtggccagggcttccccatcagctcccaacgagcctcctcagggggtaggagagcactgcctctatgccctgcagagcaataacactatatttatttttgggtttggccagggaggcgcagggacatggggcaagccagggcccagagcccttgactgtacagagactctattttaatgtatatttgctgcaaagagaaaccgcttttggttttaaacctttaatgagaaaaaaatatataataccgagctcaaaaacactgtgtttggtgtcattgggtcaagggttggggatacacacggcagaattcggaaacagggtatagatcaacaaaaatacacagtcataacaagaaaaactggcgcctggcacaatcaactctcagtttcctcttcactcagcagcatgttgggga

SEQ ID NO: 1083 - DNA, 1214 bp, Homo sapiens
tccagtgcttgcctaaactcctccgccctgcaggccaccgaggtccgtatctgccctgtggaattcaaccccaacttcgtggcgcgtatgatacctaaagtggagtggtcggcgttcctggaggcggccgataacgtgaggatccttaccccgccccagcatatcccggggaatgcggggcgggcacacctcagccgggctgaggcgggagttcgggatgcccggagataattttggcctcttgcccacagttgcgtctgatccaggtgccgaaagggccggttgagggatatgaggagaatgaggagtttctgaggaccatgcaccacctgctgctggaggtgagaagcggcccatcacttgcttcccgggccacctgcctcccgcactgaggctgccagtgctcagctctgtccctccctgcccgcaggtggaagtgatagagggcaccctgcagtgcccggaatctggacgtatgttccccatcagccgcgggatccccaacatgctgctgagtgaagaggaaactgagagttgattgtgccaggcgccagtttttcttgttatgactgtgtatttttgttgatctataccctgtttccgaattctgccgtgtgtatccccaacccttgacccaatgacaccaaacacagtgtttttgagctcggtattatatatttttttctcattaaaggtttaaaaccaaaagcggtttctctttgcagcaaatatacattaaaatagagtctctgtacagtcaagggctctgggccctggcttgccccatgtccctgcgcctccctggccaaacccaaaaataaatatagtgttattgctctgcagggcatagaggcagtgctctcctaccccctgaggaggctcgttgggagctgatggggaagccctggccaccccaggggtccaggggctggagtctgcttggagttattgcttcaaggggggacactaatgcccaatgcaaatgatgagaggaggagcgaagggggcatgggcctttgctctccaagtcccactctgctttgaagagggggtaggattaagcagcagcaaaagcatcacccactgggagactctggcctccatccccttccctccctgagataggtttctgcctcccacgcatcccgtgcagccccctatggcttccgcaaggccccctacactctgggggcacgttatggcttgcaaggggc

SEQ ID NO: 1084 - DNA, 1199 bp, Homo sapiens
ctcctccgcctcccatggacccttctaactttgtcaccatgatgggcatgggggtggcgggcatgccgcccttcgggatgcctccagctcccccaccgcctccaccacagaactagacttgttttttaagaaaatatatattatatatagagagaattggtctcgtttaaacacgccgaacctcaccatatggagccagacattgggacgcacgcatgtgattgtgtgtgcacgcatgtgtgtgtgtgcacgcactgggctgggccaagcgactgaggattcgcttgggaacgggcaggtggtagtaggggcgccagcttgggctctcctggcgccccgtagcatcgagtgtcttctttgtcttctttctctcctcacccaactccctttgcctctccccaaaccgggccgccaggatccctccccgcggcggcgatggcccgagccatgagagtgaggactttccgcgcccattggtgacccttccaggcagacagcctcagcaacgcccctggtggacaggatggttcggcaaagcagcctgagttatttttgtggacggaatcggaacacgctggctccatatcgtgaaatttttattaatttttttctttttcctttgttacttctttatcttttcctttcttcagactccgtccaaggagatgctctccccggtcttctgctgcaatttagattcctttcccttctctccagttctccttcccttaccaaggagaggggagcaaatggttttgggcaagggctttggccattcatgtcaagctggttgtgggtttttcaaggtgccatagccacccccaaagatgtttgtttaaagcgtggggttttttaatctctgccacccttgtcaagggagtcttgtaaagttgccgagggtaggttcatctccaggtttcgggattcccatccgtcctggcgatcctgccagcagtgggtgggcagcctgagctccctcgggctcgcctgccagcctggagttcttcctgtgctccttgatcacctgagctgcctcagattccatttggtcctctccttcctggaaggcttccttttatgttttgttttaatcccaaatgtctgaatgttttgcagtgtgtaggggtttgagccccttgttcattctccttcctttttcctcccgcttccctctccatgaagtgattctgttgacaata

SEQ ID NO: 1085 - DNA, 1178 bp, Homo sapiens
attgttccctccccccagccttgtccccttcatactgtagtagcccaagccacccaagggactccattttcttgggccacacccctttcttcccatcaccacccacataggaagggaagacagaagagccccttttcctggctgtcattccctgaagcaggcacagggtgggccatcatgagacataatgatctcatccccccctaagagctggctgtacctgaaaggatcatacatgcgctgtgaccgcaagatggaggtggcgttcatggtgtgtgccatcaacccttccattgacctgcacaccgactcgctggagcttctgcagctgcagcaggtgagggctgagccaatggggcaggactgggctaggccagacttgacttgctgtgggaccctgggcaggggcactttcccttcctgagcttcagcttcccctcctggaaaaatgggttagtaattcctggcctggcctttcccagggctcttgggagagtagaattgagatgtgaaattgctttgactccattaaagggctggtcccagaattttggcccttccacatggtgggtggtccctgttggttctgacccccacctctgcccgataggctaaggacccgttctcctccctgttccgtggctcataactctctccttcggctcctagaagctgctctggctgctctatgacctgggacatctggaaaggtcagtagagggaagtggccaggctgcgcctggtgaggccggggggctgggtggcagcctgaattatgatcctttcctaggtaccccatggccttagggaacctggcagatctagaggagctggagcccacccctggccggccagacccactcaccctctaccacaaggtgggggcatctaaggagggtgcagaagggagaccctaacagtggctgaggcaggggccctcatctgggcagatgagaagagaactttgtgtgttggggggtatcgcccatccagtctcactttgtgtcaactgtgtgcagaatcagttcagtcagggctgtctgaggggtgtccagggttccccagcctgggagtggcaggggctgcatttgtcccctcagccctgccttttctgccactgcttactgtccttcctggagtataacagaggtcaaatgtggcaggagcactgatgaaga

SEQ ID NO: 1086 - DNA, 1154 bp, Homo sapiens
agtggtgtgctccaaactcaccgaggtccccagggtttgtgcaaagccctgggccccagacatgactctccctggaatctccccaccacccgagaaacagaaacgtaagaagaagaaaatgccagagatcttggtgagtgagaggcaggggtttttctctgccgtgtgctctgggagacgtgcagggctggggctctggctcttttgggggataggcagcacctgcagggtgtgggtgagatgctccagccaccatgttcccttctcactcacctgctcctcatttctcttccctcagaaaacggagctggatgagtgggctgcggccatgaatgccgagtttgaagctgctgagcagtttgatctcctggttgaatgagatgcagtggggggtgcacctggccagactctccctcctgtcctgtacatagccacctccctgtggagaggacacttagggtcccctcccctggtcttgttacctgtgtgtgtgctggtgctgcgcatgaggactgtctgcctttgagggcttgggcagcagcggcagccatcttggttttaggaaatggggccgcctggcccagccactcactggtgtcctgtctcttgtcgtcctgtccttcctatctccccaaagtaccatagccagtttccagatgggccacagactggggaggagaatcagtggcccagccagaagttaaagggctgagggttgaggtgagaggcacctctgctcttgttgggaggggtggctgcttggaaataggcccaggggctctgccagcctcggcctctccctcctgagttgccttctgttggtggctttcttcttgaacccacctgtgtaaagaggttttcagttccgtgggtttcccctttgattctgtaaatagtcccagagagaattcgtgggctgagggcaattctgtcttggaggaagaagctggacattcagcctgtggagtctgagttttgaaggatgtagggagccttagttgggtctcagaccataagtgtgtactacacagaagctgtgttttctagttctggtctgctgttgagatgtttggtaaatgccaggttgatagggcgctggctgcttggagcaaagggtgcatttcagggtgtggccaccaggtgctgtgagtttc

SEQ ID NO: 1087 - DNA, 1150 bp, Homo sapiens
gcaggtgcaagtggactgccactttctgcagctctacctgtggcgttttgtggccgacgaagaactcgtgcacttgctgctggacgaagtggtggcctctgctgccctgcgctgcccagaccctgtgcccatggagcccagtgtggttgaggtcatctgcgagcgcggctaggcgcagccgctgccatgcaccggtctgtccctgcaccccatggcacccaggatctggtctcggtggtccttccccgcaggcaggtgtcaggaccggcctaataaacatgtgtggcctcctcctctcgcttgctgggcgggcctttccgggggcggggttttgaagctgaggcttctgaggcgcccgcgtcgggtccgcccccgagcgccgattggctggtgtgctgggcccagcatgggcagggggcggttccacttaaaaaccctgggacgagagcggtccttgtctgcgttccgtgtccaggcaggtgcaggcgccgcggggccggatcctccgcgcggccgagtccatctcctgggaaatggggcggacagtgtttccttgactgactattgtgagcgccctctctctccggcggagcggagaccatggcccccactcagggcccccgggccccgctggaattcggagggcccctgggtaatggggcagagagatgggacctggggcaaaggctaagcgaaggagagctggagcgggtgaactaagagcgggggcgagatctgaggatggaaggctttgggggtgtcggaggcagagggacccgggggtttgcagcgaagggtgtctggagagggagagctgaggaggggccggttctgggggctgcagaacggggatttatggtgtcgactgggagcaggaggagggtcttcgaggggcctgggggcgggggactaagatggacgcctgggaagggaactgggaggcagcggggtgcctgggggccgagggctgaggacggggtgcggaggcgcactctgggaatgccgagagggtcccgcagagacgtcagggcgcccgtgcgggccggcggggagctggggggctaggggcggacgcccgacgtgatggcccttcccgcaggcgccgcggctctgctactgctgctgcccgccaccatgttccacctgctcc

SEQ ID NO: 1088 - DNA, 1150 bp, Homo sapiens; identical to SEQ ID NO: 1087

SEQ ID NO: 1089 - DNA, 1099 bp, Homo sapiens
gaatgggctcggcgagggaaaggacgccccgggccttatcagagcccccttggacccgcaggtggccgaggggcaggaattgaaggacaagagtcgcctgcgctatcctattaacggtgcctaggggacgggccctcgcgctggagttaagcggccgggggtggagctccaggcctagcggggaggtccacggagattggcccccaccccaggctcctttgtgtgcctctgttacgcccaggacagacgccgggggctctccctatgcccctcgtccccacagccttaccccatttactgctactccgtgcaccacagcagtggctggggtgatcctctgaaggccagggtggcagcctaatgcttggggcagggtctgtggcccccctgagttttgggctctgcgtgtgtttgcggggtggggatgtggaggcgcgcagccccagggctcactgtgcgctgtggttcaggcttccaggccctggtgctgacagccctgttggtggggctggggatgtcagcggggctgcctctgggggcgctcccggaaatgctcctgcccttggcgtttgtcgccaccctcaccgctttcatcttcagcctctttctctacatgaaggcgcaggtagccccagtttcggccctggcacctggggggaactcaggtgagaggggtcctggggtggagacggaggcagattggggcgtctgcctgtacattcactctccaatattctccaggcaatccgatttacgacttttttctgggacgagagctcaaccctcgtatctgtttcttcgacttcaaatatttctgtgaactgcgacccggcctcatcggctgggtatgttgggcttgactgagctggcctcaggccagggggagggttagggtgggtgagcagcgcttgggcagggcagggccaaaactgtgcagatgcgagtcattaaccattcatattccacaaacatttgttcaatccacctgtgcctaggtactgggagacaaaaataaagttagaggcaaaaaagcatctttgctgcagagagcctacattctggtgggaaagacagaaaaaaataagtaaaatatatacag

SEQ ID NO: 1090 - DNA, 1280 bp, Homo sapiens
ctggtgtcccagccccacctccagaattgagacctgcctcctacctcactttgggtcccatacatagttgcttctaacaacttcaccaagaaaactctcttttctacttcttgggaggggtgagtgagagaaagtgggacaaggccacttttctgcagtgttagttactccagaaaaggtccaccatgtggaaacagatataatgagaaataatccttagtttgtgttaatcaaacccagtcagttatccaaccagtcaattcctcaatccaagcagcatgaaactgcactcctagttaggtttgtggattataaatgctcataaattccttatcccgtccctcatggaaaggtggggtttacttctccacccccttaattctggacttggcctatgacttgctttgaaccagtagaatatggtggaaatgaagctgtgcccaattctgggcttaccctttaaaacagaactggcagcttctgttttcttctcttggaattcagccaccatgctgtgaggaagcccaagcagtcctgtggggaggcccatgtagaggagaatcaaagctccattctcagccttttgggtaagatcaagtgtagtatctgttcttatcagtttaatatctgatatgtcctctattcgaggacacaatctatattaaatagatttttggaactaagagatggaataggagcttgccccacccactccacacatttacctagcattgcagtacctccaggaacagtgtacccctaaagggagataaagtttaaaaatgaaaaaaatagggaataaaaagctctagccctaccatccaattggctgggggaatttaaataaataaataaataaataaataaataaataaataaatagctctagccagcatcaacttgccagccattggagtgcaccatctttgaagggtcctccagctccaaggatggagctggaggcacaagaagagctgtctcaaccaggccttgcccaaattgcataatggtaagaaaataaatgattggtattgtcataagcctctaggtttgagagtggcttgtttcacagccctaatctaatttgactccctgttcttggccccagacccagggcctgccacagaataagaactcagggagtgttgaagaagtgagtcaacaaatgattgggctgagcgtggtggctcacgcctgtaatcccagcactttgggaggccgaggcaggtggatcatctgagtgaggtcaggagttcaagaccagcctggccaacaggatg

SEQ ID NO: 1091 - DNA, 1360 bp, Homo sapiens
catggttggggaagagttccaggcgatcgaattttcttatctggccagtgttccctgtcctttcctggaaatgagcctgggcctcagagccaaccctgaagcccgggccacctgaatcctgaaaggctggggtgggggtgtctggattctgggaaaggagcaggaggggaggtccaggcccttggaggcccctatgggagcagcactctggtttcccaggggtggaggaggtaagaaagtaacccctccatgaggttcctgaggtggctcctgagacgtggagttgggggctggacctggggtttgggtggggaagaagccagggagccatttctgcggccccagctgacctgcctgttctcccgcagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtgatgtgtttctccccagcctactgcctggagggcacctgcaggccccggcccatgggggcagctcgtggcctcagctcacccctcccctccaacccctccatctccttccccttgaccttgaagcttgaacccctactggagtactgggtatctgggcaagaccacccctggccctgggaggttgggaaggaggggccctagctgcagggacagggccacacagctgaggtcccacatggctctgct

SEQ ID NO: 1092 - DNA, 1205 bp, Homo sapiens
accggcagagttcacaaacacatttgaagaggctttttctcaggattcttaaccttcccaaaggaagtcccatggatgggtttctagaagtctataaatgctctgaaattgtatttttctgtggaaagcataactttcatctgcttgttcgtgctcaaaaaagatcatgaatgaatgattgcatgattttatgccattgtgcttatactaaaggatatgtagcccatctcttgagctgttaaactgttttgactactttaaatcgtgcagctgtgagcatctctgtaaatttagtgtacacatgtatcccctggagtggcattgcctcggcagtgagcacttatggttttataactctcttcacagactcaaatgactccagaaagctacacttcctgttgtgagtatatgatatccatttccctacatagccactaacatcaggtttttacaattttatttatttcttgctactttaagaaatttttgtggtgaaatacatataatagaagttgactatctgaatcatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcgagatgcgtctatgttgtagcatatgtcagaatttccttcctttttaaaagatccaaataatattcttattttatatcttttttttatccattcatccattagtggacacttgggttgcttttggctattgtaaataatggtgctatgtacaaatatctatattattgtatttacaagtataatgctgtaatgtacacacatctttttgagatcctaccttcagttcttttgagtatatagccagaagtggtattactaaatcttacgatatttctatttttaatttattgaggaaccactgtagtttttcatagcaactgcaccattttacgttctcaccaagagtgcacaagggttccgaggttcccacatcctccccaacacttgttattttctgctttttttagattgcagccatcatagt

SEQ ID NO: 1093 - DNA, 1228 bp, Homo sapiens
ccaagaagtgaaattcctgggtcatagggcgtgagtccgacatttttctccattctgccctgttgccctccagagtgggtgtccagctttgcatacctaagtatgagagtatctgttgttcatatcctctacgacgctccatatatgaaacttaagtttctgctagttgccatctttgatctatcatgtatgcagtgacctactaagactgtaattggtacagtagattcttgtcatctgtgtgtgaatttagcattcatgggcttaatgctgacaaggcccccagggtccaagacatataatcatgtataattttgtcaaggtataattttttaaattgcttttgtcatgtgtctgctggtgatgcccaacccagtgctctgcacccaggtcacactgtggctttgtcctctgcttatgcctgcattgcagcaactgtcctgaagagaccaaaattatgcagatttaggtaagtccatggctaatgttattatattatgtgctattgtaatggatggggctgtggagtgtatgaatttataaatcactggtcttgtaattaaaattcaaacactatagaaaaaggccatgtagaagataaaagttcctctataatcccggacccctaagataactactaatgacaacttcatttatattccttcagacattttctggctgtggatgtactaaaatgtatcctattattctctgccctaaaatggaatcatacaaggtgtactgttatttttatggctctataacatgtcatattgtacgtgttggtatggtcattttaaccatttttctagtgatggctttgaggttatttgcagtttcctagccatctcaaagtgtgctgcggggatctcttttgcatccctctgggtgcagagctgaggcacccagaggcagtgtccagaggaggcagcatctgtaggtgtcttcacctgctctggctcttggcacatctggttggtgacactgttttgtgagatgggttgaaagcacgtgctgccaaaatagaataatgttggtcctctcctcatgtgccgtggaactggggtaaaactgcgtagtggctgcagctgcctgtccataccggaatcgagtataacacggtgcctggcttagcacaaaacagtagtgggtcctgcaggccccagagtctaattcctggtattctttcccctacacagattaaataaaccaaaaacaaactattcta

SEQ ID NO: 1094 - DNA, 1144 bp, Homo sapiens
ctgccactgtgtggctagctcttcccactgggaagttctgtgtacccggaatgtcggagtggagtcctgttctagtgtccagcacctgaccctgtgcccaacccctcaacagcctattcctgctgtccacagcctgctggaactttttacaaaatatgttgccatgctggaccctgggcactggacataagccccctggcagcctttttcatgtcacccaaaggggtaattgtcctactggtggtctgtaagatgagttagggtgacttgctaatagacattgtaaatcttaatatttatgtatgtattttattattaccggttttccatttatgatggtaatattgtttcttctaagaatatttatttttccttctaaatattgagataaaattcatgcttttgaaatgttctattcagtggcttttagtatatttgctatgttgtgcaaccatcgacactatccatttctagaactttttcgtcatcccaaacagacgctctgtattcataaaaaaataacttcctacctgtctctccccctagtctttggtaacctttgttatactggtaaactttgttgtgctctctgtctgtgtgaatttgcctattctaggggcctcatataagtgtaatcatacagtatttgtctttttgggtctgtctgatttcacttagcgggttttcagggttcattcatgttgcagcatataacagtactgcgttcctttttctggctgaataatattccactgtatggatagaccccattttgtttattcacacatcatttggacatttggattatttctggtttttggctattatgaacaatggtgctatgaacagttgcgtacaagtttttgtgtgaacatatgttttcaattctctcattatatacctaggagtagaattactgggtcatatggtaactgtatatttttgaggaactgccaaactattttcccacgtccatgcaccatttcacattcccaccagtaagtaagagggttccaatttctgcgcattcttgccaacactagttattatctgactttctggttataatcattctaatgagtgtgaagtagcctctggtgtcatttggatttgcatttctctgatgagtgatgctatcaagcac

SEQ ID NO: 1095 - DNA, 2199 bp, Homo sapiens
ttacgaattctacagtcacaaatatctttgggcaaatccccttctatacctcaaggcagcttttggtttgcaaccccactggccagagggaagggccagtcacttggctctctcactgccctgcgccccagatggttctagggctgctgttttcccttggccctgccaacaccactgtttttacttctgctcattggctgagtgcagtggttcctggaagccagtggcacgtttccccgcgtagctcgcttatcccacagcacacacccaagggttctgttgctaacacgctgaattaattctttgctcatcttacagagtgtgttttgactgcccccatttctgaggccttgtaaggccagagctttgttgcttcatcggcaggttgggacttagatggccgtgaatgtttcctctctgctgctgcagtaagtaagtgcccgcaccatagtgtgtttggaggctgaagttgaagcgaggctgtgaggggagatggacgtgtgaggagggatgatggggcttgagcaaagtgggggagggggcaaaggcagttggcccaacacattccccacccctttgagaggtctgaggcctgcagacctggctcggagcccacctggtagtcctcagactgtgtgtgtgtgtgtgtgtgtgtgtgtgtgtgtgtgtgtgtgtgtgtgtgtgtgtgtgtaaaagagagaagttgtggagaaatggggggctgattctgctcagattcatcaggatgagtagaaggcacccagctctcaccctggcctgacatgtgtgtccctgagcaggttacagtcctctctgagcctctgcttcccatctggaccctgctgggcagggcttctgagctccttagcactagcaggaggggctccaggggccctccctccatggcagccaggacaggactctcaaatgaggacagcagagctcgtggggggctcccacggacccgccgtgggcccaggggaggcagagcctgagccaacagcagtggtgctgtggaccgtggatcctgagggtggcctggggcaagtaccggctgagggtccaggtgggctttgtgtacctttgggtcctggggccctggtgacttggactccaggttagagtcaagtgacaggagaaaggctggtggggccctgtgcttccgacttcatttcgagtgatggcagttcccaggaaggaatccacagctgacggtggctgacagatcagagaatggaaggcgaggcaggcgggcgtctgcgtgacctcaggtgcttggggcccagcagacccagagaaccatttccactaggccagggtgccggaagtgtccacaggtcttagattccctgttcagatgaaaagatttgtgcctttaatgataaaagtgatctgcatagagtcaaaaattcaagccatgggtataaaatgcaagtaaaatccctgccctcacctatcccaccctactacacagagatgtcctctcgagtttcctagactcactctggaaatttctgtatacacacagaagcttgtgcctctgctcgtgaaggcagagggagggagagctgaagggccagcaccttctcacctgtgggccccctcagtgctcggtcccagagcatgcaggactgtgcctcgtgttcagtttgctggtctgacttcatgctccttgggcaggatatgcatgtgccatgctaggagacatgtggatgtgaagctgggggacaatgtcccctggctatgcctttacaagggaagtaaggaaggtaggaggtgagcctgggagggagggagggaggcgcggagccgccgcaggtgtttcttttactgagtgcagcccatggccgcactcaggttttgcttttcaccttcccatctgtgaaagagtgagcaggaaaaagcaaaaggcgctggtggtggcacgtccagcacggctgggccggggttcgagtccccgcagtgttgctgcttccttccagctccctcctccaggcctctcctcccaccccaccagggatatcttgtctcctagaggggtagcattgggtggggcaccccaggcctctcccagaagccctcctgccctgctatcccctccctcatcctctggggccctgggaatacagcaggggacgtggggccacaggcagctgataacttagccccctcagccactcctgtgggagcgggaggggg

SEQ ID NO: 1096 - DNA, 5405 bp, Homo sapiens
gagtggtaggatgaaacaatttggagaagatagaagtttgaagtggaaaactggaagacagaagtacgggaaggcgaagaaaagaatagagaagatagggaaattagaagataaaaacatacttttagaagaaaaaagataaatttaaacctgaaaagtaggaagcagaagaaaaaagacaagctaggaaacaaaaagctaagggcaaaatgtacaaacttagaagaaaattggaagatagaaacaagatagaaaatgaaaatattgtcaagagtttcagatagaaaatgaaaaacaagctaagacaagtattggagaagtatagaagatagaaaaatataaagccaaaaattggataaaatagcactgaaaaaatgaggaaattattggtaaccaatttattttaaaagcccatcaatttaatttctggtggtgcagaagttagaaggtaaagcttgagaagatgagggtgtttacgtagaccagaaccaatttagaagaatacttgaagctagaaggggaagttggttaaaaatcacatcaaaaagctactaaaaggactggtgtaatttaaaaaaaactaaggcagaaggcttttggaagagttagaagaatttggaaggccttaaatatagtagcttagtttgaaaaatgtgaaggactttcgtaacggaagtaattcaagatcaagagtaattaccaacttaatgtttttgcattggactttgagttaagattattttttaaatcctgaggactagcattaattgacagctgacccaggtgctacacagaagtggattcagtgaatctaggaagacagcagcagacaggattccaggaaccagtgtttgatgaagctaggactgaggagcaagcgagcaagcagcagttcgtggtgaagataggaaaagagtccaggagccagtgcgatttggtgaaggaagctaggaagaaggaaggagcgctaacgatttggtggtgaagctaggaaaaaggattccaggaaggagcgagtgcaatttggtgatgaaggtagcaggcggcttggcttggcaaccacacggaggaggcgagcaggcgttgtgcgtagaggatcctagaccagcatgccagtgtgccaaggccacagggaaagcgagtggttggtaaaaatccgtgaggtcggcaatatgttgtttttctggaacttacttatggtaaccttttatttattttctaatataatgggggagtttcgtactgaggtgtaaagggatttatatggggacgtaggccgatttccgggtgttgtaggtttctctttttcaggcttatactcatgaatcttgtctgaagcttttgagggcagactgccaagtcctggagaaatagtagatggcaagtttgtgggttttttttttttacacgaatttgaggaaaaccaaatgaatttgatagccaaattgagacaatttcagcaaatctgtaagcagtttgtatgtttagttggggtaatgaagtatttcagttttgtgaatagatgacctgtttttacttcctcaccctgaattcgttttgtaaatgtagagtttggatgtgtaactgaggcgggggggagttttcagtatttttttttgtgggggtgggggcaaaatatgttttcagttctttttcccttaggtctgtctagaatcctaaaggcaaatgactcaaggtgtaacagaaaacaagaaaatccaatatcaggataatcagaccaccacaggtttacagtttatagaaactagagcagttctcacgttgaggtctgtggaagagatgtccattggagaaatggctggtagttactcttttttccccccacccccttaatcagactttaaaagtgcttaaccccttaaacttgttattttttacttgaagcattttgggatggtcttaacagggaagagagagggtgggggagaaaatgtttttttctaagattttccacagatgctatagtactattgacaaactgggttagagaaggagtgtaccgctgtgctgttggcacgaacaccttcagggactggagctgcttttatccttggaagagtattcccagttgaagctgaaaagtacagcacagtgcagctttggttcatattcagtcatctcaggagaacttcagaagagcttgagtaggccaaatgttgaagttaagttttccaataatgtgacttcttaaaagttttattaaaggggaggggcaaatattggcaattagttggcagtggcctgttacggttgggattggtggggtgggtttaggtaattgtttagtttatgattgcagataaactcatgccagagaacttaaagtcttagaatggaaaaagtaaagaaatatcaacttccaagttggcaagtaactcccaatgatttagtttttttccccccagtttgaattgggaagctgggggaagttaaatatgagccactgggtgtaccagtgcattaatttgggcaaggaaagtgtcataatttgatactgtatctgttttccttcaaagtatagagcttttggggaaggaaagtattgaactgggggttggtctggcctactgggctgacattaactacaattatgggaaatgcaaaagttgtttggatatggtagtgtgtggttctcttttggaatttttttcaggtgatttaataataatttaaaactactatagaaactgcagagcaaaggaagtggcttaatgatcctgaagggatttcttctgatggtagcttttgtattatcaagtaagattctattttcagttgtgtgtaagcaagtttttttttagtgtaggagaaatacttttccattgtttaactgcaaaacaagatgttaaggtatgcttcaaaaattttgtaaattgtttattttaaacttatctgtttgtaaattgtaactgattaagaattgtgatagttcagcttgaatgtctcttagagggtgggcttttgttgatgagggaggggaaactttttttttttctatagacttttttcagataacatcttctgagtcataaccagcctggcagtatgatggcctagatgcagagaaaacagctccttggtgaattgataagtaaaggcagaaaagattatatgtcatacctccattggggaataagcataaccctgagattcttactactgatgagaacattatctgcatatgccaaaaaattttaagcaaatgaaagctaccaatttaaagttacggaatctaccattttaaagttaattgcttgtcaagctataaccacaaaaataatgaattgatgagaaatacaatgaagaggcaatgtccatctcaaaatactgcttttacaaaagcagaataaaagcgaaaagaaatgaaaatgttacactacattaatcctggaataaaagaagccgaaataaatgagagatgagttgggatcaagtggattgaggaggctgtgctgtgtgccaatgtttcgtttgcctcagacaggtatctcttcgttatcagaagagttgcttcatttcatctgggagcagaaaacagcaggcagctgttaacagataagtttaacttgcatctgcagtattgcatgttagggataagtgcttatttttaagagctgtggagttcttaaatatcaaccatggcactttctcctgaccccttccctaggggatttcaggattgagaaatttttccatcgagcctttttaaaattgtaggacttgttcctgtgggcttcagtgatgggatagtacacttcactcagaggcatttgcatctttaaataatttcttaaaagcctctaaagtgatcagtgccttgatgccaactaaggaaatttgtttagcattgaatctctgaaggctctatgaaaggaatagcatgatgtgctgttagaatcagatgttactgctaaaatttacatgttgtgatgtaaattgtgtagaaaaccattaaatcattcaaaataataaactatttttattagagaatgtatacttttagaaagctgtctccttatttaaataaaatagtgtttgtctgtagttcagtgttggggcaatcttgggggggattcttctctaatctttcagaaactttgtctgcgaacactctttaatggaccagatcaggatttgagcggaagaacgaatgtaactttaaggcaggaaagacaaattttattcttcataaagtgatgagcatataataattccaggcacatggcaatagaggccctctaaataaggaataaataacctcttagacaggtgggagattatgatcagagtaaaaggtaattacacattttatttccagaaagtcaggggtctataaattgacagtgattagagtaatactttttcacatttccaaagtttgcatgttaactttaaatgcttacaatcttagagtggtaggcaatgttttacactattgaccttatatagggaagggagggggtgcctgtggggttttaaagaattttcctttgcagaggcatttcatccttcatgaagccattcaggattttgaattgcatatgagtgcttggctcttccttctgttctagtgagtgtatgagaccttgcagtgagtttatcagcatactcaaaatttttttcctggaatttggagggatgggaggagggggtggggcttacttgttgtagctttttttttttttacagacttcacagagaatgcagttgtcttgacttcaggtctgtctgttctgttggcaagtaaatgcagtactgttctgatcccgctgctattagaatgcattgtgaaacgactggagtatgattaaaagttgtgttccccaatgcttggagtagtgattgttgaaggaaaaaatccagctgagtgataaaggctgagtgttgaggaaatttctgcagttttaagcagtcgtatttgtgattgaagctgagtacattttgctggtgtatttttaggtaaaatgctttttgttcatttctggtggtgggaggggactgaagcctttagtcttttccagatgcaaccttaaaatcagtgacaagaaacattccaaacaagcaacagtcttcaagaaattaaactggcaagtggaaatgtttaaacagttcagtgatctttagtgcattgtttatgtgtgggtttctctctcccctcccttggtcttaattcttacatgcaggaacactcagcagacacacgtatgcgaagggccagagaagccagacccagtaagaaaaaatagcctatttactttaaataaaccaaacattccattttaaatgtggggattgggaaccactagttctttcagatggtattcttcagactatagaaggagcttccagttgaattcaccagtggacaaaatgaggaaaacagg

SEQ ID NO: 1097 - DNA, 1289 bp, Homo sapiens
aaggcaccgaaggcttaaagtaggacaaccatggagccttcctgtggcaggagagacaacaaagcgctattatcctaaggtcaagagaagtgtcagcctcacctgatttttattagtaatgaggacttgcctcaactccctctttctggagtgaagcatccgaaggaatgcttgaagtacccctgggcttctcttaacatttaagcaagctgtttttatagcagctcttaataataaagcccaaatctcaagcggtgcttgaaggggagggaaagggggaaagcgggcaaccacttttccctagcttttccagaagcctgttaaaagcaaggtctccccacaagcaacttctctgccacatcgccaccccgtgccttttgatctagcacagacccttcacccctcacctcgatgcagccagtagcttggatccttgtgggcatgatccataatcggtttcaaggtaacgatggtgtcgaggtctttggtgggttgaactatgttagaaaaggccattaatttgcctgcaaattgttaacagaagggtattaaaaccacagctaagtagctctattataatacttatccagtgactaaaaccaacttaaaccagtaagtggagaaataacatgttcaagaactgtaatgctgggtgggaacatgtaacttgtagactggagaagataggcatttgagtggctgagagggcttttgggtgggaatgcaaaaattctctgctaagactttttcaggtgaacataacagacttggccaagctagcatcttagcggaagctgatctccaatgctcttcagtagggtcatgaaggtttttcttttcctgagaaaacaacacgtattgttttctcaggttttgctttttggcctttttctagcttaaaaaaaaaaaaagcaaaagatgctggtggttggcactcctggtttccaggacggggttcaaatccctgcggcgtctttgctttgactactaatctgtcttcaggactctttctgtatttctccttttctctgcaggtgctagttcttggagttttggggaggtgggaggtaacagcacaatatctttgaactatatacatccttgatgtataatttgtcaggagcttgacttgattgtatattcatatttacacgagaacctaatataactgccttgtctttttcaggtaatagcctgcagctggtgttttgagaagccctactgctgaaaacttaacaattttgtgtaataaaaatggagaagctctaaattgttgtggttcttttgtg

SEQ ID NO: 1098 - DNA, 1187 bp, Homo sapiens
cccttcacagatgggagaaatcaggcctggagaaaggaggggtggctgcagggcactgtcagttcctgctgtcctgtcacccatgggtgcctgacgtgcccatacccacctctctctcatgccactgcccagagaaggatgtccatgcagcctccagccctggcatgggaggagccgcagctagctgggcaggctgggccgtgaccggggtctcctcactcacctccaagctgatccgttcgcacccaaccactgccccaacagaaaccaacattccccaaagacccacgcctgaaggtgagtgtcctggcctagctgcatcagtggctgagagggctgagagctgcaggcacccaggaactcttactgtctgactcccccggggatggtgaaggggatataggagctgggtaggctccagtcaccctgtgggcttccttggtgccccttccccccagtagcccccttcccctagcagcctctgccctgtcccaagacccccctgaaagctcagtgagcctctgctccccaggagttcctgccccagcccccacccctgttcctgccacccctacaacctcaggccactgggagacgcaggaggaggacaaggacacagcagaggacagcagcactgctgacagatgggacgacgaagactggggcagcctggaggtgtgtggggctgagggagcctccccaggggaccccagctcaaatccacaggctgccattcagggagcttctgtggggcctggctggagttggcctgtcctcatcagcacagcatccctggcacgtaggcctcatggagtggccattgtaggccagagccagcagcaggccccattcaaccccagcggccccagggagcaggctaggcagatggtgcctggggcattccctgaacttcctcactcttacccacaccgtccccctttcccctcctccagtgcccacccagccatgggggtcagcaaggagaggccactcctgggtctagaaccagaccagttctgcttgggggatgggctcaggttgggctgagggaggactggggctgtcctcagaatggggcagagctgggggcccaatttccccatctggctgacagcagcagtttctggccctcaaggctgttggaaggggcatctagatctcattccccagccttaaagaggggtgag

SEQ ID NO: 1099 - DNA, 1173 bp, Homo sapiens
gttcataggtccatgcacctgtccaggaaatgctcacttttgtgtctgctgtcttgactgcagctgcgttcaaggagatctgcccagctgggaagggataccacattctcacctcccaccagacgctcaccattcagggcgagagtgacttttcccttttcctgcaccctgacgggccacccaagccccagcagcttccggagagccctagccaggctccaccacctgaggacacagaggaagagagaggtctagcctgaccccttctgatccctgacccatgccaagcccctaggcctgaccccttgacccgtgatccacagatctgacctcacagtctaacccccaattccttatccctgacccatccactgacctcccacctgaccctctgacccctgacccagatatttgaccctgagctataacctcctaagccttctacagcctgacctgtaacccaaggccattcaacctgatcatgtgactactatgcaaacacaccctaaccccagaatctaacccctgacccttgacctggagacatgattgttgaactcccagagaccctaactgcaaatactcagctgctgatcccagatctgactcccttctcccgccccaacacttcatggccccatcttcttcccttttaggggtgaccacggactcagtgagtatgagaacccagatgggaggggtgggcaggcgagggacaggagggctcatgctgctgtcacccgcagccggtgagtgaggagaggtcagtgcagcagagccacccaactgccaccacgactcctgcccggccctaccccggtgagctgggcactgtagggatgagtcctcaagggctaaatcactgggtgggcggggagttcacagtttaagtactcggggacagtcaagctggggtggggcgccgggccaagactgaagtggaaagggaggcttcagtcaatatcgtctctgaccagagtgcactgccgcccgcagagctgatctcccgtccctcgcccccgaccatgcgctggttcctgccggacttgcctccttcccgcagcgccgtagagatcgctcccactcaggtcacaggtaaggcccgcccagcaaagccacccctgcctaggccacgcccccactttagttttctctcctccctcccgcccccag

SEQ ID NO: 1100 - DNA, 1125 bp, Homo sapiens
ccacgccgccggcgccgccaacgcgggacccgcagccggcccgcgtcgtcctgtcaacctcgactcagcgctggccgcgctgcgcaaggagatggtgagtgggtgggcgccgggccagctgggcggggggctgacgcggaggaacgcaggggactgggacaggcggcctgggtctcagaggacttgcaggcaccagttgggttgcaagggttatggtaacaataattagtgatagttaccaattatggcagtagttaccatatattttcaaatgttttgctgacgttacttcatttcatccggctaaatggataaccccattttttgggtgagggtcatgactaaagttgcatagcttgcaggtggtgcctgatgtccacaaaaacttcgtttaggaaggtgcggggaagatgggctggggcccactattccagggggcggggctgggctggggtggcctggaccccaactccagcccaccctcagttgtctgcaggtggggctgcggcagttggacatgtccttgttgtgccagctgtggggcctgtacgagtcaatccaggactacaaacacctgtgccaagacctgagcttctgccaggacctgtcatcctccctccattcggacagctcctacccaccggatgcgggcctgtctgacgacgaggagcctcccgatgccagcctgcctcctgacccgccaccccttactgtgccccagacgcacaatgcccgtgaccagtggctgcaggatgccttccacatcagcctctgaagggctggggggcagggggcatgcacccatgcaaaaggctcagaaactccccctccggcaagccctcagacttcggagcctgcgccttcccccctaccgcctcacctcacaggagggccaggcatgtattcctcagaggcgaaactgccaaactctttctcctgtcttgggttggctggcactggggcgggcatctagggtacagcctctgctcatggcactgggcctccagttcttccacatgtgtgcacccccagcttggccaaccctcagccttgcggtggggcccgaagcatcttcccttccgcttggcgtctctgggattgggatgagtgcctggctcccatctc

SEQ ID NO: 1101 - DNA, 1322 bp, Homo sapiens
gaggggcgtgcttcggtagtgcagaactctcgctgctactaggggagtccacgcctccaccttttccccgcctcctgtaactcattggaagagctgtgcgccaattactttgccgttacccaatggctactcaactgtctctttggttccgcccagtcgtctaccctgggttggcaacgcctgggtctacgcatgcgcccaaacgcttttacgctcgaacttgctttagtcctggagtctgcgcacgcccaaagggcacccctcgcgtcctaccgcgccatcacctttctgcgcttgcgcattcatgccgtcaagttttccttttccgggtcccaattggaatcgttgggcgcatgcgccactgcaggctggcggttcgcggctccttcttccggcctcctccttaggccggcaccagcagaagccgggcgagcgcggagccccaagcaagtgacctgcgaccccgaaagtggaccccagatcctggggttctccctggtccggagactagggagctgtcgcctgcaccccgggagcacccaccccacgaccacctctggatgccgccgacgggtacccggcccgtgccccgcgcctgcctgccggctcggcccctcggagcaattctgggccaggagtggggacccggaccccgcccctgatgcagccccacccccgcgtccgggccttgcaccactgactgtcccggccggccccgccccctgctcgcaccctcgcgcggccgagcccccctcccccgctgggggaggccatggcgtgagcgtgaggccgggccccggggccctcaggcgccagacggggcatgggccgggggccgcccccatgagggtcccgggagggggggcgcgggcagcagcggcggggccatggggtcgcaggtgttgcagatcctgcgccagggggtgtgggcctcgctcaccggcggttggttcttcgacccgcaccagagcaccttctccaactgcttccacctctatgtgtggatcttcctgctcatctttcccttcttactgtacatggtgagacgccacggccacctgtaactccagccgggagagggagggcagcctggcagggattcagggcagtgccctgggctctgggacgtggagagagaggaatcactgcagagtttgggtctgtgtggaagaggggccaaagtcttcctttcttggatcgagtgaccttgaaccctacacttaatctcatccagctaagcagaatacagagccctttgtcgaggtctgtgtactggttgtgtggagaggtgatgaaattttcttgtgagtctgtgaatccca

SEQ ID NO: 1102 - DNA, 1407 bp, Homo sapiens
ccctcccaccaggccctggctgggggccgcggtcctccctgagtggctctggtgatgggcggcccccacctctgctgcagtggcctccccctcggctccctggaccaccccctgcatcgcctatccccacagagggtccccggacctcacggccccctggcccgggtctcctcagttctgagggccccagtggaaagtggagcctggggggccggaaggggctgggaggatctgacggggagccagcctcagggagccccaaaggaggtacccccaaatctcaggtaaggcacctgtgggagggttgggtcccagaaggctaaggcctgctcacccgccaacctctcccccctcccccaggcgcctctagacctcagcctcagcctcagcctcagcctcagccccgatgtcagcactgaggcctcaccccccagagcttcccaggacattccttgcttggacagcagtgcccctgagagtggcacacctatgggtgccctgggcgactggcctgcccctattgaggagcgtgagagcccggcagcccagcccctgctggaacaccagtactgagctacctggcgcccactggaccacctcctaggattcagtaacggacctgctctgctgcctctctgctggaccacagaactgagtggctttggcctacatgtctgaaccctgacctttggctgccttggccagagtaccaaaactgagtgacccagacctctgaccttgacccctgatctctctcatccccagtccagggcctgggctccccagatggaggcagtcagcctcccagccaggccctaagagccaaaccatgggctggtcccacttggagcctgtggccaggaccacctcagcccctgggcctgcactgcctgcaggtgtggcccccttggcctggacctggggcctgaattgtgggaagggtggtttctttctttccttttttttcttttcttttttttttttttttttgtgcttcggagacatcagaattaataacactatttttgattttggttggcagtttctttttctacctgggaatgggtacatgatagtacaggcggctaagttgggatggacaagcacgcagaggggtgaaggatgtggggctgaagtctagtagagatcaagggcagaccaaggtggggttcaggtagaaccgggtcctcttcaccgcatggctgctcccttttcaagcctttatctgaagggtattgtctgccatttcccaccatatggtcagacttccaggtctggtggctcctacatttatcaggcttgttcttggccaaagcctttctctgcacctcagctgctccagggcgtaaagagatgacacctatctaaggtgtttttagaataaatgagagcgcgctagtggaatgg

SEQ ID NO: 1103 - DNA, 1142 bp, Homo sapiens
gtggatgtcttccttggaggggggagccatattttattcttttattgtcagtatctgtatctctctctctttttggaggtgcttaagcagaagcattaacttctctggaaaggggggagctggggaaactcaaacttttcccctgtcctgatggtcagctcccttctctgtagggaactctggggtcccccatccccatcctccagcttctggtactctcctagagacagaagcaggctggaggtaaggcctttgagcccacaaagccttatcaagtgtcttccatcatggattcattacagcttaatcaaaataacgccccagataccagcccctgtatggcactggcattgtccctgtgcctaacaccagcgtttgaggggctggccttcctgccctacagaggtctctgccggctctttccttgctcaaccatggctgaaggaaaccagtgcaacagcactggctctctccaggatccagaaggggtttggtctgggacttccttgctctccctcttctcaagtgccttaatagtagggtaagttgttaagagtgggggagagcaggctggcagctctccagtcaggaggcatagtttttactgaacaatcaaagcacttggactcttgctctttctactctgaactaataaatctgttgccaagctggctagagatccgctttttttcagcaaacactgagcacacattttgctagtcacatcaggccagacattggtggtagagagctgggtgaatgcgtgcactgtcctctgagagcttgcagtctgagaatgcccttggaaaccccgagttaccgtccagtggatgaaaacgggcagctaaggcaagagtcctagcacactgagagcctagtagagcccgctggctgtggggatggagcagtttcaggagtcttccaagaggccccattagctccaggtcttagatcagctgagagtggatgtcaaagagggactagccagcgtcagaggtaagagaaacgatgttcgaaagatgtgatggggccaaattccttgggtggcccagggagtgtgtgcttctcttggggaatgtgtggtgccaggtaaagatctacccggcccaccgatgctttgatactctgttctgggaggaacg

SEQ ID NO: 1104 - DNA, 1238 bp, Homo sapiens
tgtgccccaccacgcccagctaatttttttgtattttttttttttttttttttttgagacggagtctcgctctgtcgcccaggctggagtgcagtggcgggatctcggctcactgcaagctccgcctcccgggttcacgccattctcccgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcatttttttgtatttttagtagagacgatgtttcaccatgttggccaggctggtcttgaactcctgacctcaggtgatccactcgcctcggcctcccaaagtgctgggattatagcatgagccaccgcacaccggctggaaaataagtaactaaaaaaattttttttgtgaaccatgatcacaccactgcactctagcctgggtgacacagtgagaccctgtcccaaaaaaaaaaaaaaaaattatcaagctgaataagcaatatataaaaggataatacttcatgaacaaggccttcttccaggaatgcaaggtggtttaacatttgcaaatcaatcaatgaaattcagcatataaacagataacaaaggccgggcgcggtggctcacgcctgtaatcccagcactttgggaggccgaggtgggcggatcacctgaggtcaggagttcgagaccagcctcaacatggagaaaccccgtctctactaaaaatacaaaattagccgggcatggtagtgcatgcctgtaatcccagctactcaggaggctgaggtaggagaattgcttgaacctgggaggcggaggttgtggtgagccaagatcgcgccagtgcactccagcctgggcaacaagagtgaaactctgtctccaaaaaaataaataaataaataaacagataacaagaacatccatatgattatctcaatcaaaggaaaaagattgataaaaatcaacactctcatcaaattagggatagcggggagctccattaagcttcattaagatacccttgattaaaaaaaatatctaaaatcactttggggttaaatttaaatgcagtccctctgagattaggaacatgtcatcatatcatcacttccacattgtactggaggtcttggcaagtataataaggcagtaaaa

SEQ ID NO: 1105 - DNA, 1335 bp, Homo sapiens
ccttctgctctggccttggctgcagggcagggtgaatggcacgcagagggggtctgcccccttgtcttcgctgcctgcttgttccttccatctgctttgattggctccttcccagccacagaaactacccccaccccagtgcttcctgctcacagatgctcccctttcttctttatagggatcaagcatgaattgcaagcaaactgctacgaggaggtcaaggaccgctgcaccctggcagagaagctggggggcagtgccgtcatctccctggagggcaagcctttgtgagccccttctggccccctgcctggagcatctggcagccccacacctgcccttgggggttgcaggctgcccccttcctgccagaccggaggggctggggggatcccagcagggggagggcaatcccttcaccccagttgccaaacagaccccccaccccctggattttccttctccctccatcccttgacggttctggccttcccaaactgcttttgatcttttgattcctcttgggctgaagcagaccaagttccccccaggcaccccagttgtgggggagcctgtattttttttaacaacatccccattccccacctggtcctcccccttcccatgctgccaacttctaaccgcaatagtgactctgtgcttgtctgtttagttctgtgtataaatggaatgttgtggagatgacccctccctgtgccggctggttcctctcccttttcccctggtcacggctactcatggaagcaggaccagtaagggaccttcgattaaaaaaaaaaaagacaataataaaaaggctcattaatgggatgtgtttttcaaggttgggacacaggagacttcaggattgggggtgcactgggataatggtgctatctctctcctctgtactccacacccaaccagcccctgcacacccttatctggctccaatgactggctgagacgcctttctgatggtcaccattattctgttggtgctgtgattgacactggactggctgtttaaggagtgggtgctggctacaggggtcttccagcggaagtgatttatgcctgaactgggtgctctgtagccttgcctggatggacagtgaggtccatctgatattctgttctgtccctttctaggtgtgggctgataggcaagtcagaggtagctcaaaggttctgtttggtctgctgtcttccctggatggctgactcaagtttatgagggtcaggttcagtggctgctgtgagtcaggccaagttgagcctttgacctcctctagatgtggctggagtgcattcagggtggggccagccaggtgg

SEQ ID NO: 1106 - DNA, 1187 bp, Homo sapiens
acgtttggactcagggttccgaggaaccaggagcgatccttagtgggccgagacttccgaatttgatcaaaggtaaagagggactggagagcggtccatctgacttctgtgggggatgggcaggagtcaggggcggacgcctgaatcttgtttctcagaagagccgagaggcctaggctcaagcttggggcgatccggtacttggaggttcgaagctcctagtttcgggttgagaccgatgtggagggcgatgacgcgcgggttccttgacatcgaggatcagtaacacccggagtgggtggggaacgaggggggcggcccctgagctcaggccccgcccctttccggggacgtttcaccggattggctgtccttccataacgacatgcggccccgccccggcgcgcgccccgccgcgtgcccagcccgggtagctgctgcagcctacgctgcctcggccactgcctgccgcgtgcggagccggagcccgagcctgagtggcgccgggcccgacgtggggctcctgggccgcggcggcgggcgggcgatgctccagaggcctgaccagccatggaggccgaggcaggcggcctggaggagctgacggacgaggagatggcggcgctaggcaaggaagagctagtgcggcgcctgcggcgggaggaggcggcgcgcctggcggcactggtgcagcgcggccgcctcatgcaggaggtgaatcggcagctgcagggccacctgggcgagatccgcgagctcaagcagctcaaccggcgtctgcaggcagagaaccgtgagctgcgcgacctctgctgcttcctggactcggagcgccagcgcgggcggcgcgccgcacgccagtggcagctcttcgggacccaagcatcccgggccgtgcgcgaggacctgggcggctgttggcagaagctggccgagctggagggccgccaggaggagctgctgcgggagaacctagcgcttaaggagctctgcctggcgctgggcgaagaatggggcccccgcggcggccccagcggcgccgggggatcaggagccgggccagcacccgagcttgccttgcccccgtgcgggccccgcgacctaggcgatggaagctccagcactggcagcgtgggcagtccggatcagttgcccctggcctgttcccccgatgattgaaggcactg

SEQ ID NO: 1107 - DNA, 1341 bp, Homo sapiens
tgcagcctggatcgagaggagccggcagctgcagaaggagaaggacctggcagagaagagggtgagcacctgggcagcatggggtggtcgcctagtgcttctggtggcctgacggcactgaggcgggggccaaccccagagaggtgagacggggcttggagaagggaagggccgtggtcggtagcatctactttggattctcagcagctttcctgcaaggcctgccctttttgcactccgcttggtagagccctgagtgttttctggtgatgctgagtggcctgaagtcctaggtcacccctccctgtcccgtaggccaagttactggaggagatggaccaagagtttggtgtcagcactctggtggaggaggagttcgggcagaggcggcaggtgaggctgcagcaggggtggtacaggggacactggtggccttgctaccggaatcccgaggttgggtgcgtggagggaggttcctgactcgccgattcttcccttaggacctgtacagtgcccgggacctgcagggcctcaccgtggagcatgccattgattccttccgagaaggggagacaatgattcttaccctcaaggacaaaggtaatgcgagctgggtgccctgggtgggggcacagcctctgctgagttgcggacaagtgtgaatggccactgctctgtgctgcccccaggcgtgctgcaggaggaggaggacgtgctggtgaacgtgaacctggtggataaggagcgggcagagaaaaatgtggagctgcggaagaagaagcctgactacctgccctatgccgaggacgagagcgtggacgacctggcgcaggcacggcctgggcaggctgggtggcgggggctgaggtggagaatgtcgggaatgggggctctgaggaggtggtggctcagtggcttttcaggagccagcctgggtcccaacctgtacctcttgccttgcagcaaaaacctcgctctatcctgtccaagtatgacgaagagcttgaaggggagcggccacattccttccgcttggagcagggcggcacggctgatggcctgcgggagcgggagctggaggagatccgggccaagctgcggctgcaggctcagtccctgagcacagtggggccccggctggcctccgaatacctcacgcctgaggagatggtgagccctcccgtgccttatactcggggtcaagattctccctccctctggggctcctgccctgcccgcaggcactgagaagacagggcgagtatttgtgttcacaaagcgcttggcctcgcgggtgagcactaaatggcaaccgggggaggcaccaggtgtggatgggtc

SEQ ID NO: 1108 - DNA, 1218 bp, Homo sapiens
atgaaaccttatagtttacagaacctggcccagccctcagattgcctctgatgctcagaagaggtctgtgttcccatcgcacaggtaaggagctgggctcaggatggtgaggtgacttgccgagggtccttcagctagtccggtggcagaggcagaaagcctggatggctcattccacctgctttgttttttctaccaaatgttgttgcttaacagggccaatccctgaagataaggagaagcttaaatcagccgtgggccgggaagagtccctgtctgaggagcagccgggctctttagctcaccagggactcatgatgtccccagctctggacgagctgtggggaagctacataccacccagacaagttaccagggcccacctgactgccatatatccagtgatcttatttcagcacattgacctctcgtggctttggacactgctctcttctctctccttgaaaagtggaccatcccccgctcctcagtctcctgcagcactcgattctctattgtcagtgtctatttgctggtctgtccagtgctgcctcccatcaccctgtgtttggtgcttccccactgccctggactctcctccttactcttgtgcatggctgcggccactctgtggtttgcttctgccttgtgttctgtgattcctgcatctaacagccgtggctgtggcttccctcctctgtccatgtctacactggcactttgtgtctgtattaatcctgatcttcatgatcttctctagtaaactaaatggtgaggtttgtgttttctagatgaggaaacttgcttggagaggtgttaagtaacttgccaccggtctcacgggaagggcaaagccagttttggagggctcttggcttttgagcacaccctttcccaccctcaagcagcctctgcagaactcagatgtccagcgctggcctcactgtctctccccaaaccagcgcctctatccccatttttaatatttttatttattttaagacatggggtctcactctgtcacccagactgcagtgcagtggtgtgatcatagctcattgtaacctcaacctcctgggcttaagggatcctcctgcttcagtctcctaagtcactgggactatagacacacaccaccatgccccagctgcatccccatctttgtgacacaatccttgtcagcctgaccagaaaactcttccctcccccatccagtca

SEQ ID NO: 1109 - DNA, 1228 bp, Homo sapiens
tcggggctcggggcgcgcagcaacgaccacccggccacagactacgccagcggccgcaagcccggatttaccgcagcctgccgagcgcagccgaggcgagccgaggccagccgagccccgagcgccgccccgcccgccgcccgccgcccgccgcccgccgcccgccaccgcccccagcccccggcgcgccggctcgccccctacgagggaggaggagccacggccccgccgctcggccgcgcgccgtgcagacgcccgcccgcccgggccccgccggcttcccgggacgcactcctctccctccccgccggcgcgcgcaccctggaccgggcgcgccctgaacgcgcggcgcgctcggccggactcggagggaaaccgcggcagagctcggctgcagcgtggtaaaggatggcgcgggctcagcagaaaggaaatcaaaacgctcccttccttccgcggcttcttctttccctgtgtccgaagaggtctgcgttgcgacttacgtggtagtgcttggaaggtgcggagtagatgagagataagtgaatgtggacaaacctgtcacgtaggacgaggtggccgagtggttaaggcgatggactgctaatccattgtgctttgcacgcgtgggttcgaatcccatcctcgtcggccctgttttatagaggttgggggggaagcatctacattttcacatcctgcctatttggagcagcaagctggaggtgcgaggggtgaggcatctaaattttcacatcctgcctgtggagcagcaagctgaagaaaactgaactgggggtgagagtggaattcgatcccaagtctctctggtctttatccaccacgcatctcctgcctgctcctacttcaggtgtctgtagctctgggcagaggccaaaggtgttttctttccttctagaaagagggcccaggggttggtggcacggaaaagactagaaccgggattctggccagtgtgaagttgggggccaacgtatgatctgcaggaatcagggaagccccccattggaggcatcgccctccccgtccgaagtagtggtacttgtcctactctccagcacttctcctagggcggagaccttgtgtccacatgccctgctccccaacacacacaatctctttttttttttttttttttttttttgaggcggattctcgctctgtcgcccaggctggagcgcagtggcgcgatctcggctcactgcaa

SEQ ID NO: 1110 - DNA, 1357 bp, Homo sapiens
ttatacatgcccttctgcaccttctttccaaagttagtttcttccctagttggaattggatgtcctcaggtcttaaaacttgtgcagttgatgctacttctatctagactttgaatgatttttaactcggaccttggcagtaactcctagatagaaaatactgttaattttttttttttaaacctcagggagctaattggaacctttccatttttcctatcctctgctgacagcttgtgatgtggaattaccttctctgaggaatgctaatgttaacatcatcaagagcaaggaatgtctctttgcctacttttatgaaacaagatttgctattaatttaagaccttagtctgaggttgtttagcctccccagttactctctggccttcaagctcttttcattgttagagattactgtgatactgggggagaagggtacaagtaaacttaaaaggagtgtcaagttatcagactttgtaaagatgttgaagttttaaatgggaaagcccttttgagctttgctgtaaagccgctgtattgtgctctctttcaggtgggatgtgtgtgggctgaaattccgagctgcggttgtgcatgagaatacacccttcgtggtaccccatctccgggacgttctcggctctgtgcgttcagtccctcaggaaccgtggaccttaatttaccttgctaagttcagaccttctcttcctttcctttcctttcctctcctgcccattttcctgttcttctgtccttcaatacttctgtagcttcccattcatgttctcttctcccagcaggcctcattgtgtgcagaaactgtggtgggggctgtgctgtctcctccctgcctcctgcctcctgcggctgttggatttgggaatgaccttggtgagagtctcactgctccagggtctctttttggtccaaaggctagacctatagagttggatcactttttttctttccggtgaaataaatggtttttcaacttagggtatgtgtgctttgcgagacttcttgcttgggcttgtttgggggttcatttgtaccttgaaggggagggtataaagttttaagacactcagctttgggtgaacgtcactgtagttattttgtttattgtaagtaggacttgtaggtgccagaggaaggaggttatacagaagcccaggcaggcagccttattccaatgaagacttttcccactggtccacctttgttataaaaccaactacttttagtttacagatgtaggtcttctcttctagagaaacagtcaccaccttcccttaagactaccattccaatcacccagtcagtgtatctagcttaacttaatttccagggaaaagga

SEQ ID NO: 1111 - DNA, 1357 bp, Homo sapiens; identical to SEQ ID NO: 1110

SEQ ID NO: 1112 - DNA, 1147 bp, Homo sapiens
ggaccatagttagggtatccttgtctgaagcctaagggtcccaagcaccttgaaacgcctttgctgggggtggagggagtctgtcaaatacagggtcagtgggaagcagctgcacctactccttaaccacagggaagaaacctgtcccggcccccatgcagcggggagaggtgggttctgagtttggagtggaggactcgctccatcaggcagggaccacatcccctaacatcacggcatggtctgtccatctgcttcctctaccagatgctccgagacaaattccgagagttctcccgggacacaagcaccatcggtcaggagcgcgtagatagcgccaatgcgctggccaatgggctcattgctgggggccatgctgcacgggccaccgtggccgagtggaaggacagtctcaacgaggcctgggctgacctgcttgagctgctggacacacggggtcaggtgctggccgcggcgtacgagctgcagcgcttcctgcacggggcacgccaagccctggcgcgggtgcagcacaagcagcagcagcttccggacgggactggccgcgacctcaacgctgccgaggccctgcagcgccgacactgtgcctacgagcatgacattcaggccctcagcccccaggtctgacccaagcatgaggaggtgggggaggcttagaggaggccatgggggaaatgccggggagagttcccaggagctagggtagagctcagaaatgctgggaggacggcactctttcgagggccatttcgagatgaggaaattgctccaagaaaacatctctgtttggccaggcgcggtggctctcgcctgtaatcccagcactttgggaggccgaggagggcggatcatctgagattgggagttcgagaccagcctgaccaacatggagaaaccccttctctactaaaaatacaaaattagccaggcatggtggcgcatgcctgtaatcctagctactcaggaggctgaggcaggagaatcacttgaacccaggaggcggaggttgcagtgagctgagatccctccactgcactccagcctgggcaacaagagcgaaactccgtctcaaaaagaaagaaaacatctctggcaggggacatctagccactgcattcacactttt

SEQ ID NO: 1113 - DNA, 1132 bp, Homo sapiens
aggagaaggggaaaaaaagatgagctttttggtgcccttttcatttgaatgggtaagttgtcattttgctctaaaaggagatggagagatgtcagccttggaggactgggcaggcccagggtttggggtaagtgatgcaagttatggatgaacttctgggaggcctgacccaaatggtcctctcttgcagacgtgaatgtggaccagccagatgagaagtcaatcattacctatgtggctacttactaccattacttctccaagatgaaggccctggccgtggaaggcaagagaattggcaaggtactgtccatgggcagtaggcataaaggccagaggaggcccggctgaggggtcttactgccctagtgcaagggcagggtggagctgcaggactgggccagggaccctgtggctgggactgtcacgtccctgtcttctgcctcccaggtgctggaccatgccatggaggcagagcgcctggtggagaaatacgagtccctggcctcggagctgctgcagtggatcgagcaaacgatcgtgaccctcaatgaccggcagttggccaactcccttagcggggtccagaaccagctgcagtccttcaactcctaccgcaccgtggagaagccgcccaagtaggtgtccctggggccccacccttccctgagctgtgctcccacgagaggaagcctaaattagcacagccttcagggagggaaatttggcagtacataaatgcagtggagatttcccacaccagaagcatccaaacaacatagttgatacaaaataaaattttttaatgattagtcgtttttaaaaatcatgctgtgggccgggcatggtggctcacgcctgtaatcccagcactttgggaggccaaggcgggcgcatcaccgagaccagtctggccaacatggtgaaaccccatctctactgaggtcgggagtttgagaccagcctggccaacatggtgaaaccccgtctccactaaaattacaaaaaaattagctgggcatggtggcacacgcctgtcatcccagctactcgggaggctgaggcaggagaaccacctgaacccgggagacagaggttgcagtgagccaagatcacgccactgcactccaac

SEQ ID NO: 1114 - DNA, 1209 bp, Homo sapiens
ggggtctcactatgttgcccaggctaaaactattttttaaacatacatgcttcttagtgtcttctcttttaaaaggtaatgaaataataatcccagattcaagctttaacttgaaactgactttacaaccactttgataagtaactgatttctagtacacagttcaaagactaggtcctacccaaactttaaaaaatccaattgactattacctaggtgtcctcctaggtcaggatcctgtttctacctgttaactgtgattttgaacagtggacaaatgggttggaataaagatagaccatttttttaaatgtggtaattttgtcatttatagcctcaaggcccctatcatgccacctatttctcttgctgatcacatggcagagtgaaatgttcttactgcattttttcttcatattggtagatttggagttaaatgggttggagtctgggaatggggatgaggaagcagtggatcgagaaccccgacgcttgagcagcaggcgttctgtcctcactagccctgtagcgaatggagtcaacctggattatgatggactgggcaaaacctgccgaagtcttccaagtctgaagaaaactttggctggggactcatcttctgactgtagccggggctcccacaatggacaagtgtgggatccccagtgtgctccccgaaaggacaggcaagtgcatctgacccattttgagcttgaaggccttcgctgccttgtagataagttggagtctctgccactgcacaagaaatgtgtccccacagggatagaagatgaagatgctctcattgctgatgtaaaggtaagggtttgatgtgttacatgacagctactgatccagctatggcagtcagcttccagattcagagggagaaaatataggaattttgggtgatctctggttcagtcagagagaagttaatatgcatgtgtgtttgttattgctgctcagtgttttcattactagaatgaggttatgtccctgttttgaaaatactaacatttatgtgttcattgaagacttataaatttagtcttaaacataggtttcaggctgaccccaaaaataaagtgacccaaagaaaatatttatataagaaatgttacattaaacttaagttaccttgagataaaactcaggacaaaagtgactgataggagtctcatcctaagcagattgagagaaatgaaa

SEQ ID NO: 1115 - DNA, 1233 bp, Homo sapiens
tattccttatagcccctacttaatgctttgcatatcacaggccacagcttattttgactatgtgtggagacagccctgataccctctcctttctatcttgttatgcagggggcagggtctgcaggtgcccttggccatgcctaggccatgcctaggcagatgaggagcccggacccctcagggtggggcatgtgccctctaacttgggccagatgactcagggccattcagcagagctggcttgcctcacccacaagcaagttagtagctcctgcacctacactctgacctctcccttttctagtgattcttgcacttgctggcagttctgtgtctgcatcgcacagatatgcctgtggcccttattatttcaggtacattgatcttttcttcccaagtagattagaagctccataagggcaggagccaaattaggttttaggcttcttttggcttttctacaccacaggcaggtaattagatcttgaaaatatttgtcaactgattgacattgccatcatttcttactttcttcacttaaggcattatctccaggaggcccttataaaatatccatgtaggatgtgaggatgatctggctgtgacatctgtcaccccattgatcaccagggttgattcggctgatctggctgtctaggcgggtgtccctgtcctccctcacagctcctcgtgcatccctcccgaagctgtgtgctctgttgaggacgaccatccctgatagaggaggatcagtcttccgtcaagggtatatgagtagcctcgctcccatgctagaacttccaaacaagctctcaagatccataaaatatccatgtattacctgggagctattcattcattgacttacccagtggttcctaactaaagtgtcatgacatgctgctagagcctaagtaatctgtaatgactacagctgctgctgctacagccaagcatctgccctttgttgttcctgttatcctttccagcagtcttagatgggtatttaattatccccactttactgatggggaaactggtcactcaaaatttgtgagtctgagatttgagcttagggcatcccttgaatagcatctatcccattctctcacaatttgaatttttctcttttcctgaatatgctatcttacattggagagagaggagtagcatttacagctgaggattgtgacttgttcacagtctgtttccctcctgaagagaggaagggtg

SEQ ID NO: 1116 - DNA, 1203 bp, Homo sapiens
tgggggagggactggttggctgtcacccaggacagggacacagacaattcataggggaagctggctggagagagccctggactggaagcccagagtcctgagtttgagtctgggtctgtgtctgatctgtgtgacctggggcaagtttctgtctatatctggacttgtgtttctgtctgtagcttggggaaagggggaaggaggaggtatgggttctgtgatttggatctgggattcctgagccagaggttcaaaggggaaggatgttctgccccagtagtgggtgcaaaccctcggaggctgggggtaagagacgtacagaggcctccccggacccttcccaccttagggttccacctggcacctgcagaggggtgctactggctgagtccccctcccaatccctaccaccagaccctcccggcctccctccagaattcagccctcagccccctgtcctctgtcccagcattccgccagccctcaccctgcccccttaccctggctctgctgagctgcccccaatgaatccatagcggtcggcctggcgatatgggccaggcccgctgagctctgagtcggaccccaaggagctggagtcatcctgcagctcgggaggctgcaccaggtcctcccccagggcctgggccatggtgcccggggccttcgatgccacaggcagagaaagtggggagaaccagtgtgaggggccactcccggccagcctggggcctggctgcggggtcagaggggggaggtttcagggtatctcaccaagccccctatgtctcctcttttatgggggcaggggctaggccctgccctgacagaaaagccaggcctctgtccggagacccagccccaagccctgcccctgtccccaccagcccagctcacctcccgcagcacctcacctcctcctctcacttcctcctcctcctcacacagctttggcaaccgctgggggcccctcccaagggtggggggtgtcaccccttcctctctgaggctcttcctgcctgccccagtgcccctgagctgtgggctcctcccaccttccccatggccccagtgactgcaggcttgagttcctgtgctggtgtggagggcccaggactgttagacgcaggggccgggccacctccagttcttttgtttgtttcttttgagacagagtctcgctctgttgcccaggctggagtg

SEQ ID NO: 1117 - DNA, 1103 bp, Homo sapiens
caaccccggggtcctccgaggctcaggagcctccctcgctcggcccagtccggctccgtcccaccgcggaggcgctctcccggcgccccccgcgcctcgctcccctctcccccttccctgcgaccgccggggcgccccctcgacgccccgcccccttcgcccaggccccgctcacggaggccgcagcgctctgggttgggggcggcgccgcagccaatggggaggcggtgtggcgagggcggcggcggttatgatgcgccgggccggcggacggcggccaatcagtggcgagcgcgagggcgggctgtgacgcggccggcgctcctcgtgcggcggcggcagaggagcgagtgcagcggccagcagcacatccccgctccacagtcgccgcagtcgccgcagccgccgccgccgccccgcgcgcccaaccgccgcggccccctgccccgccggcctgccagtgagagagcggcgagggggcgcccggccggactctgagcctagtcctctcgcgctgcggccgcccgcgcctcctcggccgcctgtcgggcatgaaaaccaaattctgcaccgggggcgaggcggagccctcgccgctcgggctgctgctgagctgcggtagcggcagcgcggccccggcgcccggcgtggggcagcagcgcgacgccgccagcgacctcgagtccaagcagctgggcggccaacagccgccgctcgcgctgccccctccgccgccgctgccgctgccgctgccgctgccccagcccccgccgccgcagccgcccgcagacgagcagccggagccccggacgcggcgcagggcctatctgtggtgcaaggagttcctgcccggcgcctggcggggcctccgcgaggacgagttccacatcagtgtcatcaggtcggtggcgccgggtctgggggccgcgggacagtcaggtgacgcggggcggggccggggcggggtccgggcagggggcgtgggccgggggggtcgggggccgggggagccggggccggggcggaggccggggaccggggaccgcagccggcgaaagccctccttctcccagccctgggtaatccaagggaagcgggttcgc

SEQ ID NO: 1118 - DNA, 1296 bp, Homo sapiens
gggatgtggcttctctgcagaacaggacagggcccctgtagcctctggaggacgatgtgggaggttttgggcatggcaggaagggtcacccatatctgggggaacagacgtaacagttggtaaacaaacaggtgctgtcaccgaatgtgggaagaaggctgtttgctgcgctgcaggagcctctgaatgatgcgggccggggctgcccaggcaacttcctgacaacgccttaggggtgggaggaaggaactggaggtcttgggcatgggcagggcagtaccaggagtgctctgggcatagtgctccatcccagggctgtgtatcttgctggcttagccagtggccctcacggtttgcttctgccccacagcctcgccgctcctgctatttgccaaccgccgggacgtacggctggtggacgccggcggagtcaagctggagtccaccatcgtggtcagcggcctggaggatgcggccgcagtggacttccagttttccaagggagccgtgtactggacagacgtgagcgaggaggccatcaagcagacctacctgaaccagacgggggccgccgtgcagaacgtggtcatctccggcctggtctctcccgacggcctcgcctgcgactgggtgggcaagaagctgtactggacggactcagagaccaaccgcatcgaggtggccaacctcaatggcacatcccggaaggtgctcttctggcaggaccttgaccagccgagggccatcgccttggaccccgctcacgggtaaaccctgctgcgactccacctgggtccagggggcggggagtgtcaccatctctctctcgaatttgcatgagcccaagttgtttttcagaaaaagggtgtgactctgaaaatgaacccgtgggggggttggctcaggcctgtaaccccagcactcggtgtgactctgaaaatgaacccgtgggggtgttggctcaggcctgtaaccccagcactcggtgtcactcttaaaatgaacccgtgggggggttggctcaggcctgtaaccccagcactcggtgcgactctgaaaatgaactcgtgggggggttggttcaggcctgtaaccccagcactcggtgtcactcttaaaatgaacccgtgggggggttggctcaggcctgtaaccccagcactcggtgcgactctgaaaatgaacccgtgggggtgttggctcaggcctgtaatcccagcactctgggaggccaaggcgggcagatcacctgagtccaggaattcaagaccacactgggcaacatggtgagacccc

SEQ ID NO: 1119 - DNA, 1173 bp, Homo sapiens
cccagccgatagctcatttctttataccactaaataatattccatcctgagtgttttgaattgccttttagaggttcatttacagcattttcatggtagcaaaaaaatcagaaataacctgaagttctttaaaaaacttacagcagagtacactaggcaatcatcaaaagaacaaggaatctttctatccacaagaagggaaggtgcccagaatttactgttaactgagaacaagttggaaatagtatattttgattgcccagcttaaggcaggaatacctgaaaccatacctgttggttatttccgatgggtgagattttagggcaagttcactgtctgttgtttcatgtctgcatctatgcagacaaaaacaaaaaacagatctgtgttagctgcttctcttgccctgcccccgtcacaggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggtaggtacccacgcagtcctggggcacccctttcccctttgtccccagggcttttgaaggcgttccttcttaactcaggcctacagactcttctctgaaactctggggccctgaggaatgcaggacttctcagaacttggaacagcgtcagggtctgtgtggcatttgccaccagcccttgaatatttctatagcaaatgtggcacgttcattctaagtagggcagaaaagactatctgtagcccacacccatgcacagtttttttttttttaactttgtttttttgagacagagtctcactctttcacccaggctggagtgcaatgtcataatctcagctcactgcagcccccacctcccaggctcaagcgatcctcccgcctcagcctcccgagtagctgggactacaggagtgcgccaccacacctggctaatttttgtatttttggtagagacggggtctcacatgttgctcaggctggtctcaaactcctaagctcaagggatccttcccctcggctcccagagtgctgggattacaggcgtgagcca

SEQ ID NO: 1120 - DNA, 1284 bp, Homo sapiens
ggaagacttcaggatggcaggacaacagaaagaggtccaggttttagagcaagggcaggtcaaacttagaaaattctggaatgaggatgtgcatttcctcttctggatctgctaaaagaagagggaaggaggggctgctgggggaggagcccagagccgagtttacatccggatcccgcaaggcctcccctgccctgaggtcttgttttgtgatgtgcttgtgtccatcctggtttctgccgtgtccccaacatccggccaagcttaggtggatgttccagcacacactcaccctgtctgtgcatctgtttttgtgtccgtaagtgggtatttactcgccttacgagtgagccactgtgggaattcagggaggtggcgcagtgaccacccctggagggatatgtgtgtggcaggggtcgagggtctcgcccttccctgcttcctgcgcgtggctttctccaggacggggagggctgagctgaagaggtggggacagttgcgtccccccgccacccactgtcctgcggtgagagcagactcactgagcctgcccttctcccttgtgccttccagctacatctactggaccgagtggggcggcaagccgaggatcgtgcgggccttcatggacgggaccaactgcatgacgctggtggacaaggtgggccgggccaacgacctcaccattgactacgctgaccagcgcctctactggaccgacctggacaccaacatgatcgagtcgtccaacatgctgggtgagggccgggctggggccttctggtcatggagggcggggcagccgggcgttggccacctcccagcctcgccgcacataccctgtggcctgcaagttccccaacctggcaggagctgtggccacacccacgactgcccagcagcctcaccctctgctgtgggagttgtccccgtccacccctgggtgcctttgctgcagttatgtcgggagaggctctggtgacagctgtttcctgtgcacctgctgggcactaggtcccagctaatccctgtgccaggactctaatttcaccctaacacacatggtggttttcattgctggggaagctgaggcctgagcacatgacttgccttaggtcacatagctggtgagttcaggatcccccagagataccagggccagcactcgatccccacccagccctgaaccccaccatgtgctgggattgtgctgggagtgtccacacgcccgggaccccagggctggtgctctcatctcctttttccagatcatgagaatgaggc

SEQ ID NO: 1121 - DNA, 1209 bp, Homo sapiens
attcagaagtgtaaaaatattgcacattgacaaataccaagaatttttgcgtatgtttatattgtattgttctaaataatgggtagcctgtgaaataagatcttgccacccatgtaataatagtagtaatactatagttaaaatggctgtaagaatagttttataaaagtgaatacacagatctattgtatttgaaacataactttgacaattattagtgtgaccaaagtattaggcggttttcatacatttttcaccttgtacaaaattatgaattcatttttcctccaggccgacaaggagttgtagaatgaaaatgccctctaagtgttattttggttgttctaacttacaaaagtgattttgaataagaaatatttggtgttctttttataaccagtttttgattggtaattgttttctgtattgtttaaaacggatcaaaaatgtaagtctattggtagagattaagtaaagtatttattgctacatcatagttgataaattgatgttatcgtaaagccatatgttctgttcaagtcttgtttgcttgaaatgattattcctacaagtgaaacactagactatttggagtgtatatggcttgtgttttgggattttttttttttttttttggcttttgtttttgtttgtttttttgtttcatttggtagttcatctgccttttaacccattcaccaaaatttaccttgttaacaagcatcaccaatgaacatttcagagcaatctgcatatttaacagacctaaaataaatcctattaggcaagtcagttgaaaatgctcgtgctgctaatggaattagagtgcgttcattttacaggctagtattttaaaagtagaaatcaaaatctggcaccgaagcatgctaattgtttactgtaccttgtgaggttttcactcataaatttaaaccagtgtatttttttagaactggtttgtgtatatatatagtgattatggatactaattcaatgtaatttataattttctatgtcaatacaaaaatacatcacagccttctcaaacagctcaagcaatatattgtatattgccatatcgtctggtgaaagggttaaattacttcacctcttgcacttttagatgcaaatcagtttttcatttctgtaatagaaaattattcacgtatttttacatcatttgtttttcctgaccagtatttaaaacca

SEQ ID NO: 1122 - DNA, 1230 bp, Homo sapiens
gtgttatcgggctgcactttaggtggcgatggggagagggaagaggagtgaggggaggggagcgggggaaggagactgccagagaaggtcttggaaaaggcggtgttcattagaaatctcaaaaccgagtcaccaagttccctctgttggagcccagtggagcctctgggagaaaagctggggtgacttttcctacaaggggcagagggactctgctagatttttgtttttcatttgtttttaattttgtaacatggaaactctttccttaggatataccagctctcattactcagctaggaattatacctctttaaagcctgaatttaaaagtctgacagttttaaatgcttactaactgtgggagttaaatcattacgaagtgaggaatacagagtgttgtccctgattctgggtttaatctggtaagaatctttacagaggacgaccacacgccgcttcctgtagcatgtgtcgtggttgtaattctctcatgtgcatattaagaagttgctgctcagatgtggctcttccctttgcagaggccggtgccctcgaccgcctcctggatctccccgccgcagcctcctcagaagacatcgagcggtcctgagagcctcctgggcatgtttgtctgtgtgctgtaacctgaagtcaaaccttaagataatggataatcttcggccaatttatgcagagtcagccattcctgttctctttgccttgatgttgtgttgttatcatttaagattttttttttttggtaattattttgagtggcaaaataaagaatagcaattacttgcaattgtctttttcttccacacctctgtctcatcaccagcgccacccatgggttttaaaagataaagcttgatcataatcgtggattagacatgaattttaaacccaaattctaccgtcaagagcatctgagacaccacctgttattgcatgtccaggggacataaatttatctccatattaagctgagtcaaatgtaattatgaaggtaagtctgttactgagatgaacaaaaacacaaaacagacaaaacccctgccctcgtggagctgatattttagggagatgggaatgaaaaagactacaacaaccttaaacagatgggtgagttgcgtggtactcatggaggtggtcagtgctgagaacagacgtgttggccaggtgggagggccaggagcaaggcaggagaggagagatgggcgggca

SEQ ID NO: 1123 - DNA, 1183 bp, Homo sapiens
ggggtgtgcagggtgggcgggcaagcatctggtgtcttgtggctccagagaccaggtgggaggtggaggcatttggtcctgagtgtcctgacaggtgatggcagctcccacatctcgctcaggttcagaggaggcagcatgggccgagggacagtttttggcttagtcttgctcttataaaggcttccgggtcatggcacctgggaaggggccctcgctgcaggccccttctaaggaccccctcttcccacctctccccaccctctctctctcaggactgcctccgggcctgccaggagcagatcgaagccctgctggagtcaagcctgcgccaggcccagcagaacatggaccccaaggccgccgaggaggaggaagaggaggaggaggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaagaaaaagattacccaaaaactgtctttaaaagagagagagagaaaaaaaaaatagtatttgcataaccctgagcggtgggggaggagggttgtgctacagatgatagaggattttataccccaataatcaactcgtttttatattaatgtacttgtttctctgttgtaagaataggcattaacacaaaggaggcgtctcgggagaggattaggttccatcctttacgtgtttaaaaaaaagcataaaaacattttaaaaacatagaaaaattcagcaaaccatttttaaagtagaagagggttttaggtagaaaaacatattcttgtgcttttcctgataaagcacagctgtagtggggttctaggcatctctgtactttgcttgctcatatgcatgtagtcactttataagtcattgtatgttattatattccgtaggtagatgtgtaacctcttcaccttattcatggctgaagtcacctcttggttacagtagcgtagcgtgcccgtgtgcatgtcctttgcgcctgtgaccaccaccccaacaaaccatccagtgaca

SEQ ID NO: 1124 - DNA, 1179 bp, Homo sapiens
caggcacggtttggaaatattcacatcgcttctgtgtatctctttcacattgtttgctgctattggaggatcagttttttgttttacaatgtcatatactgccatgtactagttttagttttctcttagaacattgtattacagatgccttttttgtagttttttttttttttatgtgatcaattttgacttaatgtgattactgctctattccaaaaaggttgctgtttcacaatacctcatgcttcacttagccatggtggacccagcgggcaggttctgcctgctttggcgggcagacacgcgggcgcgatcccacacaggctggcgggggccggccccgaggccgcgtgcgtgagaaccgcgccggtgtccccagagaccaggctgtgtccctcttctcttccctgcgcctgtgatgctgggcacttcatctgatcgggggcgtagcatcatagtagtttttacagctgtgttattctttgcgtgtagctatggaagttgcataattattattattattattataacaagtgtgtcttacgtgccaccacggcgttgtacctgtaggactctcattcgggatgattggaatagcttctggaatttgttcaagttttgggtatgtttaatctgttatgtactagtgttctgtttgttattgttttgttaattacaccataatgctaatttaaagagactccaaatctcaatgaagccagctcacagtgctgtgtgccccggtcacctagcaagctgccgaaccaaaagaatttgcaccccgctgcgggcccacgtggttggggccctgccctggcagggtcatcctgtgctcggaggccatctcgggcacaggcccaccccgccccacccctccagaacacggctcacgcttacctcaaccatcctggctgcggcgtctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcgggcggctgggtctgtgcatttctggttgcaccgcggcgcttcccagcaccaacatgtaaccggcatgtttccagcagaagacaaaaagacaaa

SEQ ID NO: 1125 - DNA, 1148 bp, Homo sapiens
aaaaattagccaggcatggtggcgggtgcctatagtcccagctactcgggaggctgaggcaggagaatggcgtgaacctgggaggcggagcttgcagtgagccgagaccccgccactgcactccagcctgggcaacagagcaagactctgtctcaaaaaaaaaaaagcctgcaccaaggacccgggcctcccaggagtcgtgtcgccttccttggctccccagatgggtgtgttaatgtaaggtttccctgcactgaccaggatgtggcctcccccagccctgctctgggaggaagtgaagcgccgcagtgttgttggtgtctaatgctttgtgtttgaaccctgttccagtcagctgtcggccacgaatatcagtcgaaactttccaagcactgctcgcaggtggactcggtccgtggcttcggaggcaagtttggtgtccagatggacagagttgatcaggtgagtgatgtggcactgggactggggcaggttggggcaaggggggcgttccccgtagatctgagccctgttgggccacttgtagtagcaggcaggtgccctccagctctgggggactgcagagaggggcatctgcctcccaggatgctctgagagcctgggctctcagagagaggaagcaggatgcggcgggcttgctgtagcagtccctgcggtcgctcttcactacgtgcctcagtactggatggccctgtgtctgtcccaatgtgccagcagggaccgtttccacccgtgtttctcacatgtgtgttactgtgacagagtgacatcagagcctataccgggggggcaggatgcgctcgtgtccaggacccaggctttgcgtccaggtgttgttgcagtcatcctaggcccgagcctctttgattctcttcggctcgggtctgttggctcttttgtttaatagaggagcgatcaggagcctggagggagcagggagctgatgctggtcgcagattgtggctttgtgacatattagccacggttctgaatttatgtgtctgtgaaaggaggatgatcatacctatctcacgggtgtttgctcagatgcccatcgcagtgcctggctggtgggagtgcacccctggtggccactgctattctcattactaatactaatgttctca

SEQ ID NO: 1126 - DNA, 1140 bp, Homo sapiens
tgaaaacggcacatccagaaacacagctgctaaataggaactcgcagcttgagtgttatggcgctccagccccagcggcgttgcttatcgtggtggccacaccccgcacgtctgtgttgcccgtgtgagcctgtgctgtctcatggtgcgggtggaagccgcatgcgtgggagcttccatggggtcctgtctggcttagtcacgatgctgaggtcatagactaggttatttcctgccactctccaaggagggcctcttcatggatgttatctaaagtattaccaaagatccggaagggaagagtagattgagtgaatcatatgcgtttaactgtattgaaaacatactttccacctgtgacctgcactacctgttaatgatgggttctggcctttcattgtgcatgtagactatgtgaaagggtttggaggaaaatttggtgtgcagacagacagacaagacaaatgtgcccttggctgggatcaccaggagaaattgcagctgcatgaatcccaaaaaggtacattcactctgcctgtatgcgagatggttttagaagtttgtttttgttccttgcggggtcagttggtatgtgttgtgtctgcgtgtgcctgctgcacattgttttgtcttcactgtttgaagttgtcctgtgtgcccccccaatcccccagttccctccagctagtgtagtcacaaaccctccctgctgacacggggtggtaccccagagagctgggtttacctggaagtgggttgcacgggccaagcctgcagcagggggctgggtttacccaggagtggggacatgggtcaagcctgcagcggggggctgggtttacccgggagtgggggcatgtgtcaggcctgcagcggggggctgggtttacccgggagtggggacatgggccaagcctgcagtgctcctcatccaggcttcttgtctataaagtgggccacggtttttggcaggagatacttacttttgaaccgaaagtgttttcttgttggaatgggtgccccttccctggaaaaaggagcctgagggggctgaaagcctctcagtgtgacccagccctgagagaagcaggagcggggctaatggggctgcagcgccctccgaatctgcagggtctctcc

SEQ ID NO: 1127 - DNA, 1545 bp, Homo sapiens
gttttgggttttttctgtttttttttttttttttttttttttgaaggtggggaggggaatatacacattgcttttatatttaatacttttgctgatgcttttgaaaatgtttatgccacagaatttgctaatatattgtaatcacattccttaggaggactttggtaattggttttatgcattgatggttttttttttcttttttgccaaattgactgtcacgcggcagcttcagggagctcgcattctcttgtgttcgtgttgccctcgtgcccatcaagtgcagtcgggacctcccaggacaagcacgaggcctcaggtcggccctgtggcgggtaggcaggaaggactgtcccagacgaggggcttcctctagagtctcactgctggggaggagaggactgggcctgatggaagttaacccggagctaagtcacccagagcacaggagctgccatgtcagatgggaaatctgcctatgtcataccgtgacagcccgcaggatcaggtgacttctagcagagaccctggtttttttcctgtgcccactccggcttgtcctcatctctacccatcccctgatgcccaggtcaccgggagggctgctgggagcctctcctgtccccgccgggcagtgtcactgagtccttgaaatcctcccctgccccgcgggtctctggattgggacgcacagtgcagttgaggtctgcgtcgggcttggcttttcacaaaggctgatgtcttaactgtcacccatatggtccctgggccaccgggcagcctggggcggtgtgtgtgccatgtcacagcatggcctctcggccttgggaaggaaggcagtgcctgctctgctgtgagccgccaggaaccctcctcctgtcaatgggggtgtagtatttttgccaaaatatcatgttcaatttcagtagtttgatcagttgaaggctagaagtgtgaagtgcagatgagtgtgtgttcttccccaaggtccccccacagctccaggacaccgctgtcctggcatttgtggccactcactttgtaggaaactcatctccttcctgaggagccgggaggctggaccagtcccgtcgtgcagtcaggtgggcggtgtgtctttccagaaggtcacgtggaaatgtctcgggacttgggtcccggagtgcccgtgaagcgtgtttttgctcctgaggtgcattttctcatcatccttgctttaccacaatgagcaatgaggtcgggttttatatgcaacttattgtatctgaattcctgtagcacacctcataggtatgatttttttaaattaaagaattcagaataaacattttttgatccacttgcgtgatttgctttggtctgtggtcactccgttctgcagtggaagctgcgtcgacactctcggtgtcctgcgccccggacctgggctggcggaggctctcctgccgtccagtgcgtctcacgcgttctgttctggctttagaccgaaccgtacgttcccttttcagtgttcattcaaaggtgctgcttatgaactgaaatgtg

SEQ ID NO: 1128 - DNA, 1157 bp, Homo sapiens
ctcaagcctgagggaccatctctgcgttattctcagtcgcatggagggcctttgtcatcttcacctcttcagcaggtgcaactcctgagccagatataaatttccaggaaatcagtgtcctgtttgtgtcacttggtgtttcccagaagatgacgggaggtgtcaggggaaggatggaagtggcagcccggcctctgtgtccgtgggagggaagcacccagctagcgtggacacaggggagacacctctcggccccgcctcaactgcgattagacaggctgagccgccgtccccataaatctaacaaagctaccactctgttctccaaagcagttcacatggggtgacctagcaagctccgttctgcccagacttcctgctgaggcccctctgtcactcactggttggtttgttagctaggacattgtctttatcctgggcatttcccccccaccccccacagcactgcgattctggatttaaatttgaatcgaacggaaaatcaaagttttaagacccatgggcatttttaggcgagaaaatttatctcaaaggcagcctaattgccagtagctaggcaggatggtttgaggtcagggcgcagcgcagcaagtattgggttggctttgtctggtttccttttaaagagaccctgcgggcaaaggcttcaccaactggaaaagcctgtgaaatgcggcctccctcaggggaatgccagtgaccccagcccctgtccttctgaccttacccatcctggtacccagtcccccgtagccttctctccagacccaggaactcccaggaaagagcctgaaccttggtcacccagaagagtcatccccagtgggattgcctagtgcaacccttgcccagagagattggcccttttgtgctagcacagctgcaagctggggcaggggcttgcctgcccgctggactgcccacagcccagggatctcgggtgtgctttgtagaactgcacccattttagacattgtgtgtccgtgcccgcaatgctggacaccgtaacaagccacatactgaaaactggctgttcatttgagccgtggaaagatatttattgcccctctcaagtcgggcaggcagctctcctccaagcagcttcaggctcctcccagctcccagctcctccatcc

SEQ ID NO: 1129 - DNA, 1185 bp, Homo sapiens
aagttcccctgtcctaagagagctcacatgccaagtgccttagagtaaggctctgcacctgggtgttccctgaggattggttcccttcctcctacgggagattgtgcatgcaaagagggtgtgacactttgtgtctggtctcaaagaaggcaaagatagggcaggagctggtcagggaaaggccactacggatgtggactgaagggcatgtgggcttcaggtttagtagactgtagtcgggcagagagtatttggggtggtgtggttttcttccgcttcctaagaaagtgcaggagtctgaagcacctgtggagccccagtggctggtgcagataagcggacttgggtagagcggccagaccagctttcctgagtggcctttcttctcaggctgtccaggctcagggaggcgagagccagcaggaggcccagcgcctccaggcccagctgaatgaactgcaagcccagttgagccagaaggagcaggcagctgagcactataagctgcaggtaaggagcccagccccagcccatgccaccttcctcctgcccttcaacctctaccccacccacccaccctctctgcccacagatggagaaagccaaaacacattatgatgccaagaagcagcagaaccaagagctgcaggagcagctgcggagcctggagcagctgcagaaggaaaacaaagagctgcgagctgaagctgaacggctgggccatgagctacagcaggctgggctgaagaccaaggaggctgaacagacctgccgccaccttactgcccaggtgcgcagcctggaggcacaggtaagaatttggctggcagactcacctcactcctattccactggacccctgtgccctctcctcctaggccactgctgccttaggcttttcttcactctccccctggccctctccttctcaggttgcccatgcagaccagcagcttcgagacctgggcaaattccaggtggcaactgatgctttaaagagccgtgagccccaggctaagccccagctggacttgagtattgacagcctggatctgagctgcgaggaggggaccccactcagtatcaccaggtcaggaggcagccttcctccctatgtctgtttatggagtgcctgctgtttatcaggctgtatcctagtgagataaataagatgtgatctaaatt

SEQ ID NO: 1130 - DNA, 1177 bp, Homo sapiens
gagtgtctgggtgaactgaagctgagcccagccccttcctctctgctccccagcatgacggcctggtgtggccctcagagccctcacgcgtgtcccgggcagtgcctgaggtccggctgggtagtgtgtcactgatcccccttcgaggtagtgaaaatgaaatgcgccggagtgtggctgccttcaccgcggaccctctgtctgtgagtggctctccatgcctttgggcagggggctgggggcctggctgggtgcctgccttctactccacagtagatgattgccctgattgccctccccgattgccctccggccccctccctccagccttggtgggggccctcataggcctctttggttcacaccattcaaaggagccccttctgcctggccctggaagctgggagtcccctctgcctggccctgggagctgggagcctggctgattggagtgctccccggctggcagtggagagtggctgcagcagctgcagcagcttcagcggggcgccagcccctctgggccttcacaaaatacctgtgggtctcttgccttcctgcagcttctgcgcaacgtctgagcacaggagcccatccttggctctaggattccgccgctggaagccttctgttcagacaccccttatgctccaaggcctgatgtgagccagcggggggtgcatgggaaactgcaccccacaacccacatcctccatcctgactgcagcatggggttccccggcaggggtgggaggcagcaggggtcagcctgggcaggaacctctcccaactctgtccaggtgttcagacctcttggcccaacctgctcaccccaccgggttcactgtccttgtggggctggagagatgggcataagtcaggaacttgggaggaccaccaccctttcagaggcgtgaggccctggggccctgccggaagggagccccctgctcctcccaacaaactccagaacagcagaaagcgggtgctgtagaggagcactcagctcacggggagggagctcttggctgagcttctacagggctgagagctgcgctttggggacttcagccttccttccagtctgggctgagtggggggtccagactacctgatgccccttccccaatttggggactttttgataatataaatatatctgtatattttaccctat

SEQ ID NO: 1131 - DNA, 1216 bp, Homo sapiens
gattacctgaggtcgggagttcaagaccagcctggccaacatggtgaaaccctgtctctactaaaaatacaaaaattagctgagtgtgatggtgggtgcctgtaatcccagctactcgggaggctaaggcaggagaatcacttgaacctggaaggcagaggttgcagtgagccgatatcatgccactgcactccagcctgggccacacagtgagattccgtctcaaaaaaaaaaaaaaaaaaaaaagaatggagaatggagcctagggcccagggagggcaagtagggctgaggagtgaagttttgaaagggagccagtcaggatgctgggggctgagccgctggaggggggtgtggagaagacctgccccctagccaccccctgacccggcggggcggcgggcccacaggccatgaagaagatgtacaaggcgtgcctcaagtaccccgagtggaaacagaagcacctgcctcacttcaagccgtggctgcacccggagcagagcccgttgccgagcctggcgctgtcggagctgtcggtgcagcatgcggactcactggagaacatcgacgagagcgcggtggccgagagcagagaggagcggatgggcggcgcgggcggcgagggcagcgacgacgacacctcgctcacctgagcgccgcaccgcttcagggacggagacaggaccgggcgagccctggggcggcggccgctcctgcactttctcccctcccccacccggcacctggtggcaccgggccaggcccaggcgggtgctgcagcctggctggacagagccccaataaacgatcccacagcctcagccggctcatcactgtgcctgcttcccacctgcctcatggccgctgccgcggtcccctgcgtctgcccttaattttgttaaggttgttgatcatccggccgttgatccttccagcatctcctcatttcccattgtgtagcggggaggagacggggtttatcactgccccccttctgtccatactctgttccattctctgcccgtatctatccagctgtccttgttgagcggtcattttggcattcacgccaggctatttgctttctttttcactgctttaaggcagcggtccccaacctttttggcaccagggactggttttgtgcaagacaaattttccatggatcaggattggggaaggattggttttgggatgattcaagtgcatcaca

SEQ ID NO: 1132 - DNA, 1202 bp, Homo sapiens
ctgagccagagcccctggagaaggaagcttgtgagaagtggaagaggcccttcaggtgaggacccaggtgacagtctcagagctctgagctgagccccaccccagaggctgccagggtcttcctcttggaccttggagccagctcttgggttgggagggggcttgaggagaggccagaaagctcagatctcccagggctagtctgacctccattgtctggagccacttggggtcagttccatctcacccccccaacccctaccctcaaccctttccctccttcttgggatcagagctctgggggtggggagtcaggcttctgaatagctgtcaccaggagagaacctgtgggcaaagcccagagcccagtcatgccaggcatgtgtgcgcagccataggtgtgcaagcatgtgcatccgcagggacatgaggccacaggtgtgtacaagcttgactgagcccgtctgtatgtgtgaatatataagcatgtgtagatgtgtgctcacacttgtgggacctgattggggcttcagaccttgggtgcctgtccgcagggtctcctccatccttcttgatttgcctgtcattgaggctgcccgctctgggcgccattccccagcctaacacctcttctcagtctttccttgcaggtccctggtgtccaggccttggggcagtgaagaaaccgtggggaggggcatgagatgccagtccccaaagtccttgggagcccttgtgggccaagtcattgtaggacacaccctctcctgggcattgctgaggtcacccagtgagcctaggctcccccctcctcccatccccagcctgggggaaccttcagcgtctctcctccctgtaggccccggctcagcttcccaggaacttttgttggtgggtactagtagggtaaggcagttcttcccatcatgagggagaccttgggagactttcattaccaaatccattgctgccccgaccttcctgggactgatctgggtcaccctggtctcctgatcttggagaagtcaagttcttatcccagacttgagaggttacaagcctccaggtctctggcaaagtgtggagatgatggacagccatttgtacacacaccagccagtcccttagcatatctctcttggttttgtctcaggtctgcctcagccacctccctgacgctgtcccactgtgtggatgtggtg

SEQ ID NO: 1133 - DNA, 1394 bp, Homo sapiens
tgacttggccaaggtcatacagagtcaggacagtgccaggactggaattcaggtcttctgaccccagagaccagtgagatgctgggagagaggatcacccaccttcctaataactgctcatggctttcctggacttctgtctctcaaacttgggctagtaggcgtggcctagccagggcattacattgtgagttctaagtatgatgtgtgtgtgtgcacacatgtctggaacactggggatgggtgggttacatggtcttcctgttcctccccagacttcactcccaaccagacatcaccagaaagtcctgtcccctgccttctagagcctggacctggctttgggggtgtccccatggctttgaagagtgtatggagttagcagcacagcctaggggtagcagggaaaattgagagtcccaggtgaccttcatcatacttgagaggccccctcccctttgcagttgctctagaggcatttccccaaatccacctgcatgttatggtggggagcagacagggagtgaccttgagctggtccctactctctctgggcctcggtctccctgttcttcccagagaccccttttggctctgaccactgttgccacttggccaagaactggaactggggatcagggtgtccctcggtcctctctgcaatgactggagctgtgcttcttggggctgatgaaaatagctgtcgtggtctctaggggctgagccggagttatttccatcctcaacaaagaggtggaaatagcttagggcctgggagggggagcaagaggagaagggttaacttctccttatcccagccttaaaggaggcccccagcctcagcctgtgccctggccaagccaaacctttctgggaacttgggcctctggggatgacagtggggccaggctgggtttccacttgtgaccacagttgggactggtgtgatagctgctggagggagggccctatgtctagccaaggaggggagatattgagggccagtcagcacctgcccctactcatagggtcaggcccaatctcatttcacagaaggagagattgaggttctgagaattcagggacttaccctaggactcctagaaccttcaccttccagacgcggtacctgccttctgtcctgagtttgtcattctgtgtccacactttccctggcggctggaggttggccagcactggaagcaggcccaagacacaccttctggacgtcggcctgcctcatattccagctctggccttgccatccctgcccaggctctggttctagcttctgtgcttccacgtcggctctcccgcacactgccagagtgacctccataaaataacttgcttttcgcctacaaagtgtagttcaaactcctcacctggcaatg

SEQ ID NO: 1134 - DNA, 1206 bp, Homo sapiens
ttcatgccagccaagtgcagtggctcatgcctgtaatctcagcactttgggaggccaaggcaggaggatcactttgagaccagcttgggcaacatagcaagaccctgtctgcaaaaaataaaaataaaaaattagccgggcgtggtggtgctactcgggaggctgaggcgggaggattgcttgagtccatgattttcatgctgcagtgagctgtgatcgccccactgcactccagcctgggcaacaagtgagaccctgcctaaaaaaacccatgcagatgagtgtgcgcatgcaaacactcacatacccacacgcacctcctcccgccactgagtcagtcaccccctgaggcactagattcatggccaggccacagggaggcagatcccacgtccctgtgcccagacatgtgtcctgtgtgccatctcttcaccccctgaccccagcgtgaggggagggtggggctgggtgtctggccgtcctgaggaggccttgttcaggacaatgcttcgatggccagaagggaaaacaggagggcagtgggttgacctttgcatccccagcatggcggggagtgggctcccctgggcacattggctctcctgcagcccccactgactcgggccctgggcccctgtctctctgtgtttgtgtcactctgcttttgtcctgcctccatcgtctgtgatgctcagagtgggggcggcgggcccgacgtggcgtggaggtggcagcaggggccagcagcggtggtgagacacggcagcctgggaacggcacccgggcaggtggcccagaggagacagccgcccagtacgcggtcatcgccatcgtccctgtcttctgcctcatggggctgttgggcatcctggtgtgcaacctcctcaagcggaagggctaccactgcacggcgcacaaggaggtcgggcccggccctggaggtggaggcagtggtgaggcccagctggggtccaggtgggaaggacgggggcacgagcccagccccagctccacttgggggctgccagcggaatcctgcctggcctctggggtctgagagggagaggcttgggaggtgatagctgcagactgacaacatgggaggaaaggtaaggggacgaaggtgtggccgtgggggcagagcagaggtggcacagctggtcaagtggcttcagtggatcctaccctgggtgaagccttgcccag

SEQ ID NO: 1135 - DNA, 1214 bp, Homo sapiens
ttttgaattcttctacttctacctgaccccctctcctcactggcctggggtcaagaagtttgagtctgggagctggattgcctgcaaatagtgaaagcctgaaacataatggtttgccatgttttgaaaaaaaatgcatatttaatttcttcctcatgagataggacagttgctgttctttcttacctggcaatgaccctaaaatgtatatcctctttcctgaatatttagcagagacacacacacctgtccagagcgtttttggtatgcaaagtactttgacattggttgccaaagtcctccattttatagatgaaaaaactaaggctcaggaggcttgagacttgctaaaaggtcacacagcttggaagtgattcttcaaatcctctgctctttctgctgccacctgctgggtctcttggcaagcatggagggaggggctaactgtactttatagagctgggaagcccagtctctgagctgagcagatttgtatgaactgctttgggccaggacctgtaatgagccctggggagggacccagaggcacatctaactggcagcacaaggaggatgagaatttgcaactaaaggcctcacttggacaaaacactttggggtcacaatgcccaggaccgaagacatgttcaaggacagcacgaggcatctttctattgggagacccatgtccttggtaagcctgcacacctggcttcctaatccctgagagcctgcccactgtccagatccagtgagttggtacaaaacgtacagactgaagtccctgggcttgcttttcccatgggtgaggaccagaaccagactctgagcatccttacccctggccacccgaattgttccaagtttgaggtaccccgttcccagagatctgggggtccttctttggagggcttgctttgttctgatggccttcagaaaggaatcacatgaagtataaaaggacaggccccttggtcaccaagttttggctcctcatacagataggactcatccaggttcccagcgaggcactgactaagcgaggctcagagcttccatatcaaattcctcagctttgttctgtgcccagagggggtgggccccattctgggccctgtgaactttgtcttatatatcaccatctgtatcagaattcctcctcaattgcagttaagtgaaaatacgtggaagtctgcttttccatcctgtattct

SEQ ID NO: 1136 - DNA, 1191 bp, Homo sapiens
tcctgacctcgtgatccgcctgccttggcctcccaaggtgctgggactataggcatgagccattgcacctggcctgggctgagttttaatagagtgtcttctatcattgttgttgccccttgctccctgcccgttgtgttgtctctactctactttagcccactctcatgtagctttcctttactctttgcccatagctgggtcagtggagctgtgtacacagtagacacaatgagactcagaaagaacttgatttatgacggatccctggaatctcacttggaatgaatgcagatcacattggtaaatggagaagacgggaccttatgattgcttttctgactcagtctagagttcttttttctgcttcaaagtttcctctttattaacctttggtcagttttaatttgtagataatataaaatgaatgctataaaaccaaattgtatcaaatgcttgtgtatttgatttttacaactgaaatataagacttgacttaactatttgatggtagaaagattgagactttaagaaatgtgggtttttaattaccctattaagccattagtagtttctggcaggcaattttttttttccccaggctggagtgcaatggcaccatctcgactcactgcaagctccgcctcctgggttcatgccaatctcctgcctcagcctcccgagtagctgggactacaggtgtgtgcctccacgcctggctaattttttttgtatttttagtagagatggggtttcactgtgttagccgggatggtatcgatctcctgacctcgtgatccacccaccttggcctcccaaagtgctgggattacaggcatgagtcacggtgcccggcctctggcaggcaattttaattaggattccccaaaatattttgctgattagagtctttgtagcaagcaaaaataatcacttatgcatctatgcattattttagtcaacatggatatcagcctctatgttaggttggttttgatgatacacggagatgagtaaggtgtagttgctgtcttcaaggagctccagatgcaatagagacaaggtataaacaaataagttggctgggtgcggtggctcatgcctgtaatcccagcactttgggaggccgaggtgggcggatcacaaggtcaggagtttgagaccatcctggccaacgtggtgaaacctcgt

SEQ ID NO: 1137 - DNA, 1167 bp, Homo sapiens
tgacgccagtggaaacctaacctgccccgtcgccgccgtgcgggaggagccggtagagctgtccaaaccaggaaggcgatggcgatggcggtggcgcgcacgcatgcacgcacgcacgcacgccagcggccggcggggccgcaggctcgcgcccgggctcgccccgcgccgctccagaggctcgcgcactcagcaggttgggctgcggcggcggcggcagctgtggaagctcaggcgctgcgcgtgagaggtcccagatacgtctgcggttccggctccgccaccctcagcttctcttccccaggtctgggagccgagtgcggaaggagggaacggccctagctttgggaagccagaggacacccctggctcctgccgacaccgccctccttcccttcccagccgcgggcctcgctcggtgctaggctactctgccgggaggcggcggcggctgccagtctgtggagagtcctgctgccctccagccgggctcctccaccgggccttgcaggggccgagagagctcggtgcccgcccttccgctcgcctttttcgtcagctggctggagcagcatcggtccgggaggtctctaggctgaggcggcggccgctcctctagttccacaatgtccacgggcggagacttcgggaatccgctgaggaaattcaagctggtgttcctgggggagcaaagcggtgagtgcgtggctcccctactcctggcagctggccgcagcgtccccgcaccgcccccggtgcggcccttccgtccgcggaggctccctgcccgcctcgcgtccgcgctcgttgccaccgcagcccttcccgatgtgccccccggtgccactggctcttcgccagtggccgagtttttaccctgttccccgggttcttcaatcctcgactccccggctccgttccccgcagtccggccatctccggtcgatctgccctccctccccagacctcaccccgcccagcctcttgtccatccctttcttcctccggtctcggtcattgcccgtaccccggccccctttcttgagccccacccttattccttgctcttttcccagttcctcagctctgtgaggcccactcagggaagccccactcccgagagcgggccctcttcaaccttggccaaggagggtgggatctgggcgt

SEQ ID NO: 1138 - DNA, 1155 bp, Homo sapiens
ctcctggcctcaagtgatctgcccaccttggcctcccaatgtgctgggattacaggtgtgagcctctgcgccccatcctcttgtttgttttttgagacagggtcttgctcggttgcccaggctggagtgcagtggggtgattaatggctcattgcagcctcgacctccctgactcaagcaatcctcccacctcagcctcctgagtagctggggctgactacaggcatgcacactgtgcctggctaatttttgtattttgtagagacagggtttttgccatgttacccagtctggtcttgaactcctgggctcaagtgatccacccacctcggcctccaaaagaagtcctggattacaggcatgagacattgtgcccagcctctctgtctctttaaaatcatgaaaactcgtagctacttaagtaattctcctgccttctggaatgatgggtgaagatcttgactgccttgcctgctcctccttggcagatgacctcccttgccacttcacttctgcctttggggcaggcttctgcaccactgtcatcgcctcccctgtagacgtggtcaagacgagatacatgaactctgccctgggccagtacagtagcgctggccactgtgcccttaccatgctccagaaggaggggccccgagccttctacaaagggtgagcctctggtcctccccacccagttcaggcctcttggctatgcatgtctattgtgggtgggagagaaccacctggaagtgagtagcagccaagtgtgactatttctgatcctggtcctggcatttcaccagcattcacctatccccttaattccttcctcccagaattgctaccatcactgtttattaggtgttaaatggagactcaaagggaattcatgcttatagccaagcagctgtgagctcagttcattgagtcctcccagcctcctttgggacagagcaactgggttggattgaataccaggcccagtgagggaagtgggaggtggaggtgcccccatgacctgtgatttttctcctctaggttcatgccctcctttctccgcttgggttcctggaacgtggtgatgttcgtcacctatgagcagctgaaacgagccctcatggctgcctgcacttcccgagaggctcccttctgagc

SEQ ID NO: 1139 - DNA, 1181 bp, Homo sapiens
ccacgatgccgagccctgccttggatggggaccatcagcgatgaccacaatgacctctcccttaccaggcagctccaggcagtgttcctgcaccgcctttcccagggcttgggggctttttctagtgggctttgagctgctcaatctggcctctgcagggccggctcccagcccttccaacctcctcacagcccgacctgggacctagccaattcccggagagtctctgtcccatcgtgaccccctcacaactctcccactcaccaaagtctgatgactgtgctagggggtgcttatatagagtactgagtgttacaaaagcagaagtctggatgagaaccaatttgtgatattaagcaggtggggtgggggtggggagtgtacctaggttcattttccgccctgcttttcccctttccagtgtgtgcacttaaccagtccctgggccctgttccccatccccctccaaggcatggattgggtgggcttgtgtgtcttggggcaggtggccctttctaaactctctgcctttgctcacccacaggacacatagtatgaccattaggtgtttcgtctcccacccattttctatggaaaaccaaggggatcgggccatgatagccactggcagctttgaagaacgggacacctttagagaagcttgatcttggaggcctcaccgtgagaccttacaaagccgggtaagagtccagtccaaggaagaggtctcttgctgcctcctaaccctgtggtctaggggcaggagtcagcagggcattaacaaaaataattaccatccccacccccgacagtgaagtggctctttccagttcacagagcactctcacacctccccgctctcattctggcccttcagctgactcggacaagccaaggatcttggtccccattttataaaggagaaaactgaggcccacgtgtaacagtgattggccccaagtcatcccgggagccagcagaagagctaggacaggaacctattgttctaacttcatattgatgctagcttttgactatccctgaaaccgagattggtaatcagcccggctctgaaactggttatttgctggggactgtaaaataggattaactatttctagtcctgcattttaattgctgttagtagggccatcttacccaccctctgaaggacctgactt

SEQ ID NO: 1140 - DNA, 1247 bp, Homo sapiens
ggaaatgccatcagaggcaggaagacccctaaacagtcctgtcttccacacactgcattcaccctcttaaaggcatttttgtgcatgactgctgctgctcagcaccctttgagagctccctgtgggcagaggagtggggtcactggagtgtggctccccactgtcttcagaataaagctctgacccctcagcctcgtgttccaaattgggacctggctacatctccagtctcctttctcagtgcccccaaaactaccctccacccctgttcaatcccaaacacctgtgctttcctgcagctttgactttgcttaacctgtcccctccttggaaatatactttctcccctccctctcccccattttcaaatagctatatgttgttatttctctatgactgtgccccaccctgccccagtaggggtgctctttgtctcctgtgaactccttccgtactctctagtcctctgctaaagcactgactgccttctacactggttaagatcttgggtttttgatgtgaagacaatctggctgtgacatctgtcacctcaatgatcacagggttgatttggccggtctggctggctaggcgggtgtccccttcctccctcaccactccagtgcatccctcctgaagctgcatgcttggtcaaagaggatgaccttcctgatacaggaggaccatccctctgtcaagggtatatgaggagctatgctcccctactagaacctccaaacaagctctaaagatcttgggtcttggagatttataaatctagtttgtggccctgactccagtactgtgtgaccttgaaaaagttccttaacctctctgagcttccatttcctccttgtattttcaaggaaatttggggacataaggaagggaaagtatttggagcagtgtctgggcagtgcagagtaacagataagagtgcaggctccttcttgaaaggggaaatgggtgaaaaaaaaaaaaaggagtgcaggctctgaactacagtgcatgggtttgaaaccacactccgcgttcactcactggcagtatgatcttgggtagcattactaaactcttctttgcctcagtttcctcaactgtacaatttggataataatagtgtggcagacagaccctagtatggcacccataatgttcacaccctgtattatccccagtttttgagtgtgaacaagacctgtgatttgcttctgaccgctggaacacggcaaaggtgaagagatttt

SEQ ID NO: 1141 - DNA, 1192 bp, Homo sapiens
taccagccaaggggggcagtttcaggaagggacatggggagagaggatgaggaggtaggattgacaagaggctgctccttttggcagttagttaccacggtgggcctggtttcagtcacaaagctacccccatccttaggagagagctcaggccctcatatcaaatgaacactaaggcaggtttctgagtaactcacatattccccactcactttctcctcagttatcaaggcattacaggataagtacgtgtatcaaagtttaacatcgttcagaattgccagtaaagcccctcagttcccacctctttcagttcagtaagaggaaactgcaaggacttttcgagagtgcggctgatgaccgcataataaagaataactaataaatattaatgaagtatcccctctggccaatcaggtctgaggagaaccctctttgggctcacagaagcctcgcccctcatgaatatgtagatagcactgcccaccgcgcgtactgccccgccctccactcttctccctcgcaaccgactctcccttcaaacgggaaacaagatggcggctgcaggtccgagtactcgggcctcttccgcggcggcagcagccgctctgagtcggcggggccggcggggccgctgtgacgagacggcggcagctaagactggggccccaggcccggcttctggaccttcgctgttggtgttgtcgccgccgttgctgcagccgccgctgccgccgcggccggaggaatcgggctgcgccgggtgcctggagccccccggagaagcagcggccctgccgtgcggccactcgctttgccgaggctgcgcccaacgcgccgccgacgcggcgggcccgggttgccctcgctgccgcgcccgcggcccaggctgggcccgccgtcgggcccgcgacgacggccaggccgactcagaggtgctgggcgagtgcgcccgccgcagccaacccgagcgctgccgcccgcgccgggacgggggcgcggctgccgcggggcccaggccagagcaggagccgcgtgccgcgcctgcggagccaggtggagcttccccacttccccttagggtctggagcgaggccgagcgcgccccggcccggcctggtgagggggtggagagtcccgggccctactcgggcgggtgtggagagttctcgtgggattagaacccgggctc

SEQ ID NO: 1142 - DNA, 1278 bp, Homo sapiens
gtaactggcattagccccatttttagatgatgaaactgcagtgcagatgttctggttctctcaactaccaagtggcataacccatggattttctaaaggtttcccaaatagatcacaacctaagggtgtgccaggggagcctaggggaagctaggctgggcattgaacactgatagtgcagaatccacatgcaaacaagatcgacagggtggataaacatatatgtgcattatccccatcccccacagtttagagccttctgcttttctgggggtttcagcctatgagacaaactataatcaggcttcattattacttttcaaatggccaagggttatctgcaatgttgatctaaaatcctaaaaaatcaccctgaagtcaggcaaggaacaatacttaaactccatactatggaaacaaggtatctagctggatgcagctggtaaattcagtcccatggacctttgggggtttattttccttagcagctgacaccatgtgtcttttgcatccctggtggtgcttggtgcttctgcccatctgggctcattgagaatagggatgaagatatgattttagggaatttctgatgggctggcatgccccatgtagtatgagttactatataaagtcatgtgactggcattttaacagaccttccagagcttatatatcccaatatatgttgtttcctttgagtagccccagcaggatactgcttagtttttccagtgccattggtgaaagcatttctggaactgtcttcaaagactagaaacactgactcccaaaatgctagaactggaagggaccttaatggttatctattccagcctcctcctaaggtcctcctcagcttctagacctagaagccaaagtccagaacagtgacccattgatcaaggcagatagtataactccttttaagtgttctcagatttgccttttctcagggcaaatcttcagtgttttgtggttatttgtggttgagagagagagagaatgtaatgtctgagactagccagcagctatttgaagcctctgggaaagaaggtggcttatcaagtgggtttgtagtaatgagtgctgctgtaaagcagagccattttcttgtgcagctcatagttcccaaacagttcccaaacagaaattccagagatgtcttaaacattgtggtcatcattgagataggtggaatctctttggtgactacgttggtggggaacatcactcacctgaatgtatgcattctgtgttctctgtgtgtgtgcacatatg

SEQ ID NO: 1143 - DNA, 1239 bp, Homo sapiens
ctggggctctgaggattgggcaccctcccctcatctaagaatatatttcatacccctgcccccccttcacccacccccgcctctggctcaggcccttcccttcctcggctcaggcatggggctcagctcctagtctgtccctcccatcccagggacaagcacagcccatctagccttagtgtggagccaactctcagcctttcccaccagggcgctgacctcccgatactcagtgctggtccccagtctcagactctcagctcttcaccccgatctgactttcgtcctcctgcccaagcctttggctcttgaccccccccccatacccaatgctggcactcagcacccacccctgccattcactagtcaaggtccagtgaggaatccgtccctgggatgtcctcatccccttttcgtcccaggacgagctcttcagtcctgccggataggtgcaggtgccatgcacccctagtgcatactggcagatccttgtagggaaggagagagtcttgggtgtgtgaaagggatagtggggcatcgtggcctcagagaggggcaggaagtggggtctgaagggctggaagttgctgcccttcgatttctctatgctctctcccacccctgtggctcttcgcccttggggattccttgccaccaccgctaccaccaccacctcaccccgtgtatcttctgaaagagaagtaggtctttcctcctgcctcaggcacaagccctcctggttcagggtcagaagctcagcaccttgccttctccatgatcccaaagcacaattggtgagtgggggagaggaccccctctccctgactccccaccctctagatcaggcagaatggctggcctgtgctgcgtctgcacacaggaagtcaccttcctttaatatattggcttgaggcctgcctgccctccccatacccagaaaatctggatctcccttgagcagttttctataaagtctgcaataatctcagatactctactcttgttagtggtgccgtatcattcctgctgaccttggagtactgatgggggtgggaggggactcttgggagggcattttggacttctttttggtggggcagtgacccttgatgcgttctcccagactgtgggaggagaaatgggttctgattgcacatagcaggattaaggttagatacatggagggacttcccattgggatgacattgttccccaagccagcctgctttctatcatcgg

SEQ ID NO: 1144 - DNA, 1346 bp, Homo sapiens
agcaccccttgccccttggccagaggtgccctgctgcacggccatacgctgcagcctcgagggacacacaggccaaagtgtttccttcagcctcttcctggagaggaagccgcaggtcatgtttccaagcttctggtcaactccaggcaccacctcccagcccccaaacatggccgagccagtgcttctctgcagggcccctttcctttctggagtcagcctgcccaggtgataccttgaagtgaaactaggggtgggggagcctcactaggccccaggcaccatcccacagtactggcggtttctctgccaagtgtttggggcctgcactggccaagccatccgtcactgggactttgcagtgtgccctgtgggtggcgtgtggacaccggtccgggcaggaaggaaaagcatgccccggtgaaaacccaccgagcagagagccagcgggacctcctcagcattccacccaggggaagagttcagtccccatgaagataaggactgagttatttggctgcacctctcctcagcctcaaagctcagacctgctagagtgggttcacctggctgttggttctgtgggagagttcctgacaagctggttcctacatggtgcagtgaaaggaactctgtcctggaagtccccaatgccgcctctcagtcctgcctgtcaccaaccacctggggggcttgggcaagctactcaacctctggggctcaatttccctaactgtaaaatgggattgtaatcccttccctgcctgacgcaggaattgttatgaggcccagatgagatgaaagtcagcggtcagggctctgtaagttgaaaatggctggatgtgtgtggccctgccactgcagggatggcccaaggtcacacagaaagtttgctgcaggaggagccctccccaccagtcttcatcgcttgccctgcttctcacttaggcagatgtcaaccagaatgagatacagccaatttggctttgatgacccagctgagagggaaatttagatacaattcaggaatatcatgcccaaaaatagtggtcccagcaaccaggacacagagggaagacctggatattgtcagtgattggtggagggggacatcttggaccctcctaggcctggtgtcacatctcccatctctcagaccccacagaggccaaggggccttggctctgacccaggttaaagagagccaccagcccccaggctcagggagctgaaaccacccatccgcagaaatctaagggcaaggagaaatagaaattgtctgttccttcccttcaaagtgtaaggcctcttccaggagcaactggagccaccacagcttctcagtg

SEQ ID NO: 1145 - DNA, 1081 bp, Homo sapiens
agagtatttcaagggaccacaaagtgggtaattgtggagtgtaaatgtggttctcagttttggttatacatgagaatcacccagggagcatttttaaatagatattcctggactttgcacatttaattggcctagagtagggcctagatgtcagggtttcttttgttttttattttagccttctgaggtgattccagtatgcagccagggttggaaagtacatatttaggagcttgacatacttgatgaatattaccctaaggttcggaatgataggtgtggaagagaattggtattcttggggccggactctggtcaaattattctccattaaaggaacattgaaaaccaagtctttgttttgttttttaaacttggtggaggtccttggcaataacacagtggctctcttctgttcttttaaagggcctgctatggtgtgctgcggttcatcatggagagtggggccaaaggctgcgaggttgtggtgtctgggaaactccgaggacagagggctaaatccatgaagtttgtggatggcctgatgatccacagcggagaccctgttaactactacgttgacactgctgtgcgccacgtgttgctcagacagggtgagcagctgagagtgcttggcaaagggcatttgtggacagatttggttttccacagacatcttaagtatttgggggagtttatcatggaagtagctgggcatgttcatattccttggtgtatcgattgccacgttgatctgtaagaatcgatttgctgagatctgtcagatccaagagttggtttgtccttgttttagccatctgtgtacccttcagtgatgacacgatgacgagtcagaaaggtcacgtcctgctcttggtccttgtcagtgccatgttctgtggtgctgtgcacgagttcctttggcagaagtgtcctatttattgatcgatttagaggcatttgtctgagaagggtccagacccaggggtgcttgagtaaactgcttgctctctttggtcttgtgtgatgggggcctttgagaccccagctgtgtgctaacaactgtggtgtcctctaggtg

SEQ ID NO: 1146 - DNA, 1081 bp, Homo sapiens; identical to SEQ ID NO: 1145

SEQ ID NO: 1147 - DNA, 1162 bp, Homo sapiens
gttcctgcttttactcgtgtatatgaaatagttttcccttatcctcccttatttgctcaaaatttttggctcagtgcaacctctgcctcccatgttcaagcaattctcctgtctcagcctcccgagtagctgggattataggcacctgccaccaagcccagctaatttttgtgtttttagtagagacggggtttcaccttgttggccaggctggtctcagactcctgacctcaggtgagccactgtgcttggctgctcaagattttctaggcacttttgctattctgtcctttagcagcccctgtaaaacactaacaagcctcctgtggtcaacacttggggtttttttgtttataggtgttgtctctccaggtgccttgtattttttttttttatatgaaaaaggacaaacccttatgtatgcattttattaatgttgctgcaaaccctaagtgggagtgtgtatccatttggtaaatcaggaacttaataactctggtaaagtttcttacttttgtgctttatttggtttcagggtctccttggcagctgtattctggagtctggatgttgctctctaaagacctttaataaaattttgtacaaagacacaaggtctgactagactgttcagtattcagactgaggggcatgttggcctctggagcattacatatcttcttggttttaaccatacttgtggtatttgcaagggccagaacagtaagacccaagcagagccaaccagagaaataatatttgtgtgatagagaaggctgatagcaagcaaggcagcaccttgattcgttgtcctgtagttcaggattgtaggtttagaagagggatatgtttgagtttttcctatgcataaggcgatccacgttgcacatagaaagtgaatataaatggccattatattttgtgtcatgctgtgctctaagtgttctttacatatgtactcgttaatcaacctctctaaagtgtaaaggaaatttgcttgcaccactgaaggcacataaggctcagaagtaaatttgcctaagcagtataaagctatcattagaatccacattcctaagttgtgttctcttaggggatcatggaaccagtcattggtactacaggctattatgttctggagaactgtgaagaacatttaaat

SEQ ID NO: 1148 - DNA, 1123 bp, Homo sapiens
aggcgtccctcgcctcgctcccactaatccttctgtgtagccctcgtccgcggcctgcgcaccctcccctccggccctggactgacacatcgcttttggggtcgatgcactgtgtccaacattcggcctgaattgattaagcacttgctgtatgccgagcctgaggcagccactgtccgggcgctggaggggggaagcatggatcagggattccaaggcgggggcgggtcccgccggtggttgagggttcgcggggacaggagttgaggggcagggaggaaagggtttctgggtagcatgggggcgccgtacgttcttaggagcaaagtcgggagacattagcaggcctgaatccctgcgtgtccagggagaacgcgtggatttctatgcacagaagccacgcccccacccaactctttcccgcaagcgctggcccacacgcttgccgctgtcatcgcctctagtaaattcgaggagaccttgctcagcagatggctcgttggtctaggggtatgattctcggtttgggtccgagaggtcccgggttcaaatcccggacgagcccctcttttcttaatttttttaactgtttagcacgcgtaacttggcgttctacagtcgtaatgaacacgaaatgggacctggcacattcgaagaggtcggatcgtcgattgaaaacgagcaagcggtttttgcaccctggctgctatctaaagaattcttccagctcgataagttctgtatttagagaacggagatgcaggaaaaggaaggagatgcggaaaaaggaagggaaagaaaatgagggctcgtccgggatttgaacccgggacctctcgcaccctaagcgagaatcatacccctagaccaacgagccgtcgctcgtaagagttttcgtttcgctttgtaagtagaataggaggcaccctagagcctgcgccttcccgtcccggccgcacaggacccaccaatggcgtgtgcgcttagggctcgcctcggattaccaatccggtatccgcacagtgggaccccgagactggctctgtcgccggcgagccctggatctggacgcagcgagaacgcaatcagtccgcgctgcagaggggaaatgtgcctttctgca

SEQ ID NO: 1149 - DNA, 1241 bp, Homo sapiens
tatacaatcaaattactgtatttaaaagtcacgtgaaattcttttctctgtagtcaagcattataggttaatttatttctgtttttttttttgtttttgttttttgttttttttggattgtcattttgaaaatttttgctaaattttatttataattatataacatatttatgtagttccaaaatcaaatccacaaaatcaggtatgttctgagaagtctgtttatctatgactccaacagtctgttctgtcctccctgataggtaatctttttaatttttatttctcctttcattttttagcatataagcaaatatgtatttattatattttacttttttcttagataaatgtaatatgttatacaaactgttgtgcactttaatgtttggaaggagtaatttttaatttggtggttataagtctggtgctggtaatacagaaagaggtaatagctgaaatgtggtttgtgtgtatagaaggaaatagtttatcttagatgactgcttcttcatagttgattcatcttcctttttcctccagattttgtacttaacagactagaagctgtaattagcttttattgttatctctcaaatccattctcaaatgggctattatttcttagattgattccactttttattctgcctgtttcttagattaattgttgctactgttttttttcttttactttggtgagaaaaatttgctctcatcttgttctttttatgttattttatggatttcatgaattatttacccaatgttgtgacactcttctgctgaccttttattttccctccttgacccatcttcaacctaacaagttacttccaattacgttgtttccacaaatactcctgctgtctgcactttatatactttctttaggctggccctgaatgcagtttctgttttccattcccatttcacaaaataccttccctgtgaaatccccccttatcagttcaacatggttcccatttagtatctaaaagcatttaaaagttatttaaaacctaacaatattagtaggtcagatagtttaggagaacaatagagaacaaagcgctaccagtaatcccaccactataccacaatagcactttctattttctatattattacctttttacccatgtgaataatttttttttttttttttttttgagactgagtctcgctctgttgcccacgctggagtgcagtggtgcgatcttggctcactgcaatctctg

SEQ ID NO: 1150 - DNA, 1127 bp, Homo sapiens
ggttccgttttctaaagctaataagtcagccttcttaatgattgataaatttagaaatataactgaactttgcaaattaaacatcaaatggaatttttaaaaaatgagaatccaccaaaaagggataattttacatagttgatctactgaaaatttcataccatgacatcaccacagtcttaaaacttgtactgttacgtagcaacttccatttctgcaagttgcaaaattaataatataaatatagagacgttctttgccgagagtcgtcggggtttcctgcttcaacagtgcttggacggaacccggtgctcgtcccccaccccagccggccgcccatagccagccctccctcacctcttcacggcaccctcagaccgccccaaggcccctgccgccgccccagcgccacgcagccactgccaccgccgccacctctccttagtcgccgccatgaggaccacgtccacctcacaggtgcgccagaactaccaccaggactcagaggccgccatcaaccgccagatcaacctagagctctgtgcctcctacgtttacctgtccatgtcttactgctttgaccgtgatgatgtggctttgaagaactttgccaaatactttcttcaccaatctcatgaggagagggagcatgctgagaaactgatgaagctgcagaaccaacgaggtggccgaatcttccttcaggatatcaaaaaaccagactgtgatgactgggagagcgggctgaatgtgatggagtgtgcattacatttggaaaaaaatgtgaatcagtcactactggaactgcacaaattggccactgacaaaaatgacccccatttgtgtgacttcattgagacacattacctgaatgagcaggtgaaagccatcaaagaattggatgaccatgtgaccaacttgcacaagatgggagcactcgaatctggcttggcagaatatctctttgacaagcacaccctgggagacagtgataatgaaagctaagcctcggctaatttccccgtagccgtggggtgacttccctggtcaccaaggcagtgcatgcatgttggggtttcctttaccttttctataagttgtaccaaaacatccacctaagttctttg

SEQ ID NO: 1151 - DNA, 1412 bp, Homo sapiens
tgtgttcagcaggtgcagtggctcatgcctataatcccagcattttgcggggctgaggcgggaggattgcttgaagacaggagtttaagacgagactgggcaaaaaagtaagaccccccaatctccacacaaaaaaaattaaaattagccaggtgtagtggtgtgtatctctagttccagctactcaggaggctgaggcaggaggatcccttggacacagaagtttgaggtcacagtgagctgaccatgccactgcactccagcccaggcaacagacagagaccttgtctcaaaaaaaagaaaaaaaaaattcccagcattctcagcaaaactgtccttggtgaaaggccttcactcctctgtgaaatggttgctggaagccttctttcatttgtctactccaaaagtggagcttagaaacctgtggcccaagtaggtcagaggaaggaaatggccagtatgaatgatcatcaggtagaatacagtaacctagattaggcttacaagagttaataatcgcgaaggcccgcggcgggtgttgatgccatgtgatttctgcccagtgctctgaatgtcaaagtgaagaaattcaatgaagcacgggtaaacggcgggagtaactatgactctcttaaggtagccaaatgccttgtcatctaattagtgacgcacatgaatggatgaacgagattcccactgtccctacctactatccagcgaaaccacagccaagggaatgggcttggcggaatcagcagggaaagaagaccctgttgagcttgactctagtctggcagggtgaagagacacgagaggtgtagaataggtgggaggcgcccggcgagggggcggggcagggtccgcaggccttgctaagaaactcactcaaaaccgctcaactacatggaaactgaacaacctgctcctgaatgactactgggtacataacgaaatgaaggcagacataaagatattctttgaaaccaacgagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaattaatgaatccaccaccaaaaatcctcaataaaatactggcaaaccaaatccagcagcacatcagaaagcttatccaccatgatcaagtgggcttcatccctgggatgcaaggctggttcaacatacgaaaatcaataaatgtaatccatcatataaacagaaccaaagacaaaaaccac

SEQ ID NO: 1152 - DNA, 1396 bp, Homo sapiens
cttttttttttcttttttttttttgtttgtttgttcatttattgagacaggatctcactctcgcccaggccagaatgcagtggcatgaacatggctcactgtggcctccacctcctggactcaaacgatcctcctgcctcagcctcccaagtagctggacctataggcacaggccatcacacctagctattttaaaggattttttgtagagataaattttcaccatgtttcccaggctggtcttgaactcctaagtttaagcagtcctcccaggaagtgctaggattacagacctgagccactgtgcccagcctcaatgtaacatttttaatgaaactgttattatcacctattagagaaatatgtagcagcaaatatgtgtcagtctgtggacaagacagaggcacacaaaactttattttccgtaagagctcactgaatatttaaatacttaaaattaatcatgtgaattctatttgcattctcttaatcttgaattgcagagcttttactcaagtgtttacctttggtccgaccttccgagctgaaaattctcagagccggaggcacctggcagagttttatatgatagaagcagagatttcttttgttgacagccttcaagatcttatgcaggtaggtacacaagttttaaaataccaggtatctgtgacattaaaatgtttctgtatatatttttacctcggacgtttatgtgttacaggtattcataaagtgaaaagaaggggtaactacttaataaacacttattgaatgcctttactgtaatagtttaaaatacaagagtcagacagatttaagtttatatcccagctctgccattagctttgctatgaagttccctgactttcatgatctttaggttcctcaactctaaaatgagaataattgtgcttactcctaaggttatgtgaggggtaaatgaaattgtatatataatataatgcatatagcatggggtctggaacacaagcaggttcactaaatagtagctctgatttgctaggaaaatataccaaacatctttataattatataaatgtctgtaatacttacataaacccctatgtagctatattagaaagcatccacaggagctatcagctcagttgagcaggggacaaggctggagagatggtcatggtcaggcaacagatcatgaaagaccttgtatttcagtgccatagtaaggagtttgaactttacccaaaatttaaggagcaagagttctaaattggaaaatgaaggtcagagctatattttaggcacatctttttagcagcaatatgaacaatgatttagaggtagataaaagtagagaggccttgttaggaggctgtagacataatccagacagtgcacacaagtggaattg

SEQ ID NO: 1153 - DNA, 1225 bp, Homo sapiens
gctctgtcacccaggctggagtgcactggcgcgatcttggctcactgcaacctccgcctcgtgggttcaagcgattctcctgcctcagcctccccagtaactgggactacaaacgagcgccaacactcccggctaatttttgtattttcggtagagacagggtttcaccatgttggccaggctggtctcaaactcccgacctcaagtgatccgtccttctcggcctcccaaagtgctgagatttctgtgcccaacctggaaattactgttgatttagaatcaccaaagaggagatgccttctgggcagcgcagtgagatgaaaccagaaagaagggcgcaccccacatcctgagaaaggcaccaagatatgtgccctgttatttattgttgggccagagggcagggctctgggaggaaatacctggaattgccaatattgggaggattgattatatgaattaggctcatcaacatgaaggaatgttaggcatccattcgaaatgttgtgcattattacgaaaacaaaagatagaataccaaagtgtgtatcctattgtgattggaacatataaaattaagtatgcatattggtgaactaaaagaagttgatttgttgaggcaggattgtgagtacatgttttactttcatttagtctgtgtgtgtatgtgtaatgaaaacgtaaaatgttttacgctcacattggaaatatttctcttccttagggatggattcgttctgtccgatcccagaaggaagtcttgttcctgcatgtaaatgatgggtcatctttggaaagccttcaggttgttgcagattcaggccttgacagtaggtgagttttgttttttaaaagaattctttgatttttgtttttcacctctagtgcttctcacttccctactccagtgtttacgttggacccctgagtaatcttttgaaacagatctgctttaatagctttgaggatcaactccgaatatttggaatcaagatccttcaagctcaggcctttcctcctctatttgacattgtcacatgctgatatcccctacttatgcttcacttcagtctttcttaattacctgcggctcccttaagctgttctgctctttcctaatagcatttgtacatgttgctgcctctgcccaatacagcctcttctcctcttgtctttcatagttcctgcttagttaggcatcatctgatgttcccatcccatgatt

SEQ ID NO: 1154 - DNA, 1197 bp, Homo sapiens
gcacattatatttttcatgtataatatatcttaaaaatagttctatccatctaaatataaataggtgtatatatgtgtataataccttggaaattggtgtattacttttcatacttgcatatgttttaaaagacatttgactttttcatcgattcataataattgtacatatttatggagaacatgtgatattttgaaacatgcatgcaatatgtgatgatcaaatcagggtatttaggataattcatcacgtcatttatcatttatttgtgttgagaacatttcagatcttctagctattttgaaatataaactcaatgggctgagtgcagtggctcacacctataatcccagcactttgggaggctgaggagggtggatcacttgaggccaagagttcaagaccagcctggccaacatggcaaaaccccatctctactaaaaataaaaaaattagctaggcgtggtggtgggtgcctgtagtcccagctactcaggaggctgaggcaggagaattgctcgagggaggcagagaatgcagtgagctgagatcatgcctctgcactccagtctgggcaactgagtgagactctgtctcaaaaaacagaaaagaaaagaaatctacacgaaattatggtttactgtagccaccctactgtgctatgaagcactggaatttattacttctatctaaccgtatgtttgtatccattaaccagcctctcttcaccccaacctccaatgcttcccagactctagtaactattgttctactttctgcctccatgagatcatttttttggctcctacatatgaatgagaacatgagacatttgtttttctgggcctggtttattttacttaacataatgatctccagttccatccacattgctgctaaatgacaggatttcattcttttttatgactgaatagtattccattgtgtatatataccacattttctttacctgttcatctgtggatggagagataagttgatttcatgttttggctattgtgaatagtgctgcaatacacatgggggtgcaggcattcctttgatatgctgatttctttttctttggagaaatacccagtagtgggattgctggatcatatggtaattctatttttagttttgttgttgagaaacctccatactgttgtcaaagcaaactaaatatggtctgagaa

SEQ ID NO: 1155 - DNA, 1388 bp, Homo sapiens
catatatgtgtaggcatatgaatattttgcaccttcatggtacccatttcgtgatgtaactctcaggattatacatgagtcatgtttagcttcaaatactgtataatgactaatggatctcaacatgctggcctgacacctggccatagttgttatatagctagttcccatcacgatcatctagggtgcctttttaaaatgtagattctaagtcacacccctcacctacagaaatagaatctcctcaggtggattcaggaatctgtatttttagaattgattcagacagagttaaacaactagtgattgcaaacttctgaattaagcaaaaacagtagaaaacaggtggttggggcctcttggccagctgggttagacattctagatacacttaaagagtgtcactactcagagtatgtcccctgagtggtggcggcagcagcacctgggagcttgttagaaatgctgaatctcgctccgccagaccgccgccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaaaaaaaaaaaaaaaaaaaaaaaaaaaaaaaaaaagaaatgccgactctcaagccccaccccagacctactggatctggacctgcattttaacaaggactccagctgctttgtaggcacgttgaagattgaaaagcactagaacatgcttaacaacaaatcacaaggggatccaaccctggggtcaggtgggttgcaaattgctcattggccatttgttagacagttgacacatacgtacaactcagttggtactagaccaggcgcttatatacattatcttacttaatcatcctaaaaaccctacatggtaggccctgttatcctcattttttaggtgagaaatccaaggctcacagagttatagtaactcaccaaaggccattcagcttttaataagcagagctgggatttgaacctgaaattgtctctccaaagcacacgctcattccactgcagcatattgcttaaaatgaagagcaaatcaaaggcgcagccaaatttaggaaaactcatatgggcaattagctgaaaaatggag

SEQ ID NO: 1156 - DNA, 1208 bp, Homo sapiens
ggagtattcaacctaaaagaaaaggatgctaattaataagtaacgcaaaaacaactaaaagcataaaactcaatggtaaaagaaagcagacaatcaaatccagaatactctaactgcaatggtgatatgtaaatcacttataactttagtatgaaggttaaaagacaatctattaagaataataggccaggcgtggtggctcacacctataatcccagaactttgggatgccaaggcaggtagatcacttgaggtcaggagttcaagaccagcctggccaacatggtgaaaccctgtctctactaaaaatacaaaaattagccaggcatggtggagggcacctgtaatcccagctactcaggaggctgaggcaggagaatcacttgaacccaggatgcagaggttgcagtgagccaaaaaaaaaaaaaaaagaataataatagctacaatactttattaaggtatatacaatataaaaagatgcaaattggcccgggtcttccaggagtcgggttgcttgggaatgcagcccaaagcgggtggtaaactccatttaaggctaaataccggcacgagaccgatagtcaacaagtaccgtaagggaaagttgaaaagaactttgaagagagagtacaagagggcgtgaaaccgttaagaggtaaatgggtcaggtccgcgcagtccgcccggaggattcaacccggtggcggatctttcccgccccccgttcctcccgacccctccacccgccctccctctcccaccgcccctcctcctcctccctaggcattaccattcaggacataggcatgggcaaagacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatattcgcaacctactcatctgacaaagggctaatatccagaatctacaatgaactcaaacaaatttacaagaaaaaaacaaacaaccccatcaaaaagtgggcgaaggacatcaacagacacttctcaaaagaagacatttatgcagccaaaaaacacatgaaaaaatgctcaccatcactggccatcagagaaatgcaaatcaaaaccacaatgagataccacctcacgccagttagaatggctatcatt

SEQ ID NO: 1157 - DNA, 1178 bp, Homo sapiens
aaatgttttattttgttatttggttatgaaaatggaatccttgttcttgcacaactgtaaatgttttgttgctagataatacgatttgagacctgaattggtctttggtttccagtgcatcacagcatattttgtaaaatcatctactactgcacttgagcatgaatgggtagtagccaaactcacaaattggagtgatgaacctgcttatacctaagggcaggagcaagcccctcacaatgcagctgcatgggtttttagtgcctactgaattatatatatatatacatatatatatatatatataaaccaaaagtagttggaaagattatttgaaatgactaatttgtgctatctttatgaaatatgttaaatgtagcttttttgaaacagaagccttgaattgaaatttaactaatacttgaacattttgtatatatttctttgtatataattttgtgcagtaccaatgacaaaaatatggtgtcataataaaaccaggtttgttgatcttttagttatgggctcaaagaatttattcatctctaacatgatattggaaaataatggatgaaaataggaaaaatgattgttaatgctgactgtgggtcttaaaaggttctggaaagcagtaagttcatttttctaaaaactataacattctgttggagtattttcttccttacgtcaatacttttcctgcattatttgaaattgtgggctggggagaaacagtagtcaaagctttctgaattgagatactttgaaattccaagtgtagatttttagaatgtcattttataaatggcagtttttggaattacttgataagaacttttgaaaatggaaggattagtatggcctatttttaaagctgctttgttaggttccttatgttttattaactgtcttttctcagtttccatttcatttttttttttctagttttggtgacttagtgattttgtcattttttacatcaacttcatggtcttgtttttacatggtaattgcatgtacttaggatctatctaataggggctttaaataaatttggtcatatttatgtgtaagcacattttactgtaaatgtttgggtttctgaatttaaacagatctgtttatttcagtatgtagtaaacaatatcttaaagtgtccgattcactacttgttaatt

SEQ ID NO: 1158 - DNA, 1115 bp, Homo sapiens
gcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgctggccctcatgaggcatagcctgaccaagctgctggcagcctcgggcagcaactccccaacccgcagtgagagcccggagccggctgcaacttgttcgctgccctctgacctgacccgggctgcagcgggggaggaggagacggcggcggccggatctcccggccgcaagcagcagtttggcgacgaaggagagttggaagccgggagggggagccgcggcggcgtggccgtgcgcgcgccctcccccgaggagatggaggaggaggcgatcgccagcctcccgggggaagagacggaggatatggactttctgtctgggctggaactggcggatctcctggaccccaggcaaccggactggcacctggaccccgggcttagctcgccggggcctctctcctcgtctggcggaggctcggatagcggcggcctgtggagaggggacgatgacgatgaggccgcggctgctgaaatgcagcgcttctctgacctgctgcaaaggctgttaaacggtatcggaggctgcagcagcagcagtgacagtggcagcgccgaaaagaggcggagaaagtccccaggaggaggcggcggtggcggcagcggtaacgacaacaaccaggcggcgacaaagagtccccggaaggcggcggcggccgctgcccgccttaatcgactgaagaagaaggagtacgtgatggggctggagagtcgagtccggggtctggcagccgagaaccaggagctgcgggccgagaatcgggagctgggcaaacgcgtacaggcactgcaggaggagagtcgctacctacgggcagtcttagccaacgagactggactggctcgcttgctgagccggctgagcggcgtgggactgcggctgaccacctcgctcttcagagactcgcccgccggtgaccacgactacgctctgccggtgggaaagcagaa

SEQ ID NO: 1159 - DNA, 1220 bp, Homo sapiens
gaagccagggggaagcaggttactgtttttgcatttctatcttcaaggaagaattaggttatgaatagttccgtgaatagtcaggaagcgctgtcctccaagttcaagattaaggaaacgtggcatgcacagctaaagcaagaggtgacgtcttgtatcttcccccgtttcctgggacattggtggtgtagcccattccacagactttcgctccctagcagcgggtcggagatcgaaggaacgggccaattgcggctgaaacgtctttggaaggaggaagggggtgagggagcatccctttgagtttcgcctcttctcgaggcggtggtgggaagggagacatacttaatactgccctcttaatccaacggaccttacatcgtgtagactgccgggagggcggcgggaaaagggcaagacgggagttggggaagggaaggagccaggaagccgcgcgggagggcgcgcgcgcgcgcccctttttcagcagtgtggcggggtcgcacgcacgcccgcctcggcggctgggcgcgatttgcgacagtggggggggcggtggaggtggcggcggcagcggcaactttgcggcaagctcgggccgggcttgcttgacggcggtgtggcggaggccccgccccaggcggcaggaacctggagggaggcggaggaatatgtccgagagggaagtgtcgactgcgccggcgggaacagacatgcctgcggccaagaagcagaagctgagcagtgacgagaacagcaatccagacctctctggagacgagaatgtaagtgcagcttctggcagttacgagactgcggagtgaaagttttaaattcttttaaaacggggggcgcggggacgagcgggctgctgtggggggagggagaggtgtcactcaggaaaacgcgggcgtgcgggagaaaattgaaattgcctacggggattttgatgtggggccgagagcaagcaggaactaggcaaaggagagtggttctagtgattgcgtgggtctgagaagtctgccctgaaatcagtttgcatgtgatggggagtgttttggcctttggggggatttaaggggagagtgcgggtctgagattctagtagtttaaaaggcacgttagagacttttctaagaaagttggaaggacggggcagagttagggaccctgttaaaggagcgtaagggttgtcactctaagacccttgtggaattttc

SEQ ID NO: 1160 - DNA, 1159 bp, Homo sapiens
ctggctctgggaaatatctcatatagttctcttaatggctctatgagataggtaatattatcctcatttgataaataaaggaaactgagaagccagagggtttgcatagccagcaggtttggatccagggaatgcctgaatgaatgtggccggctgttactgaaaggagtgttacccattagttgttactgtagccgccttaatgagagttagtgagagacttaactaaggcaggggcagtaggttggagaggaatttgaaagataaattgcatctgtaataatttaagggaataatttaatatgtggggtaagggaaacaaagttgaggatgacgcctgtcaaacataagtggataggtggttgttgatgctattaacctaggaaaatagaggagagagaacaagttcatggggctaggggagacagataatgagtttgattttgaatatgtttattttgaggtagtgtggtacatttaaatagagtatggatggagaagggaaacttctattcataataactgaagtgaccaactaggaatttcatacaaaaattccaaatttgaatttcaggaagatacttggaaaattctactcatggactcctggctttggtgccgctctgccagcatcttatgtggccattctcattgaaagaaaaagcaggtaaaatttcatatatttatttaacggaactgattacctgtcccctaccccaactataatttttttttttttaattatcacttacagggatgagaaatatttctagatatattttttcggttctgcagatatttaattgaaaattaattttatattaatgtttatatgtattttatatttattgtctataaaaatataaaagtggacattatagagcagtaatagcctctgtttactaaaagattagagagttctataatgtgacctaactaaaatatggctatgcaaattctaggccaggcagctcattcctgtaatcccagcaccttgggaggctgaggcgggtggctcacttgagccttggaatttgagaccagcctggccagcattggaaaaccctgtctctacgaaaaaaaatacaaagaatattagctggatgtgatgatgtactcttgtagtccctgctactcaggaagctgaggtgggaggatc

SEQ ID NO: 1161 - DNA, 1180 bp, Homo sapiens
ctccttctagtaatcattttcacatagtagaatacttcactcagctgaaaatgagtggccaagaaaaaaatacaagaaaaggaataagaagtgattattttctttagggctgcactttgaatgtgatgagtaataaggttaccttcattgtggaggtgatgtttacaattgcctccagccctttactattggtgctgaagccaccattggtgccagctctataatttcttcttcttgtggaattaacaaagaaaggagtgtcaaggactgagatgaccctcagattggggggctgtcttagattctagggctttgtagtactatgtttctgtttaaagtagtggcctcaggtgactttgtaatagccctgtagttgcaaaaagggtaactacaaagaaatgaaactgactctagtgtgtgtgacttctggaaacagaagtggggcagtaagttggccatgatatagctagtgtcataggactacagcagagtagtgagtgaatggccttaagcttacagctgtggtgaataagaatgtgtgctattttacacacagaagaaaatgattgacttttggttggaggaaagaatttatatctggtcttttggaaattattctgttgctgttttatgtgggctctctctctctccctctctctctctctctgtctgtctctcttgctgctccctctccctgccaccttgtccattctctgcttgctggtgttactttatgttaactagtctccttggacttcattgcaaccttttaagccagccgttcaagtgagaggctctggagtgatcataacggtgataacaatggagtaaacatttccagagacactgattttttttttatatgctctgtttttcttaggcaggatgatgtagaagataattgcacagatatggaaggagatgtttctctgtatgtgaagcctttaaatccagaacaattaatttcttctcttcttaaaaccccgtaacatcacttgactctggaatttcctattttcttttactttctccattttttttccatctgtccctcctacgaatatgttttacatgaaataatgtattgggttttatcttttgtcccagcagacctgaaaatcccagtatattaccacagacacacataccatctggtcaccaacagggacatcagggccaa

SEQ ID NO: 1162 - DNA, 1207 bp, Homo sapiens
ttcagaaagaataggctgtaaaatgtttctttatcagacttaaagtcggttgatgttaatgccagagaggtataatgaggcatgtctgacccccacttcccatcatggcctgaaccagtctttcaggttaaattttaagggtgccctggctgacgaggaagtccattcagatggttaggggaccttagaattttacttttggcttacatttggtttacatgtatgtgtctttctaggttggaattgtggcttattcacttttgtatcaatactgctatgcatatttatgttcgtatgtatatgtacaggtatatgtctccagaagtatggtagtttgagatacttaaatgcttgttaaaaaacacaaaaacacgtttgttgcttcaacaaggctctctcttttgattctttacacataaactctaaggtagacagaacaagggtaacacattcctttgaaaagataaccaacaacaaaagtgacagcgaaatagaagaagtgatttgtttaatgtcttcaggccacaaagagacacaggcagaaccagaactcaaatctctgcattgggccattctccgtgaccacttcttattacagtggcttgtcctctggttatttccattgtccttccagacaactgtggtcatgggaaactgaatctgggcatggccatagaacctgaaaggtatataatttctcactagcaaagagtctagtccatctgggagacatttgcatcacactagcaccagggaactttttaccaaagtgaagcatgggttttctccattatgagccagtaggtgtcacaatttacccaagatgagcacaaccaggtctgtatggcagcctctgacatgtccaaggtattctacctgaagggctgatgtggactgtcctctcatccttcattgattatctggtcaactggcagatggttgaccccctccacccatcctgagaggtatggcaggtggggacaaattatttcaaagctttggtcaattcaatttctttctttttttttttttcgtagctcccgtatttatttatttatttatttattgctttttttttttccttttttttaaattatactttaaattttagggtacatgtgcggacaaaaaaccaaacaccgcatgttctcactcataggtgggaattgaaccatgagaacacatggacacaggaaggggaattcaa

SEQ ID NO: 1163 - DNA, 1174 bp, Homo sapiens
agtaacaaatttcaccaggaataaataaataacccatatatccttgtatctactttacttagtttatttttatcttaaaggtatgttgaattttgtcaattgttatttctgcatttaatgaaataatcttatggcttttcttattcagtccagtaatagtatagaaatttactggttgattgatttcaaatagtaaacaaaacttgaattttttttttttttcttttttgagttggagtctcactctgtcattctggcttgagtgcagtattgccatctgggctcactgcaacctctgcttcctggttctcctgccttagcctcctgagtagctgggattacagggatgcaccaccatgcctggctaatttttgtatttttagtagagatagggtttcaccatgttggccaggctgatctccaactcgtgacctcaggtgatccactggcctcagcctcccaaagtgctgggattacaggtgtgagccactacgccaggccccaaaccttgaattctatagtaatcccttatttgttcatgatatattttcctttcttaaaatacatttctgatttgacttgctcatttttttaaattattaatattaatctttttttaagagtatcttgttttgctgctagaacaatgctggcctcaaaaaataaatgagatgtgttatctgatatactaatttcagagtttcaggataaatatgaagaaaaactctagctcttcacggtcaaatgattaagaaaacaaaggtaaagggaaaatcttgaagtcaatcaaagagaaaagaaacaatttctaccaggaagcagatatgaaatagcagacttggcttctgaaacgaggccagacagaagacaataaagttgcttatttgacatatggaaagcaaacacagaaacagcaactcaccacctacaatgatgccctgtgaaaacatcttgcaaataagaaagcaatgtgcttctcagacgacaaaaactgagataaattattgccagccaatttgcatgaaaagagatgttacagcaagatctggcaaactgagcatgatatcagatgaacttctgaaggaaaacacacagacacactcatgtacatgcatagacacactcatgcacatgcatagacacacaaaggcatttggacacagtaataatgtgg

SEQ ID NO: 1164 - DNA, 1197 bp, Homo sapiens
gcatatccatgattatttccttttttccatagctacctacacaatttcataaactcatgacccagtgtaatcctgagtccttgaaatgtttctaaaagtgattcaccctttcagtgaaataggaatagataggacttccatttccaggatttttcttagccagaagtgtcccctggaggcttgggcagaattacagatatcttgagattaaaggaaaaaaaggagccacattggctgcttccatctgcttcagagcaaaacttgctattcctgtgtgttaggtaatcccaagtggtttttacattctggtatctcaaaggtatgattaaaggattagtgtggaaggaaaacagcagacattagtgcagcagagttgaaaaaagccaatactttggtactatcgtgggatttcatcagcagcaaaatgaggacaggagaattagaccataagtgattttgttaaaacactaggggaatccaatcaaggtgctttagctattaagatccctgattacaggggttatatctgttccaatttgctttgtgaggtgcccacataggcaatagagacaaggaccatgtttttaagaagtactaagacgctgttactttggaaaaactactgaatactcagtgcatatctaatgagcagttttagttttaaatttctagaaagaatgcttggcaatagttgaattaacatttgccaggtatctaactgagaatataagttaggagccataggtattagtgaaacatggagaatagatggttttcattcaggaatgtgtcatagttgtgacaaacaccaacaactaagaagttagtagcaaaataagaactcataaaaatgtgtgtaattaatattaaaaaatactactctagccttatttatatgtcaggctctgatataagcactttccatgcaaaatcgcatttaatcctcataaccaccttatgaaaatgttatagatgagaaaaaaaagacttagaaagattaataacttgctcaaacatccaaactagtagatgtcagagccgggatttgaaatcagctttgattaattcaagtgaagttcaaatttcatctaatttcagagccattctcataagagctctttatgattgcctactgagaagaagaaattatgagagctaagacagaaactaaattttgttgagtgtctatcctgtgcc

SEQ ID NO: 1165 - DNA, 1228 bp, Homo sapiens
ccttattagccagattgtgtcctctatcactgcttccctgagatttgatggagccctgaatgttgacctgacagaattccagaccaacctggtaccctactcccacatccacttccctctggcgacatatgcccctgtcatttctgctgagaaagcctaccatgaacagctttctgtagcagagatcaccaatgcttcctttgagccagccaaccagatggtgaaatgtgaccctcgccatggtaaatacatggcttgctgcctattgtgccatggtgatgtggttcccaaagatgccaatgctgccattgccaccatcaagaccaagcgtagcatccagtttgtagattggtgccccactggcttcaaggttggcatcaactaccagtctcccactgtggtgcctggtggagacctggccatggtacagagtgcatgctgagcaacaccacagccattgctgaggcctgggctcgcctggaccacaagtttgacctgatgtatgccaagcgtgcctttgttcactggtacgtgggtgaggggatggaggaaggcgagttttcagaggcccgtgaagacatggctgcccttgagaaggattatgaggaggttggtgtggattctgttgaaggagagggtgaggaagaaagagaggaatactaatccattccttttggccctgcagcatgtcgtgctcccagaatttcagcttcagcttagctgacagacattaaagctttctggttagattttcatttggtgatcatgtcttttccatgtgtacctgtaatgtttttccatcatgtctcaaagtacagtcattaacataaaaaaaaaagtttatgttatattttagatcatttgttggcatttcaacaatgttcacagcatcttcactaagagtcgattttgtctcaagaaaccacttttttttcccatccagaggaagaagcttctcatccattcaagtttcattatgagattgcagcaattcagtcacatcttcaggctccacttctaattgtagttcacttgctatttccacatctgcagttacttcctctaataatgtcttgaatactcaaagtcatcaacttcttcaaactcctgttatggttgacattttgaccttctctcataaatcactaatgctcttaatgacatcttagaatggttaattatttcccaaagtttttcaacttgttttgtcaagatccatcagaagatt

SEQ ID NO: 1166 - DNA, 1242 bp, Homo sapiens
tccacaatgtctttgagcttctggttgtgtaatgctggggtttaaagtcaccatttgtgggtttggcatcaattaatatttagccagctggctaagagataggaaaagaatatgatatttctttccttatgtaataatgaaaagcaataattacaagtaggtaataatacacaaaggccataattagtctcttctagtgtttagaatgcacttgagaatcgtagagtcatttggagcgtgtttggaccaattagtatgtactgtagtacccttctggcaaacaaataactgaattgctactatttaacaatcttatgagcccacactactgcattttgggagtggcaaatgtgtttggaaatggaagcagttctttttaagcactgtatcagagagattgtcttgtacgtttgcctgttgcaaacaggctggtttgtaaaagatgtatgttttggtgtttgaaatgtttataaaattgtatataaatggtttcaattttccaggcttttgtagatactatatttgatgcctatcaggatgctttaatttggggggtcgaatataattgtaagtcatccacgctgttggtctgcaaacttttgaggtaactacacacacacacacacacacaaggattttagatttgaaaatgatgttttttactcatttcaaaatgtactgtaacctttctttggttcttactgttttcatttaactttctctgttttcaagaaaaattgtctttattgacatttgtaaaaaagaatgtgttttgcccagttattaagtattttatttttatgcaatttcagaatcacaatgaggtatgccatttcttcatatacatgcacattcacctcaacttgcacacacatcacacaccaaaccttatgcaaaggggaaagctaacacttagagtggattttgtcccttaaggaaatggattgttcctgcatatattgctggtggcagtattcagtcttgtgttctttttctaaaaaaaaagaaaagaaaagaaaaaaaaaacaaaagcaaacaaaaaaaaagacagccaaaaaaaagaaacaacaacaacaaaaaaaaacacaacagtgtacaggtttgtaactgccaaaatttgatggttaaaacaagttttcaagtaaaaagaaaaaaatgaaactagcaattgtgttgactctttttaagtgtttccttttctttgtctttagttcattgctcgcatggtatttagaggtgtat

SEQ ID NO: 1167 - DNA, 1169 bp, Homo sapiens
aattagaacaagatcattttcaggtagcgagacaaaatcactttccacaaagacaggtggaaacaacagaaacattacgcgcttcagatattttaaccaatcaagctttagaatcacaagaacatctaaggcaattctctcagactgaaacacaacagagagactataaattggtccccaaagattctgagacactttcaagggctttgtcacatgacaggcagctaatatcacaggatgctagaaaaatatctgaaacatttggggcaacaacttttcaaagtttagaatcccaacaattgttctcagagaatagtgaaaatatatcttaccatttaactgaaccttcttcatttgtaccactggtacctcagcattcttttagttctctgcctgttaaagttgagtcaggaaaaattcaagaacccttttcagccatgagcaaaagtacagtttccacaagccattctataatcagccaaatgcatgataggcctttgctgccgtcagagaatatcacagcccagcaaggtaatatgaaggccctccaagaacagttagacctacagaagaaagttcttcaggcaactcaggaagctcaggaacagttgcttttgtgcaaacagaaagaagtggaacagcaaacgggcctctcggtattccttcccttggtaactccagattcatctgctttattgccttctgccaaagcagatttggggagaatccaggaatcttcaccaaccaagaataatattgcagtttcctcagaccatcatgtgatctcacaacttcaggataagcgtttgagtctttcacagcctatcctatcacagcaaaataattttaaatttctccaagagcagttgaatattcagaaggatagccttcaggctaggcgagaagcccaggaagtattgtatgtacataaacagagtgaattggatagaagagtatgttccgaacaggctgagccctctttcccatttcaggtagctcagcatacatttacttcactaccatctgctgatacaaaatctggaaaaatacaggagcaacattcatctaagagcgagaaaggacttgtttcatgccaatctgacatccccatatctcaggatgggtctttgagtttcctacagcagttcctacctctacatgatagtttg

SEQ ID NO: 1168 - DNA, 1238 bp, Homo sapiens
cttttacatagacaaagagatttgggggacagtaagtctgggctggtgagctcttcatcctcaccagtggttgttcagcattcagttgcttcacaagcttctgctaaagctgagcctaggagaattcaggagctttatttatctgagaaggagaatgtaggtccctcctgtcatttgataatcccaacatttcaggataagtctcttagttttccacagcatagcctggcacagcaagaaaatttgacaatactccaagaacagtcacaaatacaaagggtaatacttggtgctaaagaaggaactcaggaatttgtacacacagaaagtgaattggagaaaagaatttcttctgaacagactggcacctcctcatccctttcccaggtggatgaatctgagagattccaggaatgtatatcaatcaagagtgacagtaccattcccttaagccatcctaagatcccaagatgtcaggaaagacttttgagagtttcacaacatatgctacctctacaagataatttggaggaacaccaagcatggctagacactgagaaagaagcctttcatttcagccagaaaacccaagaaaatacatcttctgaacaaactggttcatcttcattcataccccagttggtacagctttcatttacttcgttagcttcagctgagtctggcacaatcctggaacctctttttacagagagtgaaagtaaaattttttcaagccaccttcagatcccacaattgcaggataggcttttgaggatatcgcaacttatccagcctcaacaagataatttgaaggcacttcaagaacagttagctacacagagagaagccatcattctagctagacaagaagctcgggaagaattacttttacatcagagtgaatgggagggaagaatatctcccgagcaggttgacacctcttccttacccctagtaccacagcattcattcgcctcattacctcttaatgaatctgaaagaaaccaagaaccatgttcaattaacagtgataatatagtatcctcaggtcactcagagataccaacattgcctgatgggctgttgggtttatcacatcttgttttacctcaacaagataatttgattgcacttgaagaacacttgcatgcacagacagatttccttccttctattgagaaaacccagaaagaattggttttgtcaaaaccatgtaaatttgaggaaaaggtatcttc

SEQ ID NO: 1169 - DNA, 1354 bp, Homo sapiens
tatattgtgctgactagtgaatgtttttaacaaatacggtgaattttttctttgatctaagacaagacaactttaagaagcaaaatgagaaagtagattgtaggaaagcagggaatggtgtcctgtggtgctaagaatttgatttgtcttatcccaactatatttttctcccatcttgaactccaaaatccatttttcagttaagctgaaggaatctgttgttgaaaatcatgcagtgttaagttatgctgtggaggaagaacatgcatatttgggtccaactgtgaagccagatgataaggttagtaatgtcttaatgttcactcgatttttagagctgtttggcttcgtattctcttttgtttagtttacagaagctatgttataacattaaagtcagtgctttctgagatctgcttttagtgaagtggatcaatgatgaaactagccaaatctgagcatcagaagtctttccagtctacctgatgcatgatctctacagttctgagaagcaaaactataaaacaatgtaaaacaataagggcatatgtctggtgtgtgtgtgtgtgtgtgtgtgtgtgtgtgtgtgtacgcacatgtgtttataaagataacagctgtaggaatgaatgagattgagggtgggggggtgcgtatgtatgtctatgaaagcctaatcatttctgggcaatgatgaaaaggttttactactgatctttgtaactatgatggtttctacacttgacctgagctcagaagtgacaactgctggggttggtgatttggggttttcttacatactacttgctacattgtggtatgatattccccttaatttctaggctaaaacactgtcttatgaaccattatcttcagcaactgtttccactgggagccttttaagttatgaaaacacagatttgagccttacagatccaggtaataaggtcaaaatgtttataaataagttgaaagaccggcaccagttgagttgcaatacagtgatggaaggaagcattgggttttcatgatacaccatggggaactatttctctaaatctcacaagtaaagtatggccaggcgtggtgcctcacgcctgtaatcccagcaccttgaggtgggaggatcgcttgagcccaaaagtttgagaccatcctgggcaacgtggtagaaccctatctctacaaaaaaatacaaaagttagccaggtgtggtggtaagtgcctgtagtcccagctactcaggaggctgaggtgaggggatcgcttgagcctgggaggtcaaggctgcaatgagccacaatcacgccactgcactccagcctgagcaacatagtgaaaccctgtctcaaaa

SEQ ID NO: 1170 - DNA, 1354 bp, Homo sapiens; identical to SEQ ID NO: 1169

SEQ ID NO: 1171 - DNA, 4146 bp, Homo sapiens
gagccaagaattaaaatttgctgaaatcttcgaattgggaaaacaacatcctctgttgcaatactgaagttcataacaacagttagactttaaacttaaatcttaagtttaaatctttttcctttggttcatgtaaaggagctacttgatgttactttttatttatcattcctctggctcctaagcacaacgtgattgtgaaattattgtttttgtgattaacgtagtaggaagtttctgcagttggcaatattgtaagagcatattgcagtttctgctcataatttctttcctatggagtgttagactttgttatttatgtgtataaatactagctggacacagtggtgcctgtggtccccagctactctggaggctaaggcaggagaaacacttgagcccagcggtttgaggctacagtgagatgtgatcctgccacatctcactgtagcctcgaacccctgggctcaagtgattcagcaagaatcacacgatttttaaaagacatggcagatcctgtgtctttaaaaaaaaatcaaaaccttgtaaatagtggttgaggtctatcccgatggggcttttcctgtagcctgcacatcgttggaaacgcctcatagagtaactctgtggttttactttactcacaggactattgttagatctgtgggaaggaattacaagacagttgctaaaagtttgaaaaagacggttgctaaacgttatgaaaaaccagataatctacttttttaccttaggtattggcatactccacacatctgtaccattcttgagtgatcgcttaggtaagttttaattggtgacagtataatcttttgggaaataatgattacagttcagatgatgaatttaactgttcaactgctgaatgataacgggcatgaactaaaacttaattctgacagagctggatatggctgtataataaactggatcttaaatttatacttgggttttagttttaataactggaaatgtatcctttctaaatctttaattggtactttctataggaatgaatgtgatttgaactcattcatgttgagaggtaagtaaaatatttaacttataataatcaaggactcaaaagatgaaaaatagaaattacaccatcccagtatttcaggtataacacagaattagtaagatactggcaaaaatattacaatgtatatatttgtatagagaaggaaaatgaagagactgcatgtctatacctaccaaacgaaactacctgtgttctttgcatcattattcaactggcagttacacatatttcatcctaaagtcacgtaaacctgtgtggatatgttgaatcaatagggatatgaattacataaaaagaattttgtgtaactggcagtttgagcaacaatgagcttgacgtttgttgtctgatctgttaagttacatgtatatattccatctttaagttttatagagagactgggcaaagattaggcaaagactagagttgtagcttaaaatgtagttaatgtagcttccttattacagtgacaattaggaaaaaagctcaaattattgtacttgttaaaggaatttgagaggtttgtgaaagcatttctcagcaatattgcaaatttgggaatacgagttgtacagttcagtcataattgcactgcatggtatctgcactcagcagtttacacctgctagggtgttcaaaggtcagtgctatagaaattcagtatctggcatcgttggttttcttggctttgtgcttgttaaacctggtatttctactgatacagtatttgtgtaggtttctcagagtgttcagtttgatatactctaaaatagtaagcaatgcttttttttccagggtgtcaaattgagaaccaggtagatccccaccacctacagtaaaaaggtaagattctctgtttctattgattctgcttgtttccctctatcagtagcactgccagcataacaagaacttcgtacaaatacactactaagctttaaagacttttacaatgcctcattctagagaatgggcactgttgatcatggtgtccaaaaatagttaatgtggctaaattgagacaggttatgcttccatcacagtatgcatattgcagtggtgacaatgagacctgtaacattttgctatgtttatgagtaaaaatgtaggagaaaaatgttgacttttcaatattagaaataacatttaataaggaattttcagctcttataggaccactttttttatgtgctgtatattgactgaaacattgtaatgtggtatacattactgtgtcttggatcaggtgtcaaaatgtaactgtactttgtacaattcaacttctaggaccctaaagtaaattggttgaagaaattagatcccaaagattcttggtaagttaattcattacttaaaaggccatgcaggttattttgttgaatactagcttttctccaaatgttattttaggttatttatttatctagcaatgctattgcaacatctatcaccacttaggagtaaaaaaaaggactaggcttacgttattatgtgtttaaacttcattattaacgatgttatgatgatgggcgaaatgttcaactgctctgaaggggctgaatgaaaatggcctttctgaacatccatttacattaaatattgcattgtatttcagaagattataaaagctcaaaggtaaaagttaccagaaacatgatcatagagcaaattcggatatgaatgggcatgggatcattgatttttaaaaatacctattagtttaaatagctattttaagcatagaattttcaataccttacttggggtgccgggtttcaggatactttggaacctaagcaacctcattcttgaaagatagatttatgtacttaatagtaaatataaatttgaaatacacatttttccacaggtgaattttgaagtcttcatcagtatatccatattaaaacgagatgacagaagccaaagtaattatggcaagtaatggtttttatcttaactataagttatttgctcaagggtgtaatggtcattaccaaggcttttagaatgcagtttctcatttgctgtggacatgaccataaaaaaatttcccagtaggttttctatctgctactttgctagcaatcagcttattgggaacagttgattaactgtaatagaaatgcaatacaaataaaatgtgaaccacatgtgatttttctttaaaatcagtgagatttgaaaattctcctagatctcttgaatcatgcaaatttgctttgcctttatattgtaacccttgtgggttgctaataaccaagcagtttgtagtagagttaactcaggctcgttctagggactcattcatgttcactcactgtacactcatctctggaaatgtaaaatttacttttatactattgttatgtagggctgacaggacaactggatcagtttcattaaaaaggtatgtatgcattagaaaagacatttgtatgggtcatttcaaagagggcttatgaggctgtgaaacccagagctcttaacgctgtgaccaaagatggaagttctctataggaagccatagcactcctaatgtttggtgctatgttttcctgaggagatataaaacgtaataatccaggattgttgccatgtgagagttttaaaggttaatcaaaatttctcttcttcagggcaaacttgaagataaatcttttgactccagctctttagaggatctaaagtgaccttgatggacagtggaagaaatcacaacatggaattcctcgaataacaatttattgactttaaataattttgtctaatgctacatatacacaattaaaaaacctttacactatttctagaaagtcagcatgtatttttggctcgaagtttctctagtgttttctgtggaaggaataaaaatttgagtttcagttgtgtacttcatgcttgaaaaattaagtccttctccctcagttatactcaccttatggaattcttttgcccttgctctgttttgggcataagcttcttgttttgttttttcttccttttgttgtttcacttcagctagttgattgtataacctgtaaagaatttatatagaattagagacaaacactgcaaaa

SEQ ID NO: 1172 - DNA, 4146 bp, Homo sapiens; identical to SEQ ID NO: 1171

SEQ ID NO: 1173 - DNA, 4146 bp, Homo sapiens; identical to SEQ ID NO: 1171

SEQ ID NO: 1174 - DNA, 4146 bp, Homo sapiens; identical to SEQ ID NO: 1171

SEQ ID NO: 1175 - DNA, 4146 bp, Homo sapiens; identical to SEQ ID NO: 1171

SEQ ID NO: 1176 - DNA, 4146 bp, Homo sapiens; identical to SEQ ID NO: 1171

SEQ ID NO: 1177 - DNA, 4146 bp, Homo sapiens; identical to SEQ ID NO: 1171

SEQ ID NO: 1178 - DNA, 4146 bp, Homo sapiens; identical to SEQ ID NO: 1171

SEQ ID NO: 1179 - DNA, 1130 bp, Homo sapiens
tgtcagatgcttagtattgtaataacctcatttccctttccaaatttagagtatctttaatactattttttttagacagagtctcgatctgtcacccaggctgtagtgcaatggccgcagtcttggcttactgcaacctccatctcccgggttcaagcgattctgcctcagcctccttagtagctgggattacaggcgttagccagcacacccagctagtttttgtttttttagtagagacaggctttcaccatggtctcgaactcctgacctcaggcgatccgcctgccttggcctcccaaaatgctgggattataggtgtgagccatggcacctggcctaatactacttttaactaccattttcactttttattagttcaagaaaaggcatacacatttattcaacatgtatacctggggagaaccagtcattaccccgatgttcattattttgatcaccacgatagagctgactactctgctatgtagtgcattttgggactgcacttatgtatgtttttgtttaacgtggacaaagacttacagataggtgcaaaaaataaatcctcttttgcaacccagaactcattgttcagtatgagttttgatacatataagaagggatattatgatacctgagacagttgattgatgggagtattgatagccataaaggttggttccaggccaggtgcaatgggtcaagcctgcaatccccacaccaaggtgggagtattgcttgaaaccaggagttcaagaccagcctaggcaagaaagtaagaaacacatctccacaaaaatttaaaaattagctgggtactggggcatgtgcctgtagttggagttactcagaaaggggggaggctgaggcagagttggaggctgcactgagctttgatggcaccactgtactccagcctgagtaacaaagacagaccctgtctcttaagaaaaaaaggttgattccaggcctgtagaatagataaacagcatgggatatgagggaaatcctcagcagtattaattttgcattccaatttcatgttgatgatatacacaatggctttttgttttaaaggcttttatcttgagaacatggtgtctggagttaaaggtatgtctcaattt

SEQ ID NO: 1180 - DNA, 1381 bp, Homo sapiens
ttgtagagacggagtttcaccacgttgcccaggttggtcttgagctcctgggctcaagcgatccgcccgcctcgacctcccaaagtgctgtgttacacaggcctgagccacccagaccaacctgtttttcttttttcttttagctcacaagaaggaatctttttctttttttttttttttttttttggtatgttgtatactctctaccatggggatgaagacacaagaattatgatagttcattgaaaaaggttgagaattcagaacttgtcagtttccaccaataatggcaaagatacaatatgacaaagttcagttgcttaaatgaatctaggaatgaagaatctaggaattataatggagaggtgattaggagtttaaaatggtttattgattggagatccttttcctggtttatatagggcacactttgctttaggaattccccctttgatcttggaaaacggcttttaattgtacattaatactgtattggtaattgtacgttaaaatatgtggctaatgataaaactacattttttacttatattgaaagatgcttttgttggaagggacggtacttttttggaatcttgttgcgttgaatacatttagagggtaacaactgaaagaacctgtgaatagaatttctggatttctttttaaagaaactgatctgaaatggataagaagcttaaccttggtaaatgatttcgcctgaaatcattggcatagtctgaccacgttcaacactgtagtagatactgtcaatatttagggaagctttgtcatatttactaaatttcataatttcagaaaactgtttaaaacaaagagcaattgatggataaatcaggaatagattctcttgaccatgtgacatctgatgctgtggaacttgcaaatcgaaggtgagtggattcaatcatgtttattgtatctgaattatgagaaactattgtatataatgagtgacagtaaagataattttcaggaattgggaaagaaggaaaactagatttcactgaccttccaagtttatctagttacatagattgatataatagcattgcaaatactttaaattcaaaatgtgaatatattatgggacacattcgtcgagaaaaaatgtattctttgggtcatattagcatctcttccagactacatcctccggttcggtaggctgtgtttgttttactcagacactcttagcagtgaaccgaaccatacagccttttggagctcatacattgtcttgaaagatacagtttttttgtaagctgagcatagtggtgcatgccattagtcctagctagctacttgggaggctgaggcaggagcatccctggagtttccaggagtttgaggttgcagtgag

SEQ ID NO: 1181 - DNA, 1181 bp, Homo sapiens
catagagaagttttaccagtctaaggatgaaacagagagaggaaaaggatagcagttggagtatgtaggatgctcagtgttctggtgataccagtgatgaccttgataatcttttgtcaccacctagggcatccatcagaaaaacccctacatgcaagaaccatcccagaaagcaaaagtcattcaacattttggtctcaggatctcttcacactcaaaaagtatcgatgactccaaggggctcttctttatgtggttttaatctatttaataatttttaatattgacctattaaaaattaaaactgatacttttaaagatattattaattcatttaaaaataagtaaatccatacatgtcattatagatagcacatgtttaagaaaataaccatgatttccaaacaaaacaattagtgaaaaggttagcattttgtatttttataaatctctttaatgtctggcttaaatatatgatatgtggattcttatatctgcttctacattcaatttgttgtgtgtggaacaatagtaaataaatatttggctaggcatggtggttcacgcctgtaatcccagcactttggagactgaagtgggcagatcacttgtggtcaggagttcgagaccaggctggccaacatggtgaaaccccaattctactaaaaatacaaaaatcatccaggtacggtggcacacacctgtaatctcacctactcaggaggctgaggcaggagaatcacttgaacctgggaggaaaaggttgcaatgagccaagattgtgccactgcattccagccggggcaacagaacaagattcagtctcagtaaaacaaaaaaaatagtaaataaatatttggtctttgtccccccagttcctggcacacagctcctaaaactcttggaatctctgaagtgataagtgccttttacatgttaatgagaagacttgtagctgggggaccctggagagttttaggatggggactcatcaccagaaagatcaaggataattagagggttggaactttcagtaccacactccaacccctggaaaggggacaggggctggagattgagttaatcaccaatggccaatgatttattgaatcatatctatgtgaggaaatcttcataaaaacccctaaatgaaggggtttggagagcttcaggggtggtga

SEQ ID NO: 1182 - DNA, 1197 bp, Homo sapiens
agtaagagaatgttcaaaaggggattaaagctaccaaaagtcttctctgaacccatcccccatttcccataccaaataaattagtttctccagctaggtaatcccatagcatcccagtacatcatcaacataacactgaccagactttttaatacttgctggctaattgttgggcttccttgatggactgtgagttccatgagtgcagggtccatatttgtcttgttccctactgcattcccaggggctaggataggtttagcccatggtaagtgctcaatatttgtcaaatgacagatggtaggagggagtgggcacccccagttgctttgccttcatcttctgcacccttggcctggcttccagcataagatttgggaagagcatccaagggagccaaaatcaagttatggaagacctagacccagctttgcctccaagtcacccaataagacctatggtctgacttctatatgatctggtcatttacggtctgactggggcagagggtaaggaagagatgactggaacacagcttctcatgagcaagttataaatgtgtggtatattgattacctaagcccatcaggcagagcctaggatagctggagctcacaggtttgtcacctccagccagaagtggcttcaagtatttatcccaggaggccaggtaaatattctcatgcataacataatatagagagaaataagttgggaagcactgtattggatgaatacagatatggtccccggcctacagcactactagtcctcgcttaggaggaactgggcatttggaggctgaaaaggactctctaacagcaaagctaacctgagaaaattgagctgcccagaaaaaaaacattagaggagagggcccatgggatctgtctgtggtgctgaatcagctcccagcaagttgagcccatctcctctcttacttggccctgacttctgctattttgatcttttctatttttactggtcttggaacaatgatgttgatgtcatctcattaggccactacaagcaatcacagcaaattcatttgtgacccagcccaaatatccactgtgccaataacattcatcacatctgaggttctctctaccctcagccagtcaggaatctgccccttcccagctgtcctcctctggactgtatgtcctgcagattaacagtttaaaatttggttac

SEQ ID NO: 1183 - DNA, 1220 bp, Homo sapiens
cttgggagtacaatggcccgacatttcttcataggtagaaacaaatacttgactcagtgatactcatgaccattagaatagtcatacctggaatgtgtcaaattataagagacagacacttggttagtggctgcctcatatagcacttttgaagaggcctaagtcaaaacttgcaatataacattctattgactttcttaaaaatattttttctgtacctaacttgagcataagggttatttgagcaagtaacattaactcagtggaaggcattgtcctgtgaaatattcttaggcagatctgcccacatctttattgaacttgaaatctaatatttctagtatttgaacaaagcagaaggttaagtcagggaagagcagtgctgtccatgatgtaatggaagctaccaggggaggcagtgtctggatgatgctgtgctacctacccctgcacaagccatgctggctcagtctgagctgtgggccacatcagctagtggctcttctcatgcatcagttaggtgggtctgggtgagagttatagtgagggaatggtcactaaagtatcctgacaagttcctaggaaaaaaggaataaagtttttttccttaaaaaaaaaaaaattgctcttggctgtgaaaagaggtactaaatgcgattcagttcaccgctaaggaaagtgatgacatagcagttacagagggtgataaatctctccagctaattcaggtcattttgtgaatactatgtatcaagccctgaaaatatggtaaataaaacgtgacagggaaacctttttttgattgaatattgttacatagttaaatgtgctatatatccttaatattttatattgatcctgcaaaatctgttggttttaggggagttttgttttttgtttctaacaattttcagacctgttggtataggaatgtagaagtctttcagatgatttgaaagcagctgcatttgctcttggaggctttgggagagcaggaatgaaaacattcagaggaagacatctgtagggaattcttctgttacttaccaaagaataagtgtctttctggtgttttatttcctatcataaaaatacaacagtgcatttacaaggttaaagattcctcgaagttctaggaaattcttgaaaatataagtggtgcttagaaaattcaagcatttaggaatgtgacctttaattcaggtatgtaaaagactttt

SEQ ID NO: 1184 - DNA, 1178 bp, Homo sapiens
tatattttttctctggtaacatatttggtaattttccttgctcatctataattattttgtaaggaataaaaactatttctgcatccagtgatttgtatcttacagaatgtgcagctctcactgctaacagaaagagggatgggtgaagcagtacaagaatttgtggacaaggaggagaaagatgccattgaggaattagtgaaataccagttggaaaaaacacagcgatttcttaaagaacgtcatattgatgccctcgaagacaaaatcgatgaggaggtaagtaactaatttgagtgtctaggtctatttaaatagtctgtctttaagagtagctctgagatttttttctggtaaatcactatttaacctctctgatttgtttagtttttctcatctataaaattgaaatgataaaatgaaggttaaattagaaaatgtagaaaatgcctagaacagagtcttgcatatggttggtactaaagtgttttgttccccatggatagtatcttctcttaaagatcctttgaaagggctttaaagtgaaccttgtaggatggtaatttttgttcattttaatttttttagtaagttttgattgagatcttgaatttcatttagaaaatttctgctaagcaagaagcagtggaaaaattacaggaaaagctgtctagacttgactacatagaaattataaatgtttgcatatcacattgtcaaaaaacaaaattaaaagatattgacatgaaaatatttgtatgtgggcagaaaaaagtttaatattcttaatattaatgagctcttagaaatcttaaaaataattaaacatttgatagaataatgaacaaaggacatgaataggtggttcataaaagaaatataaatagctaataagcatatgaaaatggtgtttagcctaggataatcaaagaaactcaaatacatcttttgtttgtcaaattggcagcaatttgagaaaaatagtatctagcacactgctggtagtagtattacgtttgaatagctttactgaaaagcagtttggcagagtatattaagaggcttaagatttaccctttaactcagcctgggaaatttccctatgaaaatagtgaggtagagatttgtgtatggagtgattcatcttagtgttgttcatagtggggaataattggaaa

SEQ ID NO: 1185 - DNA, 1219 bp, Homo sapiens
tctcactaagtttccttaggattattattttgaattcctttccaggcatttcatagattttcttttctttggggtctgttactggagaattatgttcctttggaggtgtcatattccttgaattttcatttttttgtgtgtccttatgttgacatctgcacatatagtgtaacagtcacttcttccaatttgatggagtagcttttgtaggaaaagatgttttcccatagatgtatctatagtgttggttggttggggcactttggttttggttctgggtgaacacagtagtatagtctttgtatgatttctttggctgtatccaacatcagtggtgtctgcgagctcctcagtggcttagtctgtgtttgtggaagccatcaggtaatttttctggggttggggcccctgggcaggcttatcctttcgtcccgggtggggcacacgtgggcatatagtagccctgacactgcagggggcaggatcactgctagcagtggtagctccaggcaagtggctctcgggttctgaggagcccatgctttgccttcctatatcctgtgggcagcttccctgatgtgctggaccacctgttacccaggaggtagggcactgaatgggcttagacgccagcaacacaaattcaccactgggtccagctagtgtcataatgctgcagctctttggatgagtgatagggtggatatcattggtgtcccagtggtgtggagaggcagggggctattggggctcaggtcaagatgaagtttggtggtggctcagctcttaaaattgtaccatactgtagcagcctgggtcccaaagggtgaggggcacctgatgtagattcccactctggggcaatgcagtcatgtggagtccgggaagctccctatatcaggctcagggcctgtgagggctgtggcgctctcctgtagtcaggatttcaggtgtctgtggtgggaatgtggactgctggggatctcctgcctacctttttcctgcaataagggggcagggggctctcagctccaagccagttctggctggctgctttacttcccatcctatacatctcaagtttccatgcctcagagtgtctttatctcttctttgctgaattcttagatgctgtatttaatgtgtggttatctatttgttgtttgatccttctttgtagagaaggcaagtgttgggtggtccatcagccatcttgatc

SEQ ID NO: 1186 - DNA, 1111 bp, Homo sapiens
ttaaaatagtacaccatttttagtggagggagggtgcatgcctatatgatggtaagattcttttgaactctaaggacaattcctcatggaaaaaataaatttcagtgcatattataaaaatgatttgcactgtgttagcaaaataaggtgttttaggttgtattttaaagacaattctaaatcatttctctggaaagcaagaccttaaattcttctctttaatagaactgcttttatgcaaagagatggtcttaacatggactaaacagtacataacaataatgtttgttatgtaaatagtatatcacatttgcttagtagcacaattcaacagcaggctgaaagtcgtggctcctctgctcagattgagttttaagttacctaatttatgtaatcagaatctattctaggtggccgtcaacgtaaactgtgtttccctattatatccctctggagactgagaatcaaattaaatagtctttcttcaaagcagtactgtaacatgaatgtatttatctcagtcaacagaacttatatgcccactgtatgtggagcttatttcaatgctaatttggcttagttagcagacctagaatctgcccaggtgagacctagaacaaaaatagctggggtgaaatggataagagaggtagaggtatatgtcaaggcagagccctatgaggaaggaagagttttcaaagaatatgaggaacatagtgctgagagtgtggctgccttcagcaccgtacacctaatctagagaaaatatttcccatgtgggaggtcctgtctgcattcagtccacccttttctgcctgcttcttcctccaagtgcctcaacctctacatgctcactctcctccccttccctcagcccatcttggtctaagcagctttcacaatccaaaccaaacatcaccagccacccgctgataagtcaccagcatttactttcctgagttactttttctccattcattgagactatggattcatcccaactccttctaaatccctcaaccatccagctatattttggctaacctttgccctagacactctaccagatgttaatgcagtatcaagtgtaaattgtgtcaccctattctgt

SEQ ID NO: 1187 - DNA, 1159 bp, Homo sapiens
gtgtgtgtgtgtgtatattgcttatatacacataaaaaaacctttgtgaatgtctaataagattttccaggtgtttataatggttactaaactgataacattttcacttctaggttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtcaaagtttagccgtttgtttttttttttttgttttttgcggctgtaatgtgcaatgatgtgttttattttccttgatgcttaacattactaacaattgcaaaaataatactgaggagcactactttgcattgtttgtagttggagttttggatactgatcataaatcatgaatctggcgtattaatgcttaacttcagcgcctttgggttgtgtgtatgtgtattttttctccccccaccccgcccttttttttttaagaataaggacaagtgcttacaatctgctcaagcaattgtttttcagatattggaattcagcaaagagtgacctctctggccattctaaaactttaatgttgtgtcctaaatctggtggaggaaaagcatgcgctgttgaaccaagctgctcactggacacatatttgtgtccccaggagattatttgtcaggcactgttttttatttgtttgtttgttcatttattgttgttttactgctattggcgataacatgaaatgtgatacagctattgcccataatttaatgtgaaattaatcatgatgaattctatagcatgctactgaaatgccaaattcagctattttctttctcttctaaaatggaagtttcagttttccatatcagatgtatataagtggaattataacacaatcctatcactgacagtaatcctcagtcaccttaaataatcagtgctcacagtgctgcttacagttcatttagttggcacatataaacctgtacccacacaagactgaccaaaaattttctttgcacatttttcctttctcatagtttttttctatatttcgttaagcaaaggaaggttaat

SEQ ID NO: 1188 - DNA, 1221 bp, Homo sapiens
taacctaattgatctgctcctccagaaatattttattttgttgtgtttgtgctactgagagttttattataatccagattgtgcttcatttgtgctctctctgtgccatttttttaaaaaactgaatcttgtgtgtaaatagaagaaacatttaaatatcacatcactttttatgagaagcatcattggattcatatttcttatttttcctttttattcccttctgtctttcagctccagggttccttgaaaagaaaacaggtagttaacctatctcctgccaacagcaagcgacccaatggctttgtggacaactcatttcttgatatcaaaagaattcgtgttggggagaatctctctgcaggacaaggtggcctccaaataaacaatggacaaagtcagattatgtcagggaccttgcctatgagccaagcacccctgcgaaagactaacactctgccatcccatacacattctcctggcaatggcctgtttaacatgggcttaaaggaggtaaagaaggagccaggagagactctgtcttgcagtaagcacatggatggccaaatgacccaagagaatatttttcctaataggtacggagacgaccctggagaacaactgatggatcctgagctgcaggaactgttcaatgaactgaccaacatatctgtgcctcccatgagtgaccttgaactggagaacatgatcaatgccaccataaagcaggatgacccatttaacattgacttgggtcagcaaagccagaggagcacacctaggccctccttacccatggagaaaatagtgatcaaaagtgaatactcaccgggcttgactcagggcccctcaggctctcctcagctgaggcccccatcagctggccccgcattctccatggccaactctgccctctccacttcgtctccaatcccttcagtccctcagagccaggctcagcctcagacaggctccggagcaagccgggccttgccaagctggcaggaagtatcccatgcccagcagctcaaacagatagctgctaatcgtcagcagcatgcccggatgcagcagcaccagcagcagcaccagcctaccaactggtcagccttgccctcttctgctggaccatcaccaggtccatttgggcaggagaaaatccccagcccttcttttggtcagcagacattcagcccacagagctcccccatgcctggggta

SEQ ID NO: 1189 - DNA, 1199 bp, Homo sapiens
gtatatattctatgtgagagtttgtgtgtatagagaaagacataaaagaagaggcaaaaggactgaaaaaataatatatacccataaaagagggttaaaaaatacaaactttttttttttttgagacaatgtctccctctgtcccccaggctggagtcctgtggtgtgatctcagctcactgcagccttgacctcccagcttagcctcccaagtagctgggaccacaggcgtgaaccaccacacctggctaatttttgtattgttttgtagaggcagagtttcactgtgttgcccaggctggccttgaactcctgacctcaaacgatatgcctgccttgacctcccaaagtgctaggattacaagcatgagccaccatgcctggcctaaatacaaccattcttaatactctcaaccctccatattcgtgggttctacattcctggattcaaccaatcatggataaaaaatattcataaaaaataaaaataacaataaaacaacacaacaataaaaataaggcaaatattaaggatacactataacaggctgggcacggaggctcatgcctataatccaaacactcggagaagccaaggcatttggatgacttgtggctaggagttcgaggccagcctggccaacatagtgaaacccccgtctttactaaaaatacagaaaatttagccaggcttggtggttcacacctgtaatcccagttactcaggaggctgaggcacaagagtcatttgaacctgagaggcggaggttgtagtgagccaagattgttctactgcactcaagcctgggtgacagagagagaccctgtctcaaaaaacaaaaacaaaacaaaacaaaaaccaaaaaaaccactataacaactatttacataacatttacattgtattgggtattttgaataatctagagaggatttaaaatatacaggggaatgtgtgcaggttatatacaaatactactctattttgtgtaaggtatttgagcatctgcaaattttagtgtctttagcgtttagtgagtggggtcctggaaccaatcccccacagatattgagggcaactctatatggttttctcctatttcaggaacagattaacaggaagaaagttgtcacaaaagtttgcatcgttaatgcaaaacactgatataagtaagatattcttgaatctctaggaagtt

SEQ ID NO: 1190 - DNA, 1199 bp, Homo sapiens
ctctagattcaagtatacaaaataaactgatgcattctcttggatttagtgacaatgcttctcgaaatttgtaccaagataaaatatcagaggggtgaacaaaaaatgaatggataagatgttcatctcaacattgtttaaagtactatataatggctatgttacataacttcatacagtggaacactgcggccataaaaatgatggtgaagattgtgtttattgccatggaaagctatccatgcaatattattgttgttattattttaaatagagatgtgatcttgctgtgttgcccaggctggagcacactggtgtgatcatagctaactacagcgtttaactcctggactcaagcaatcctcccacctcagcctcccgagtagctgggactacagcatgctccaccatgccctgataattataaaaatttttcagtgatagggtctcactatattgcctaggctggtctcaaactcctgggctcaagcaatcctcccgcctcagcctcctgagtagctgagactataggcatgtgctaccatgtccagctgatgcaatattattaagttaaaaatgcaggctacagctctttttcatggtggctcgaaggcgatcagctgcttcaagatgaagctgaacatcttcctggccactgcctgccagaaactcattgaagtggacaatgaacacaaacttcatactttttatgagaagtgtatggccacagaagttgctgctgatgctctgggtaaagaatggaagggttatgtggtctgaatcaacagtgggaacgacaaacaaggtttccctatgaatcagggtgtcttgacccatggccatgtccacctgctgctgaataaaaggcatgcctgttacagaccaagaagaactggaaaaagaaagcaaaaatctgcacgtggttgcattgtggatgccaatctgagcattctcaacttggttattgtaaaaaaaggagagaaggatattcctggactgactgatactatggtgccttgtcatctcgggcccaaaagagctagcagaatctgcaaacttttcagtctctctgaagatgatgatgtccaccagtgtgttgtaagaaaggctttaaacaaagaaggtaagaaacctaggaccaaagcacccacgactaagtatcttgttactccacatgttctgcagcacgaatggtggca

SEQ ID NO: 1191 - DNA, 1312 bp, Homo sapiens
aaagttttgagaggaatttttagagaggacatttcctccttcctgatttggatattccctcaaatccctcctcttactccatgctgaaggagaagtactctcagatgcattatgttaatggagagaaaaagcacagtattgtagagacaccaatattagctaatgtattttggagtgttttccattttacagtttatattccagcactcaaaactcagggtcaagttttaacaaaagaggtatgtagtcacagtaaatactaagatggcatttctatctcagagggccaaagtgaatcacaccagtttctgaaggtcctaaaaatagctcagatgtcctaatgaacatgcacctacatttaataggagtacaataaaactgttgtcagcttttgttttacagagaacgctagatattaagaattttgaaatggatcatttctacttgctgtgcattttaaccaataatctgatgaatatagaaaaaaatgatccaaaatatggatatgattggatgtatgtaacacatacatggagtatggaggaaattttctgaaaaatacatttagattagtttagtttgaaggagaggtgggctgatggctgagttgtatgttactaacttggccctgactggttgtgcaaccattgcttcatttctttgcaaaatgtagttaagatatactttattctaatgaaggccttttaaatttgtccactgcattcttggtatttcactacttcaagtcagtcagaacttcgtagaccgacctgaagtttctttttgaatacttgtttctttagcactttgaagatagaaaaaccactttttaagtactaagtcatcatttgccttgaaagtttcctctgcattgggtttgaagtagtttagttatgtctttttctctgtatgtaagtagtataatttgttactttcaaatacccgtactttgaatgtaggtttttttgttgttgttatctataaaaattgagggaaatggttatgcaaaaaaatattttgctttggaccatatttcttaagcataaaaaaaatgctcagttttgcttgcattccttgagaatgtatttatctgaagatcaaaacaaacaatccagatgtataagtactaggcagaagccaattttaaaatttccttgaataatccatgaaaggaataattcaaatacagataaacagagttggcagtatattatagtgataattttgtattttcacaaaaaaaaagttaaactcttcttttctttttattataatgaccagcttttggtatttcattgttaccaagttctat

SEQ ID NO: 1192 - DNA, 1202 bp, Homo sapiens
tgtatacacatataatgcttaggaagcatgtatgtatatatatacaaaatccttggaagctaatatatatatattaactcttttgtctcaagggcctctgttcatttttccctttattttctctttgttgttcaaattacataaactctcttgattttttctcaaatgtactcattgcatcctctgacatctccactctgctattgagtccatccagccagttttacatttctgttactgtatttttcagttctatatattccacctcattttttttataattctattttttcttgagattttctgtttttcactagtttcaagagaatttgtaactgcctgttgaagcatttttatgatggctgccttaaaatccttgtcagataattcttatgtcagattcatttcagtgttcacatctgttaccttttctcattcaagttgtgattttttttagctcttggtatcacaggtgattttcccttatattctggtcattttggatattatattatgatgcactgtataatatttaatttttatattttagaaaacagtctctttgctgagagggttgggggtgtgtgtgtgtgtgtgtgtgtgtgtgatgagtttcctgctgggccctacagtaccaaagtggagcatttgtacactgattcattgcagatgactggaatggaagtttagtgctccattttactttactgataccttgttgtgaaagtgaggcaccaacttggaggcaccttgttgcctccaagctggggtgtaagctcagcttcctactgggccctgttgactcctccctgttagggaggaggagtagaggagtggagggcagattcacaccactgtgagtggggtgggagctcagctccttgttgagcctcatgaatattaccttgtcagggggattggaacactgcatgcttttgccaagtaggtgatggaagatcagctttttacttagtcccactgaaacattagaaaggggtgattttctccttggtgttaagctacaataggatgtgtattgctaaaaatgttttctcttgttaggctgctgttttcctagccctttataggaggtttttgagtctgtgcctgtcagtggttccagattggaatcttctctagcgccctgtcctggatgtataggagataataaggaaacccaggtttgtcgtgccttaattcct

SEQ ID NO: 1193 - DNA, 1099 bp, Homo sapiens
gccgtggagcattgccaaaagaacagacacgcttcaacagagttgatgaagattttaggtcagtacaatgatgtaagacatagacacatatggtattttttttaaattaattcatattgtgaagtgcttaatacaggcaaattacttttacatgattggtatcctctgtgtattcaaattctttcctagtggatccttttgagaagctattctctcattcaagcatttacttcttgaaccattatggtgtggtctctgttattaccactctacctaataatacatacttcataaaatcactaattactttctcttttaaattcaaaaggcattttcaatttttattttactttatctctcattagtatttaatagagttgagcatttcttctttcttagaaagtctcttccattggcttctgtgatttcgtcctctcttggttttctgactgtctctctagttcaacacatagttcctagtccttagctgtctccaaatctttagatgtagtcattctccaggcctcagccttcgatttttttctcactgtattctcaggtaatcttaaccactgccagcatcagttctcttttatatgctgaggtctcctcaacttacatgtacagcccatatttctcttctgagctccaaatctaccaaacatgctcaaatagtaggctaaaactgaatccatgagcttaatttaccagttcctttccaacaaatctttcttctttctgattcctatttcaataaatggcccaacctaattgctgaaagcagagacatgatggataactttgatatctccctcttcctccacttttacatacattaagttgccaaattttgttgattctaacctgcttagtatatcttgagccaaatacctgtacagaagtatatctgtacttctattctaatgttctgtatctcttacttggactacgcacattaaccttctgacttgctcttgtataatataagtttttcacacaacagccagagtaattgtttaaaaatgcaggttcagcactttcttttactcctgtaaataaaactttaaaatagtttcccattgtgctagggataaagcat

SEQ ID NO: 1194 - DNA, 1241 bp, Homo sapiens
tttttcaatttgcatgtaaatttgaaaatgaaatgtattaattcaccctcaatttttaagaagtgaatacatctttttcacagggaaaatagttaataatgattttttaaacaactgaatacttcatagcaaccaaaaattgaaaagtgaaaattctacaaagaaaaatataaatgaaagatagcaaaatagcagcgctgttaggctcaggtgtgaaggttttgcactaagtctagagagttctagtcaatcatagttagagtagattagtttatacattaggtcaatattcagttatcagtgagggatcttaggaaggggagctctacagattgtacctgttactagtgattttggcaggaaggttaaactattcatataagcttttaattatttaatgaagattaatttctggtattagtttgattcttcttccaaatttattattaaagccagttaggaaggtttagggattactattattgaatctcatactgttatattacaacatgttagcagatctgtttttaaattttgtttgtttttttgcttttgtaggttgccatgggtcaaggtcaagctgatttagcaattcaaatgctaaaagaatgtgcccgcaatggagactggctctgtttgaagaacttacatcttgtggtatcttggctgccagttctggaaaaggtagattcagataaatgtacaaataatatctattatactcaacttagcaatctccaagggacatcagtattaaaatgtcatgcattatttatgatgatttaaaaagtaatatttgagaaattttaaatttaaatatttcataaatatgtacaattctgcaaaataagacattaataggaagtctataaaaatctttttttaaaggcatataagagaagccaagacatttttaatgaagattgacagggaagcttagaagacatatttataccatgagtttctttttttgctcttattctgttgatctgtattgggagaagagacatagtggggtgtcagagggaactgcctaacttcctaggtgctaaggaagctagagaataaactgaagcaaatgtttcgtttatctcaaatggactcaggagaaaaataatcttaagacaggacaagtcactggatgggctttacatgcaaacctagattttattctagtgcttatttaagaaagatgagtagggtcttgggtagttaaagatgattctgaagagatattcctt

SEQ ID NO: 1195 - DNA, 1208 bp, Homo sapiens
agggaagttcccctgcacatgctatctagcctcctgccatgtaagatgtcccttgctcttctgccatgattgtgaggcctctccagccatgtggaactgtgagtcaattaaacccctttcctttataaattacccagtctgggatatgtctttatcagcagcgtgagaacaggctaatacatagatcaactgtttaatgcatcttaacagattatacaatagcaaaatgttataaagagatttcagaaatcaatgacggagatgagattgttgaatcatattgaggagtcatgtttcagtgcttggttggtttatacatggtgctaacttaagttgagtaagagatacaaaataaaaatatagcatgggtaaatattaggttcaaaggagtaagagagtttaatactgtttgaggaaggaaaagaagggtctcaagaaatataattttctagaagaaatgggagtgagaggagaaagcactccaagtagagcaagtggcacaaaccaaagcaaggaggtgaaaaagttaatggagttttgcagaggataagaagtctggtttgattaaaacctttggcacgtgggatggtatggacgtggaagttggcgatgtgggtgtgatgacagtgtttcactaagatgtcattagcgttctgtgttggttctgtaccactgtgtatttatttaagctatttttttaaagtctgtaatgtaaatagactcatctatttatggcagaatagaaaggatcgattgaactgatgacaatagccctaaagatttttattgtttttttccttcatatgataacatctactgtctggtaacaaatgcaaagattttactatctaaagaccgtagtcacaagcataaaaaagactacatccttatccttttccaaggtttcttttaagggtttcattctgttttgatagatgccaggttaagatcataacaaataagcatcctctacaaaagaaaaacagcttaaactcctatctgtacagcggtctgtcattgccatttggaaggtagatgaaagaattttgtgagagacattcctctctggaccttttgtgtgctttccagatgataccctgccaaaaaggattccatgccatgggtatttgatgtgagtacacattattctctgtcacttcattgggagccatttagctcttatgaattttagcaacgggtatgtcaga

SEQ ID NO: 1196 - DNA, 1099 bp, Homo sapiens
ttccagttttacatctttgtaaaattgtatctcaaaggcagaaaaggccatttcgtctctcatttgttttatccatgaggaagatttttaacaaaagcctccagaagatttcccctcagtttccattgacttagatcaggttacagagaaaggcaatgtctgacatttttggtctctgttagaagtagactctgttgaaaagaaagaagctaagctaggtgtgaagaatggaattggaagcccactgccttcccataagaaaggtttaccataatttactcacttttttctgtgttagacattttgattatctgcagtttattactacaagcagtggcagagtgaatgtccttgtacattttgagttacatgcttaattatgtccttgagaaagtttctaaaagtggaatgattggtttgactggttcatagggctttaattatacaatttacccctctaattagtactatatgtatgtgacttccctccccctgccagaatactccttggtcaattgtaggtattctttttggtttaatttttgccaatgtaattaaaaaatggtatgtcatttttaaaatttgtatttctttcattacaaataagattgttatgtcagtattgttattggcttttcgtattcctcttaacgtgaaccgtctgttcattgtttttacctgttttcgttttagcaagtagtacttaatttaaagtgtgaacttaatatataagatgccaggaccatcatattgatgacaaaaatctattatgtggttgtagtgcatgtcttggagttaaactcttaagtatcaagaagtaaaataatttcattgtttctgttactaacattaaaagtgtgcaaattgtataaaattaggtacttcgattagtaaaagaaaaaaatttgaatgttttttttttttattttattaagcatgcccagttatgccaagcatagtaaataaaggtcaagtagcatttataatagaggaagtattgttatccctagcatgagtgtaatggtgatatgaaaaactttgtcttgtcattataataataaaaaaatgaacatttattatggaatttctatgagcctga

SEQ ID NO: 1197 - DNA, 1218 bp, Homo sapiens
atttccaatgaatagttaattagaaaagtttattataaagcagtcatttttttctaattgttaaaagtgatatattctgaccacaaaaaacttggaaataaaagcataaggatgcaggaagaaaccactataaccttatcactgagaaatataaaatgatatagtttaatattttttacattataacattataaatatttatattacaggaaataagatatgtggaacggagttatgtatcaaaacccactttgaaggtaagtaatttaaattgtgctttaaaatttccagaatttaaaggaaatgtcaataaaaatgcatatacttatgatttggatacatgtgaaagtcaaagcaggattatgtaacagttaggaatagctaactattcaaatattcagttaaagtagatgactataatagaaaaacatgtcagttagtctctgccaatgtttgttgcttccttatagtctgctacaaaacaacattccctctagaactgggcagtgttcttcttttactcacagggactcgcattgtattgtgtgtggtacaagcagagactgtatagaagatcctagaagagagggagtggaccagttgggaattagacaaggagggccattacagcatctcctaggaccttctgaagagtctctgttttgtaagggtcactaaagtgacttagttaagatcttctatcaaaatctaagcaaccattctgttatttatctctaaacttaataggagattgtggaagacaagtgtaaggagagaactgtcacagtgctgttttatagtattcaagagagcttttatcttcttttgcttaaagttcatattattgtcttactgtttaagaaattatggctctgggccgggtgcggtggctcacacctgtaatcccagcactttgggaggccgaggcaggtggatcacgaggtcaggagatcgagaccatcctggctaacacggtgaaaccccatctccactaaaaatacaaaaaattaggtgggcatggtggcaggcacctgtagtcccagctactcgggaggctgaggcaggagaatggcgtgaatccgggaggcggagcttgcagtgagttgagatcacgtgcctgcactctagcctgggcaacagagcaaaactccatctcaaaaaaaaaaaaaaaaaaaaaaaaaaaagaaaaaagaaattatggctctggctgggcacagt

SEQ ID NO: 1198 - DNA, 1207 bp, Homo sapiens
atatattcaccaaagttcttacctctaagaagtaggattaggaaacacctatctagttttgttttaatttgttttaaatgagcatgtcattggaaattttcttggagtgggggaatgctactacataaaaagtcagaaatagtcgagtgtctgctaattattttgctggtattaaatcatattattcacgctgagtacagtggcccacatctataatcccagtgctctgggaggctgaggcaagaagatcacttgagcccaagagttctggactaccctgggcaaggtagcaaccccatctctatcaaaaataataataataataaaataagctgggcatagtggtgcacttgtagtcccagctactcaagaggctgaggcaggagcatcagttgagcccaggaatttcaggttatagtgagctacagtgactctaccactgtaccactacactccagcctgagcaaaagagtgagaccctgtcttatatatatataatatgtaaatatatataaattcagttagaatcatgccttcacgccactcctttcttgcagagtgaaattcacatgtctgaagaagctatacaggacatattggaacagacagaatcagacccagcatttcaggcactctttgatctctttgactatggtaaggagactatttatttcaagacagaaaaaaaaggcttctacaatttctttggtaacttaaccagagtgaatcaacattccccagagtatctaaaaaagttcttgttttcatttcatcaaacattatatggatatgttaaaggagtgtttgttgttttgtttttagctgagaaactttagctgttaaagtggagagtagttttgttttttatttttgtggcatttttgccagtcatcagggaatgtgttgatgtctaccactatacaaatgtgttaaacacaattgaatcgtacaaagggaatacaaaaaattggccattgtcctcaatcttatgatttagtgcagtagttctcaaagtatagtcccccaaaccaacaatctcagcattatctgagaactcgttagaaaatgcaaattactgggctaaagtttaagaaacacctgtctagtgggaaaatctttgtacttgtaaatgatattaaaagcaacattttttaaacatccataaaaccctaaatcgaagtttaacatttgcgtaatcaccaacaag

SEQ ID NO: 1199 - DNA, 1221 bp, Homo sapiens
ttcagattttttaagatttgggaatatttgcatgtacataatgaggtatcttggggatgagatccaagtctaaacacaaaattcatttatattttatatataccttgttcacataccctgaaggtaattttatataatatttttaataatttgtgcatgaaacaaagtttgtatacattgaactgtcagaaagcaaaggtgtcactatcttagcgacccaagtggtggtgtcagcactcaaaaagttttggattttggggtatttcagattttagatttttgtatgaggaatgttcaacctgtatttgaacaagcattaccaaatatcattgaatattaatatcttttgcgtaaaaactgctattatcagcatcatagtttctctaaaaagaaaacttggggatcatagccgatagagagacttgctaaaatataaatcagcctctgcaaaactgtttacatatttattggtttacatattttattggtttatttctatcccctgttcactttttctcttccacttccaattatgaagagaaaatatttgttcagggttgtccccccgccccccgtcactgcataatttctcctcttacaagctgcttttggctttcattaataacagcttccttttagaaggtctgataaggatatttaaggaagaagagaatgactctgttattaaaggtggcatggagactgtggagggaatattttttaaagcactactcatatcctttaaactaaattttgccaaagcccgagacaacattaaggagaaattgtaccttaagttagtaattccaaatctatctgagttgtatacccatcaaagacaatacagttattaacatagatgaaggtatgctataggcatcattcattatctctatattgaataggtgaaagataactgtagtcaggtgaaaggcattcattatttttaagctgaaaaggggatccttgaaaacactgaaaacctctacaacaatcttcaggaagcctgctatcttgggattcactaataataggccaagaacaaaggcaagcatccattcctcactccaccacttttctatttcagtgggtgtcgttgctacgatgaagactttggaaatttcctttctcttttaggacagggtcaggatttaggactcatagcctgaaagctcattacatactccttgtaaccatcagtccaaggttcagttcactaaa

SEQ ID NO: 1200 - DNA, 1209 bp, Homo sapiens
gaaatgataaggattttcatttctttgccaatggttgtggttctgaaagtcacataagggcctacaccagaagagaaagctaatctgtggatgtcaattagagggatatccattggggtctgcaaataaaacctgattatttatcaactgacttcttcaactgcagtttcccttattattattttttaggccaaagatgaagaggaagcctttctggattggagtgatgatgatgatgatgatgatgatggatttgatccaagcacactcccagatccagataaatacagaagctctgaagattcagatagtgaagatatggaaaataaaataaggtatgtttttactatgggtatgaaatacatacttagtactctcacatcagtcttttaatgaatccaaaagacattactaagagttctactccaagagatgtttgttgcttttttttgatacctttacttagattcctggaaatcctgctgctgtttttttactcattttgctgcagattgttctggtcatgttagggcctttttgattatttctataatccctattaatagatatgagtatgatatatgagttgtgtttttcctttctctattctttttttttttttcttatctttctctgagtcctttatgcctaagtatttgatgcactaaaatctgttctctgcaaacagagttagggttttattttttttcattgtcagagaactctattaaagatactgctaaaaattgtccttgaattttaaaacgtggacattattcttccacattcttttatatggaattaaataacaaaatactggtggggctgggcgctgtggctcatgcctgtaatcccaacactttgggaggctgatatgggaggattgcttgaagccaggagtttgagaccagcctgatcaacaaagtgagaccccaaatctacaaaaacaaatttttttttaataaataaaataatggaacacttgtacagaaacaactcttgacaaattccttcactttaaagtctatttgctattatttatttgctaccattggcagaaacaaatgaaacgtgatgaataataatatgacttgctcaccatttgttttcagagtactatgtattagattacattaagagtttattgatttcaaagttgagaatgttaaacttcatgctcaatctaaaccagtgagcttctttacagaa

SEQ ID NO: 1201 - DNA, 1354 bp, Homo sapiens
ttattggatatttgatatttggttatttaatcacagtcatctttaacagcttacactgattggtgttttatctcctgtgatcctttgatggctttttttgcctaccatttcacagaggtttagacagcagtagtagctccctaggagagtttactgatgaaacagcctctgcaagattttaaaagttttgttcttttatagactgatttagaaaaacaaatgattagttaaaaaaagaaaatatacatttgttggtaactaatgttattttttaaaacctggaccttttctggaagggcagcatataaaaacatcagtcccgaggaggggacaacaatactacctcactactacatctgtgatgactggttgttcaaacacaatggagtgtgtaaggtatatgttttataattcataaccatagcctcgatcatcaagaaatactttcgaaatttcattttccttcagaatatcttaagagtgctaaatttttaactgcctttttgtcgagtcaaactgtgggattctgatttgtattaaaattgtaagctcctcactggtatactatcatcctggaggggtgttgtatggctgagcaagagagagagagaatgagagagagactgtgtgtgtgtgtgtgtgtgtgtgtgtgtgtactctgtgtgtgtatgagagagagaaatgctaaccttgtagcatgtgaagaatgtctgtaccttgatacgatagttacataatcagtatatttggtttctagatcactgtgcttattttgtttcaatctctgactaaaaatacttaaatttggtttgttaattcttattttagaaattataattttagtttatattaatttcggttatagcttactgaagaaatctttccagttagaaggaggttctaatattcacatgttctaatactttgtttattgtaaaacagctaaatttggagatacgtaaagccttgttttctctgtgtggttcagctactttccatttggtattacacagtcaaatttacatttatctattaaaattgccattttattaaacattttcatgcacagtagattcaagttgtgtctgaaaatatctcttgtgcttttttgattttgctgactttaaaaggattaatctgggcagacattatgtaaaagaaaggttgcgtttaatatattttttgaactttgtaggacaaaacatagctggttaaccttgaagtgactgttgtaccatggttgtgcacatgcttcagaatcctatggaagagaatattcctacttgcagtacatcaaaggaatggatggtggaccctactattcatgttttgagacataaatgttcactttaaa

SEQ ID NO: 1202 - DNA, 1194 bp, Homo sapiens
caggctttggggcgccagtcgctcccgccgctcgcacccgccaggccagggccgcggttcccggccgcagctctacctgctgctgttgcagctctcggagccctgtaactttctcgggcccttgaggccgctcagttttagtgtctcagaccccaccagacaagttcagtacatgatatccctcttttcctttaaaggattctaaactcaattcccggactaactttgaaagggggcagtgcatttttgtttttttttttttttcagtttaaacagactacatcacttcctagacagatgtcatgtttcttcagacattcccaatatttggtggtttttttttttccttaaagagtagttactaggttggaaatgtgttaaaagtcaacttcataaaaatatattttaaaatacatttgagattttggtggaagacacgttgctgaggaactcgatggcattcttgtggcactaagactggcaggatgtaaatataaaagtctaagataataagggtttatttgataaacgagtactttgacatagacattgtaatctattgtttaaggagcatacttctttttttttttttttttttagaacactaaatactcttttatatgactgatggagctaagaaggaacaattaccccgttcatgttgctggataaataatggcttgatccatttgccaaaacagcatcactggatttgagaaaggagactaatattcaggattgcagttttttattttcagaatttctttgctttccccagtgtgctttatcttccagagattaataatactttccttcaaatacagcaacatgtaaaacactccttttgaagttaatcgtatgctgtaaagacgattgcagtgactttctttgcttaatcgcttttttatatatgatggaatttaataaacagttggtatattattagcaaggaatgaatagacattggcattctttacagttttatttaaatgagacagaatttgattgtggcattgaaaaaacgttgagttcttgaccttaggaatcacatacaatgttttgttcactcctgtatccccacacatggaagagtatgtaggagagtctcagaagtagctgtagaatagatgtaattaatttgggtgtagggaaaatacgttgagtctgtccttttgtttttttttttgaaattgt

SEQ ID NO: 1203 - DNA, 1330 bp, Homo sapiens
ggaattttccagttcttgcattggcataatgaggagcaggagggaaaaggcctttactagattcttgtcacaaatttctagtcaatgtgttcttaactgggtggagaaagaatggaaaaccttcaagatctcatccaagcaaatggcaacaacttagaagaaatcatttagtgacttaattctttctaaagatgaaatgggattgttttttactcgtcttccttgttaaatcattatttaagccgttcttattgaccaattcctgacacttgattgtctcctaatgctttatccatcaccacctgggctcctgcatcctcactgtggaatcaggcaccagccacataatgttccagacaaagcctggaagggtgtggacccagacgtggagtggagtgattctcttgacgtttacatatatctctgtgtctctccatcattccaaagctaaatgtacatgtttagaataacttattttataaactcttcgggagacatgttgagatttgaccgtaatgaaagccacattttcctgaattatgatggtctgcattagtctcatgtgaaaggggaatgtggaagctcagggttaatgtagtggttgttttggtttttatttgctcaattttgtctgtactcatgtcattcagaaacctgaagtgtggctgcatcttgctgctaatgtgtgatgttgacgcctaactgaatttgaacagctcaccactgtgcctacatttaaaaatacttctctctcttttctaaaaagctttaactgtagtgcctcctaataagcagtatgtttgtttcattgtgagattgcagttctgtatttcgaatgagtctaagaaccacagggataatactgtgcagatttcctgttctttacctggctctgcttccagcagtattgacacctagtccttgctgcattgtacagtagcttttcaaactgcagttttattgctaagtttttagtatgggtgatactggagtcttatcatttgaagtgtttgcttttctacttttacagtaaaacctcattaattctgaaatttaagataatgagttaagctgaagagtttactgaagcaaattaatagtgaggaagcctatttgaactacttaaacagtattaaagccctttttaaaaagcacctatttgggatcatttgaggtcaagaattcgagatcagcctgaccaacatggtgaaaccccatctctactaaaaatacaaaaaagttagctgggcgtggtggcacacacctgtagtcccagctactcaggaggctgaggcaggagaattgcttgaacctgggaggtagaggttgc

SEQ ID NO: 1204 - DNA, 1178 bp, Homo sapiens
aagtcgtgtctttgggttggccgcaccatatgttatcactgtgtgagctgaaagtaaccatttggtatgatgcagctaacattctggttacgtgtaccacctcccttcagtcactttaaaaggtgattatctgtttctaacctgattcaataagttttcttctctggttttcctttttaatccattcagcctcctttggaaaatctggcaactgtggaagagactgttgttcgtgacaaggctgtggagtccctgagacagatctcccaggagcatactcctgttgctctggaagcttattttgtacctctggtgaaacgcttagcaagtggggattggttcacctctcgcacatctgcatgtggtttgttcagcgtttgctatcccagggcatcaaatgctgttaaagcagaaatcagacagtaagccatggtatttttttgccttgttaaagcagaaatcaggtagtaagctatgagttatttgggattactggggacttgtagctgacaatttacatagtaccttgttaccaatgagtggctgatactaggatagtaggatttatgacatctttcttttttttttttaagagataaggtcttgctctgttgtctaggctggagtgcggtggcacaatcatagctcactgcaaccttgaactcttgtgcttaagtgatcctccagcctcagcctccaagtagctaggactaccgacatacactactgcgcctggctaatttttaaaaaaaatttctggctggatgcagtggctcatgcttgtaatcccagcactttgagaggctgaggtgggaggattgcttgaactcaggagttcaagaccagcttgagcaacatagtgagaccttgtctctactaaaaagaaaaaaattagctgggcatggtgggacccgcctgtatttctagctactcagaaggctgaggtgggagttcacttgagcccccgacaaacaacaacaaaaatatttttggcatatagatagggtcttgctatgttgcccagtctgctttcaattcctggcctcaagcagtcctcctacctgggcctcccaaagtgctttgattacaggtgtgaggcaccatgcctggcctatgatgtcattttttattatccagttgaatatgttttatttttgttacttctataagtagaagct

SEQ ID NO: 1205 - DNA, 1208 bp, Homo sapiens
cacccagctaaatttttgtattttttgtagagacgaggtctcactattttgcccaggttggtcttaaactcctaggctcaagcagtctgcccaccttggcctcccaaagtgttacaattacaggtgtgagccacagcacctggcctttttttttttttttttttttgagactgagttgtgctttgtcacccagactagagtgcagtggtgcgaacacagctcactgcaaccttgacctcccaggcttaagcgatcctcctgcctcagcctctcgagtagctggaactacaggcacgtgccaccgtgcctggctaatttttgtattttttgtagagacaggggtttcaccctgctgcccattgctggactcaaactcatgggctcaagcaatctgcccaccttggcctcccaaagtgctaggtttacaggtttgagccactgggcccagcacagagcattattatagtctgtttttctattgctgtcattttggagcattagccacttctaatgtttgttttatgggtgcttgttgatataacctgtatctatctcgaagtccctcaagtgggtattaatgcagtgtgatttctgcccagtgctctgaatgtcaaagtgaagaaattcagagaagcctgggtagccgggcgtggtggctcacacctgtaatcccagcactttcggaggccgaggcaggcggatcacaaggtcaggagattgagaccatcctggctaacacggtgaaacctcgtctctactgaaaatacaaaaattagctgggcgtggtgacaggcgcctgtagtcccagctactcaggaggctgaggcaggagaatggcgtgaacccgggaggtggagcttgcagtgagccgagatcgtgccactgtactccagcctgggcaacagagcgagactctatctcaaaaaaaaaaaagaagcctggggaaacagcggaagtcactatgactcttagccaaatgcctcgtcatctcattagtgacacacatgagtggaccatttctgtaagaacagattcccactgttcctacctatgattcagcaaaactacagccaagggaatgggcttggcggagtcattgggaaaagaagaccctgtcgagcttgactctagtctggcatggtagagagacatgagaaatgtagaataagcaggaggccccaggggttggggatgatctccaaggggct

SEQ ID NO: 1206 - DNA, 1243 bp, Homo sapiens
aaatcccttaggtatgagctgagaggagtgttaaaaaaaaaaaagaaagaaagaaaatcccactgttcttactatgcaggcagagttaggtgataaatatcatcgactgctatctacacatcagacacttgttcatcagatggataagatttcagtttcagttgcttatatgaccaacaataaagaattaaatgaacagaaagggagtatagcatagtagttaagagtgtgagctctgtagctggaatgcttgggtatgaacctcagctctttatactagctgtgtgaccttttgtgtcacaatttctttgtatataaaaacattaggtttaatggttgtgaggtttaaataagttaaccagtgcctgtacagagaaagcatatctaggtattagctataatgataataatatttttgttattaaataagatgatttgagtgctaagaaagaaagaaactcagtgatatactagtgagtgaaagggtgaatggatatatgtgcagtcatgactacttttagacaggttggttgggagatctttttgatgaggtgacatttgatttgttttgaaagataagaaggaggcagcttgagccaaccatgtgaagaactggggaaagatcattttggatagagagactagctgtacacagtctgaaatgggaaagagtttagcatgtctgaggaacataaaagaggccagtgttggccaggcgcaatggctcacgcctgtaatcccagcactttgggaggccgaggcaggtggatcacaggtcaggagatggagaccatcctggctaacacggtgaaacctcgtctctactaaaaatacaaaaaaattagctgggcatggtggcaggcgcctgtggtcccagctactcgggaggctgaggcaggagaatggcgtgaacctgggaggccaaacttgcagtgagccgagatagtgccactgcactccagcctgggcgacagagcaagactccgtctcaaagaaaaaaaaaaaaggccagtgttaatgaagcataatgagcaaagggtctagtaggagatgagattggaaaaaaacagggatgagaacataaatgaccttatagattatggtaaagagtttgaattttatttaaagtacttgaggaagccattgagaaatttaagcaaagaagtgaaataaaatgattatgttttgaaaagatcattttggttgctccatggaaatggatgaaacgtttatatagtttatg

SEQ ID NO: 1207 - DNA, 1175 bp, Homo sapiens
ttcacttttttgattgttggttttacactatttctgtagaatggttttctgtaatttccttaggagtcagtttaatttctttctcgtctagatagatcccgttgattttgcgcttaagaaagagatcccatacacagtcaatagcttctcctccctttatccacttaacagttttctttctaagaccaccacacctccacctactcccttattaggccattaatttccctgaagggcaacactttccataccaggcctaagatggaccctgcactgtacccccaccgctaccactgcagcttccactctcactccagaagagcttatacaagatgtattgtgactagtcatttgtctttatagagacttaagctgaaaaccagttcctcaaatactgtcctggaagtgattttcaggacttttaagtctgttagtattttactaaacctttaagttttagtgatactttgtaaggctggaaattttaaattatttttatagaaccaaccataccaactggatgcagtatcatgtgcctataatcccagctatatgggaggctgaggcaagaggattgcctgtgctcaggagtttgagaccagcctgtgcaacttagtgagaccccatctctctctctctctctctctctctctctctctctctctctctgttttttttgaagatggagtgtcgctttgttttccaggctggagtgcagtggcacgatctcagctcgctgcaacctccgcctcctgggttcaagcgattcttctgcctcagcctccagagtagctgggattacaggcatgtgccaccatgcccggctaattttgtatttttggtagagacaaggtttcaccatgttggccaggctggtcttgaactcctgacctcgtgatccacctgcctcagcctcccaaagtcctgggattataggcgtgagccgctgttcctggcccccatctcttcacaacaacataagagaccccatcttttcacaacaacataaaagaaatgagaatacctgatgttttatagttcaaaaataccaatttaccaggagacaacagggtattctttattttaaaatagagtataggagcattttccttagcatgataatacttttgttttaaaataaaatgagaccttcgagttgtaccttcatgaagcta

SEQ ID NO: 1208 - DNA, 1246 bp, Homo sapiens
ctaatacgtaaatctagagacagaaagtagattggtattgccaggggtggagggcatgggggaatagggagtgactgcttaatggttacaaagttttctttcagggtaatgaaaatgttttagaactagacggaattggtgattgcacaatattgtgaatatattaaatgtcactgaacttgtacacttgaactttttttttttggagacagagttttactcttgtcactcaggctagagtgcagtggcatgatctccgctcactgcaaccgctgcctcccgggttcaagtgattctcctgcctcagcctcccaagtagctggaattacaggtgctcaccaccacatctggctaatttttatattttttagtagagacggggcttcaccatgttggccaggctggtcttgaattcctgacctcagtgagccacctcacccagccccactttaaaataattttatgttatataaattttgcctcaattgaaaaaaaaaaaatcacctgggtgcagtggcacacacctgtagttccagctctgcagcaggctgaggcagaatgatcacttgtgcccaggattttcaaacagtagtacaccacgatcatgcctgtgaatagccactgcactccagcctgagcaacatagctagaccccaactctatgaaaaaacaaatgaataaggaaacctgtatacacatccccacacaaaaggaaagaaggaaggggggagggagggagggaggaagggagggaggaagaaagggaggaagggagggagggaggggacacaagaaagtactaacttgggcaagaagattgaaaaagaaaatgttgtttagaaaatcttcttagggttaaagtgcctaccagccatcatgtagcatgcagctggtacttactgaggcagatctttagtttggttttgtgtgtctgatattttgacccctgttttacgtagaaagcctagacgctggaaatagtgccatgcagcccagactccagcacacatcagcctcctggcaaatctcaatcttcctcagcatcagtttccagaatggaaaatgaagtacaccaaaagctttgacagccctgtatgactatcaaaggaagtactgcaaataaattgttagcaaaatgaagaaatgcaatagaaatgaaaaatactgggacttgcctgttcaactaaactcctctagagtttacagtaaaaatactgatatcctgtgttatagttttggttttatc

SEQ ID NO: 1209 - DNA, 1216 bp, Homo sapiens
cggctcactgcaagctccgcctcccgggttcacgccattctcctgcctcagcctcccgagtagctgggactacaggcgcccgccaccacgcccggctaattttttgtatttttagtagaggcggggtttcactgtgttagccaggatggtctcgatctcctgacctcatgatccgcccgcctctacctcccaaagtgctgggattacaggcgtgagccaccgcgcccggcctgggtcttattttttatccattcagcaactctgtcttttgatttgtgagtttagtccatttacattcaatgttattattaataagtaaggacttaactcctgccattttgttatttgtttcctggctcttctgtggtcttctcttcattctttttttccttcctgccttccttttatgaaggtgtttttttctggtggtatgatttcattccttgctttttatttttgtgtatctgttgtatgtttttaaatttgaggttatcatgaggcttgcaaataccatcttataactcattttttattctgataacttaacactttgcataaacaaacaagcagaaagaaaactaataaaagctctacaccctaactttgtcctcgcactttttaacttttggtcatttttatttatatcttattgtactgtctatgtcttggcaagttgttgtagttattacttttgataggttcatcttacagtcttttcacttaagagtagtttacatgccatagttacagtgttataatgttctgtgcttttctgtgtacttcctattaccagtgagttttacaccttcagatgatttcttattgctcgttaacctccctttctttcagattgaagaactccatttagcatttcttctaggaaaggtctagtgttgatgaaatccctcagcttttgcctacctagaaaagtatttatttctccttcatatttgaaagatatttttgctggatatgctattctagggtaaacaacttttttccatcagcactttaaatatgtcatatcactctctcctggactgtaaggtttccactgaaaagtctgctgccagaaatattggagctccattgtatgttgtttcttttctcttgctgtatttaaaatcctttctttatccttgaccttttggagtttgataattaaatgtcttgaggtagccttcttagattaaatctgcttggtgttctctaacct

SEQ ID NO: 1210 - DNA, 1425 bp, Homo sapiens
tcagttggagtggtgcctttggaacccccggatccccctttgtctcacccaccccgctctcttcttccaattgttttttcccctctgctgcctgcacaccacttcggctgatgatggccataaagcaagttgccatctctgtaccactttacacagaggccatcagacagtcacggtgctttaccccttcatctttcaggtacatacttcactcatgaagccaaaggagccgatgacgcagcagacgcagacacagctataatcaatgcagaaggaggacagaacaactccgaagaaaagaaagagtacttcatctagatcagcctttttgtttcaatgaggtgtccaactggccctatttagatgataaagagacagtgatattggaacttgcgagaaattcgtgtgtttttttatgaatgggtggaaaggtgtgagactgggaaggcttgggatttgctgtgtaaaaaaaaaaaaaatgttctttggaaagtacactctgctgtttgacacctcttttttcgtttgtttgtttgtttaatttttatttcttcctaccaagtcaaacttggatacttggatttagtttcagtagattgcagaaaattctgtgccttgttttttgtttgtttgttgcgttcctttcttttccccctttgtgcacatttatttcctccctctaccccaatttcggattttttccaaaatctcccattttggaatttgcctgctgggattccttagactcttttccttcccttttctgttctagttttttacttttgtttatttttatggtaactgctttctgttccaaattcagtttcataaaaggagaaccagcacagcttagatttcatagttcagaatttagtgtatccataatgcattcttctctgttgtcgtaaagatttgggtgaacaaacaatgaaaactctttgctgctgcccatgtttcaaatacttagagcagtgaagactagaaaattagactgtgattcagaaaatgttctgtttgctgtggaactacattactgtacagggttatctgcaagtgaggtgtgtcacaatgagattgaatttcactgtctttaattctgtatctgtagacggctcagtatagataccctacgctgtccagaaaggtttggggcagaaaggactcctcctttttccatgccctaaacagacctgacaggtgaggtctgttccttttatataagtggacaaattttgagttgccacaggaggggaagtagggaggggggaaatacagttctgctctggttgtttctgttccaaatgattccatccacctttcccaatcggccttacttctcactaatttgtaggaaaaagcaagttcgtctgttgtgcgaatgactgaatgggacagagttgatttttttttttttttcctttgtgc

SEQ ID NO: 1211 - DNA, 1183 bp, Homo sapiens
taaagggtctgtccacaaagggctagtggaatgtgggattggagaggatgacattcttagggacaggatcgtcttaccagtggtctctgaaggtctgactcaactgtcatcttgatttgggtgattcccaaatctgcagcttcacccttgagctcacttggaaaatgtagtcctacacaccatccagctagtggaacacattatctacttttccctgcccacgtcctccaggcttcccatcttcggcagtaagtcctagtcctccagactcaatcttggcattttcctttattccctccatcctctctcaccaccattttgtgatcaaccacattgtataaactccttccttgtaattctaggatctgatctttcctgtggagactgctgctcctccctccctggttcaggccagcattgacttgcctggcaatgctccagtaacctcttcgctagtctttttactttcatggtccgcatttcccacccttatcacacaacattcagtccttcttacaaacttctgtagaattgttcttcgtggaatacactgtggaatgtggtacctctttaccctgttccctctatactcatcgacttctaactaccttcagtcatttttcaacatctataggataaagtctctatttctggctctggcattcagaaccctccatagtaatgacaaaataaggcccttcttcctctctcttaactcctaccagtcctttctgaaatattcatatgatctttattatgccctgctccttatcctagttatatgaagacctttcttatctatcctactaaatcctgagttgctagaggttaagttctatttcttttacttgcttatatccaccacatacaattctaacaaactgtgactagtaataatgatagcttacatttactgaacattttctatgtgctagttactgttcgaagtgtttacatatttttttctcatcttagttcacagggcgggtattattattctttccctttattacagtgcacatggaatttaaagaggcagaaatgatcacttctatgcaacataatcaggcaaggtttcatggcaatccacaggatatagtggtgagggaatttattgtagagataagcttctctgcaggggatgaaaatgtgattggggaggggtgggaattacaggataggt

SEQ ID NO: 1212 - DNA, 1148 bp, Homo sapiens
tttttcgctttctaggccattaattaccagacataattaattttcaatatctttaacaaggtataatattcttttctaaatccaaggtagctgtatatcatttttctttattttaaatagagcaacataaatatatgttccttgtacagcaaggaaaggatgttagggtttgtgcatgtgagaacacagatgggctaagagtgatttgcatccagagggctcatgcaaggaacttggtaagaggttacagagtgacactactgtggcagtgaataataaattaacatttcaatattggcaaaccggagaattttgaagaatgtcatatttagttaatttctgattattacaaactaagcctgtacattgatttgttaataactaggcatgcatgtgcacgtgcatgtgcactctctctcacacacacacccccccctatatacatatatatgttttttgaggggcatctttagtgatttcagcctgggtactctgttctaatatatgctcttccttctgagaacccatttactgtcacagatccaactttcttccaaaggcaaatgactccaaacccatatctgtgttgtgatccactgttaaacttaatttccctccctgggctctgacatctacttagctataggatacaattactaggatgaccttttgatattggtaacttatacacaaaactgagttccgtttctcctcatcctcacaaataagcaaccattctcagtttcccctttattttcttgaagatagacttgctctttggaacctcagaatcatttttgactctctctttctgggaccctggtgtggtcaaatctgtagtcaatttctgctgattgtctgtgcctggttggtttggacctagctcctctttccccttgcagtgcctgccatggccccttgccctcttcttcctcccttgatttacgttcacctttttaatgcctgctagcttctgtacatgaactctttgcatgcccaacccaatctttcttgttttatgaccactggtcttgctattcattccatccatggtgtcttccttctcccccactatctctgcagattgaaagctaaagtatagctcactgccatctcacgtttgaaaccctccagttcactccagtcaa

SEQ ID NO: 1213 - DNA, 1202 bp, Homo sapiens
tttcctttgcacagttctctgcccagggtaatgtgctttcacatattttacttcgctgacacatcacaacaactagtgaggttggtgttatgattaatctcatttcacaaatgaaaaaacgaggtcaaaaaggttatgtgacttgtgcaagatcacacaattagtaaattttagagacatgtttcaatttggggtctgctgataccagcctatgaattctttctgctcaatgtcttctgcctccccctactatttttttccccaccgaggatggttcagcctgcctttctaaatacacccagaaacacagagttttcaattcataatagtgatggcttcagggacaaagtgaaacaaacaaacaaacaaaaaaacaaccttgtaggaagtttctttccagctattcacttttttcccatcagaaaaaaatgtaaggggtatcgttatgatcttccaaatacttttattataaatatgcaatgtctatttgtccatccctacacagacccagattttagctttgaggagcttagtcttttccgagtcttttctactgcagagctttggctcattctagaatgttttagactgtagcatacaattttttttttttttttttttttgagacacagcctcgctctgtctcccaggctggagtgcagtggcatgatcttggctcactgcaacttctgccttctgggttcaagtgattgtcttgcctcagcctcctgagtagctgggattacaggtgagtgccaccacgtcctgctaatttttcctatttttagtagagacagggtttcactatgttggtcaggctgatctcaaattcctgacctcaagtgatctgcccacctcagcctcccaaagtgctgggattacaggtgtgagccaccgcatcctgtagcgtcccttctccacggagcctttcctaatcaccccaaatctattctggtttggttcttatcctgtaatgtcttctattatgcctagctgtaaacatgtctgacttcctcactgaaatgtgagctcttggtgaatagggactgtgacatacacattttcgagggggctgatgtaatagattagaaggccctgggttttagcatgagctctgtcatttgctaaagtctgtagcctttgacaaaccatgtcacttctctaggcctcagttttcttttttgtaaaatatgagtgttggg

SEQ ID NO: 1214 - DNA, 1200 bp, Homo sapiens
aatcctatgttcaactactgcaaacattcatgtcttccacaacccgcacatcagctgtcatcactgtcaaagaaaaaagggtcgtttcctcctccctgctttccaatcatacatgagtatatttcatcagcagaacataaattgcatttcaaaactggtgtcaaggagcctaagaagtgtagtgaaatttcagctcttgagatacagggaagaacacggaggatggtggaaattaaagatgattgctaataaacatgatccagtccaaaagaataaaaacaatatcatccaaaaaagtaaattttctactttttttgtagaattttaggttttacatttacttctaaatttcattttgagttattttttgcatatggattgaaattcatttttttttgcgtatgaatatccaattgttccagcatcatttgttgacaaggctatgcttcctccaccaaatcatctttgcacctttgtcaaaaaaatcagttttgtgtgtgagatttttagactctattatgttccactgacctatttgatctattcatctatcctgataccaatacctcactatcttgtttactgtagctttatattgagttttgaaacaggtatcattagctttccaactttgctcctcttttaaaaatttattttgattattctacattctttacatttccatgtgatatttacaatcagctcatctatatctacaaaaaaaccttttgagattttaaatagggattgtgttgaatctgtctgatgataattgacagtttaacagcatagatcccttaaactgatgcacaaggtacatcttttcatttatttaaagtcttctttaatttattttgacaatgcattgtacttttcagtggcaggttttgcatatcttttgtcagttttattcctatgtgtttcatatttcttgccatttagagtgtgtgtgtgtatataagtttctggttgttcatggttagtatatagaaacacaattaaattttgtacattagacttgcaacttgcagccttgctaaagtcacttattagttcctgtacaatttgttttacatgttatacccaattttctgcataaataatcatattgtatgtgaacaaagacaattctacttcttccttcgcaaaccggatgccttttatttgcttttcttgccttatttcactggctggaaattt

SEQ ID NO: 1215 - DNA, 1203 bp, Homo sapiens
cacagactgagaatctgggaaggctcagaggaggcagcctggaaatgaaatgtcttttcattttttttttcccaaactagttctttctcagaaaccttttatcctaaggctcaggactgtgagcaaccactggggaggtcctgggtttaacaatttcctttccatgtctgccaggctccagcccacctgggagaggcttcttctgaggttcacccctcccctgtgtctttgtctcctttctctgcgtctcagacgaggctgtcataccgggaatttcagtgggcaggtgctcaaggaagggagagaagcagataaggataccagaggcagccgaagtgtttttaatttaaattatcctcctcctcagcctctggaacctgaggcggctgcttgaacctttggatgcaaatgtcgatgcttaagaaaaccggccacttcagcaacagccctttccccaggagaagccaagaacttgtgtgtcccccaccctatcccctctaacaccattcctccacctgatgatgcaactaacacttgcctccccactgcagcctgcggtcctgcccacctcccgtgatgtgtgtgtgtgtgtgtgtgtgtgtgactgtgtgtgtttgctaactgtggtctttgtggctacttgtttgtggatggtattgtgtttgttagtgaactgtggactcgctttcccaggcaggggctgagccacatggccatctgctcctccctgcccccgtggccctccatcaccttctgctcctaggaggctgcttgttgcccgagaccagccccctcccctgatttagggatgcgtagggtaagagcacgggcagtggtcttcagtcgtcttgggacctgggaaggtttgcagcactttgtcatcattcttcatggactcctttcactcctttaacaaaaaccttgcttccttatcccacctgatcccagtctgaaggtctcttagcaactggagatacaaagcaaggagctggtgagcccagcgttgacgtcaggcaggctatgcccttccgtggttaatttcttcccaggggcttccacgaggagtccccatctgccccgccccttcacagagcgcccggggattccaggcccagggcttctactctgcccctggggaatgtgtcccctgcatatcttctcagcaataactccatgggctctgggaccctaccccttccaacc

SEQ ID NO: 1216 - DNA, 1148 bp, Homo sapiens
gaatgaataaaaatgaggtctaaaggggaagacagcacttcatctttcagcagattttcttttgccagacaaaaatgtctattcagagactcggccttcctatagccatcctatctaaatgcgccagctatatccaggatgtggattgttttagggctcataaagtgtctcataaacttataatgaaagggttaagtcagttcaggtctttaaagaatgctttgaaagaatttatataagctttgactacttaccttacaaaattgaaagttcaagggttctcagcagttgaagagaagtaatgttagtaattctcaactttgactaaaactgccttctagtttgaatagcatcttttatgttctttgtctccttaattctggaaaagaatagtttcaaatatatatatatatatataattatatatatatataaaaggtaccttaaaatgtatgcttcttttttcaggaagctgtgctgaatggtttggtggccactgaggtgttgatgtggttttatgtcggagagattataggcaagcggggcatcattggctatgatgtttgaagaccaatctttaacatctgattatatttgatttattatttgagtgttgttggaccatgtgtgatcagactgctatctgaataaaataagatttgtcaaaactcagtgttttctccatcagatactccatgaaaggtcacaatttctcttgatattaagctgggttgtctttaaacaaccctaaatacacgtctgtttagcccgcaattggaaaggatatatgtggcaatattaacctggtacatgaatatatggggataacattttaatttgaaggtttggaatatatatatttaagctttatttccagaacagtgagggttaggtcttgggaaaactataacttgccaaagtagaagaaatagtagtaccatatgccaaagtgatagagatgaatcatgtcagtagttagaataacatttcaactgttttctttgctaaaatcacagaaagaccctattgacaacatctatgtctgtaaaaatgttagagtacttgtcatcttgaatatagcctccccaagagagaacagggtggtattctaagtatgtttctttgtaacatctttagcagtaggacag

SEQ ID NO: 1217 - DNA, 1241 bp, Homo sapiens
ccaaagggaaacaaagaagatagcctgaaaaaaattaaaaggacaccttctgctacgtttcagcaagccacaaagattaaaaaattaagagcaggtaaactctctcctctcaagtctaagtttaagacagggaagcttcaaataggaaggaagggggtacaaattgtacgacggagaggaaggcctccatcaacagaaaggataaagaccccttcgggtctcctcattaattctgaactggaaaagccccagaaagtccggaaagacaaggaaggaacacctccacttacaaaagaagataagacagttgtcagacaaagccctcgaaggattaagccagttaggattattccttcttcaaaaaggacagatgcaaccattgctaagcaactcttacagagggcaaaaaagggggctcaaaagaaaattgaaaaagaagcagctcagctgcagggaagaaaggtgaagacacaggtcaaaaatattcgacagttcatcatgcctgttgtcagtgctatctcctcgcggatcattaagacccctcggcggtttatagaggatgaggattatgaccctccaattaaaattgcccgattagagtctacaccgaatagtagattcagtgccccgtcctgtggatcttctgaaaaatcaagtgcagcttctcagcactcctctcaaatgtcttcagactcctctcgatctagtagccccagtgttgatacctccacagactctcaggcttctgaggagattcaggtacttcctgaggagcggagcgatacccctgaagttcatcctccactgcccatttcccagtccccagaaaatgagagtaatgataggagaagcagaaggtattcagtgtcggagagaagttttggatctagaacgacgaaaaaattatcaactctacaaagtgccccccagcagcagacctcctcgtctccacctccacctctgctgactccaccgccaccactgcagccagcctccagtatctctgaccacacaccttggcttatgcctccaacaatccccttagcatcaccatttttgcctgcttccactgctcctatgcaagggaagcgaaaatctattttgcgagaaccgacatttaggtggacttctttaaagcattctaggtcagagccacaatacttttcctcagcaaagtatgccaaagaaggtcttattcgcaaaccaatatttgataatttccgaccccctccactaactcc

SEQ ID NO: 1218 - DNA, 1155 bp, Homo sapiens
gctttctcctggggcccctccaattgtttactgttagaaagtgggaatggggtccctagcagacttgcctggaaggagcctattatagagggttggttatgttgggagattgggcctgaatttctccacagaaataagttgccatcctcaggttggccctttcccaagcactgtaagtgagtgggtcaggcaaagccccaaatggagggttggttagattcctgacagtttgccagccaggccccacctacagcgtctgtcgaacaaacagaggtctggtggttttccctactatcctcccactcgagagttcacttctggttgggagacaggattcctagcacctccggtgtcaaaaggctgtcatggggttgtgccaattaattaccaaacattgagcctgcaggctttgagtgggagtgttgcccccaggagccttatctcagccaattacctttcttgacagtaggagcggcttccctctcccattccctcttcactcccttttcttcctttcccctgtcttcatgccactgctttcccatgcttctttcgggttgtaggggagactgactgcctgctcaaggacactccctgctgggcataggatgtgcctgcaaaaagttccctgagcctgtaagcactccaggtggggaagtggacaggagccattggtcataaccagacagaatttggaaacattttcataaagctccatggagagttttaaagaaacatatgtagcatgattttgtaggagaggaaaaagattatttaaataggatttaaatcatgcaacaacgagagtatcacagccaggatgacccttgggtcccattcctaagacatggttactttattttccccttgttaagacataggaagacttaatttttaaacggtcagtgtccagttgaaggcagaacactaatcagatttcaaggcccacaacttggggactagaccaccttatgttgagggaactctgccacctgcgtgcaacccacagctaaagtaaattcaatgacactactgccctgattactccttaggatgtggtcaaaacagcatcaaatgtttcttctcttcctttccccaagacagagtcctgaacctgttaaattaagtcattggattttactctgttctgtttac

SEQ ID NO: 1219 - DNA, 1153 bp, Homo sapiens
tttgatgggcacaaggttgattttgaactttcttcttttgatagtttcaagcagcttatgctgggcagtcttgcaaattaagtattagatttcctctctatggtctttgtgagtattaagacccctaaaatttctattcccacttcatattccctgattttcttccaaaataactagagttgccatcctcttctttgaaagtccatagcttttcgggccgaagctgtctaaagtgtacacagggccctgaagatctaagtaatatgtacaatagataaaattagaatttataccccagcctcaagtagagaaatggaatagggttctagaaagtggagtccccatttgtagctgagcaggggcagaagaaggctctcaagccccttctgggaagtgcccccttctctttctggtgacgaggtgccaggtggttggtgtattggttagagcaatagagaactgggcataggtacatttgatttttttacttgaagctttctatgcctgccctgccctatcacaggagaagaagaagacctcacagttgacacctcaacggggctttagtgaaaatgaggatgacgatgatgatgatgatgattcatctgaaactgattctgattctgatgatgatgatgaagagcatggagcccctctggaagggtgaggaaagaacacccaagccaagggtgctcttcagaatacctccttcaaaacactggagtgggaggacgtcagttagaagtgaaattccagcatctcttttgatctcctgtatttaggattttcagatgtctcagaaacccaacataataatgagttttcctccctttctgactccactaccttatccagtcctatagtatcactttactatctgaaacgtttgtgggcttgggggttacatgagattttgctgagtaaatcaaaaaggtggtggccaggcatggtggctcaagcctgtaatcctagcattttgggaggctgaggtaggaggattgcttaaggctgggcgttcaagaccaacctgggcaacatagcaagacctcgtctctacaaaattttattttttttttgagacagagtcttgctctatcgcccaggctggagtgcagtggcgtgatctcggctcactgcaagctccgcctcctgg

SEQ ID NO: 1220 - DNA, 1159 bp, Homo sapiens
ggacttttaacacgagactttgagagcagagcaaatgaataatgtgaagagctagaacgttgccttttgggtcagaatgttaatatatcatcctgatagaatgtctatgaatttcataggttatacagggcagggctgggctgtggccactcattttggagcttttacttaatactacggaacatctcgtcccaacagttgtcttttctccatctagaagaaaagcagcttaatcattttggtggggaagagtgatgctgtgactttcagttgtgaattgaacatttttctagtattttacagttacttttaataccgcttttagggaaattgatatgttctgtaatgagaatgtagtcaacatgatggagactcaaacctcctgctttaccttactctttgtttattttcctaggttaccaaagtgacccaggtagatggaaacagccccgtcaggttttccacagagaccactttcctagtggataagtatgaaattctgtaataccaagaagagggagctgaaaaggaaaattttcagattaataaagaagacgccaatgatggctgaagagtttttcccagatttacaagccactggagaccccttttttctgatacaatgcacgattctctgcgcgcaaggaccctcgactcacccccatgtttcagtgtcacagagacattctttgataaggaaatggcacaaacataaagggaaaggctgctaattttctttggcagattgtattggccagcaggaaagcaagctctccagagaatgcccccagttaaatacctcctctacctttacctaagttgctcctttatttttattttattattattattattattattattattttttgagatggagtctcactttgtaacccaggctggaatgcaatggcatgatctcagctcactgcaacctccgcctcctgggttcaagcaagtctcctgcctcagcctccgagtagctgggactacaggtgcacgccaccacgcctggctaattttttgtattttagtagagacggggtttcaccgtgttgcccaggctggtcgcgaactcctgagctcaggcaatccgcccacctcagcctcccaaagtgttgggattacaggcatgagccaccatgcccagctgctcctt

SEQ ID NO: 1221 - DNA, 1162 bp, Homo sapiens
ctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtgagtggaaggccggtgtggggcttggcgctgaggcacttggg

SEQ ID NO: 1222 - DNA, 1178 bp, Homo sapiens
aaaccagtgaacttttttttttaatgtttttaattcccttttaacccagtgtactaggtcaatcaggaggcatctggaaagggggggaaaaaagcaaaaaacaaaattaaaaaaaattgatttccatattttatttttcaaaaccctaaaatattacaaaataagtcccgcatatactttaatgttttaactcttttggacaaaggaatcaattacttgaagttgcttttttgactctgcctacttctgagcaaactatttgcgactcacccacaattgccttggagatcaaaatcctacagatgcctcctgatgggacatagccctaactccttaacaactgtagcaagaactgcacggtacaaacccaaaaaagaacaagctcatctatttggaacccaagcctcatattttctgtccagtcaatgttggttactaaatagaaaacctaattaaggaagtaacttttttccagggaggggtgggagagggaatttaaaaggtgtcaacttttgaccaaaaaaattgtgcccttgtaccgatgcagctctctttctcccccacctcttgcgagataagagggatcattcatgtagaagaaaagagtataaatgcaattctgtatctcgctagagaacgtgtgggtgactaaacaaaaagtgcagtctccttcaccaactttagactgcgtggtgccacatgcctgtgggtccctcttaaagcacagacttaaaatggaaagtattactgaagtatagcctctaatgaggagtggcacttaaactatctgggacaccactactggacacggtcttgtagaggcagctgtccagttttggtgcttgactcttgaataggaattgttaaatggaaagatgctctgaggactaggtcaaagcctggtctttttttttttttttttttttttctttcttttttgggccctcataataagcattgttactattggaagttgttttcacattctttccaatattaaatatgtatttttttaagtaatgataatattttccagtggctcatttggatgagaactaccctctatttttaatattaaaactacatccaactcatcatttagcctttggttgtacagttgtgtaatgggctatggactgttacacaccttaccacctctaggcctatgttttttcttt

SEQ ID NO: 1223 - DNA, 1405 bp, Homo sapiens
cgccattgtgggactcatggccaatggtaagtgttaacttctagagtctctccctcacccccacctgtgctttgcatatagaccagtgagaagctggagctagcaccactggcttaggttcttccctttccccctgacagtgggcggctttctggctgggctgcccttcagcaccattgccaagcactacagttggagcacagccttctgggtggctgaagtgatttgtgcggccagcacggctgccttcttcctcctacgaaacatccgcaccaagatgggccgagtgtccaagaaggctgagtgaagagagtccaggttccggagcaccatcccacggtggccttccccctgcacgctctgcggggagaaaaggaggggcctgcctggctagccctgaacctttcactttccatttctgcgccttttctgtcacccgggtggcgctggaagttatcagtggctagtgaggtcccagctccctgatcctatgctctatttaaaagataacctttggccttagactccgttagctcctatttcctgccttcagacaaacaggaaacttctgcagtcaggaaggctcctgtacccttcttcttttcctaggccctgtcctgcccgcatcctaccccatccccacctgaagtgaggctatccctgcagctgcagggcactaatgacccttgacttctgctgggtcctaagtcctctcagcagtgggtgactgctgttgccaatacctcagactccagggaaagagaggaggccatcattctcactgtaccactaggcgcagttggatataggtgggaagaaaaggtgacttgttatagaagattaaaactagatttgatactgaacactgtcagtgattcattttttcaaagtgagacagcttccttgggaaatattgtcaatacctgctctttccaccccaaaatggaaagacttcatttccctggaatggggaagctgaagtgtagatggactcctttaaaactcatgcctcctctgccttcacctgaacattgaatagttcaatgattattttagagataaagctattgggttgtggacagattaaataacttgatggagggaagaagtgtaacagtggtttactgagtgtgtagccagaaagcctggttcaaacccagactgtcagtaactagcttggaaactttgaggcagaaagtctgctaaatctcttatctgtaacagaatgtaccccctggagttagggtgaagatcaagtgagataaagcaggaatgcctggctgtaagtgcttgaaatatgttccatcatcatcatcatcataacagccaccaccactgctgccaccaccccaggaccccaggaaatcagcagcaattctgggactagatccaatgctcatgcttc

SEQ ID NO: 1224 - DNA, 1882 bp, Homo sapiens
taacccccacctctgttttccccattcatctccacccccttcccccaccacttctatttatttaacatcgagggttgggggaggggttggtcctgccctcggctggagttcctttctcacccctgtgatttggaggtgtggagaaggggaagggagggacagctcactggttccttctgcagtacctctgtggttaaaaatggaaactgttctcctccccagccccactccctgttccctacccatataggccctaaatttgggaaaaatcactattaatttctgaatcctttgcctgtgggtaggaagagaatggctgccagtggctgatgggtcccggtgatgggaagggtatcaggttgctggggagtttccactcttctctggtgattgttccttccctcccttcctctcccaccatgcgatgagcatcctttcaggccagtgtctgcagagcctcagttaccaggtttggtttctgagtgcctatctgtgctctttcctccctctgcgggcttctcttgctctgagcctcccttccccattccccatccagctcctttccccctgggtttccttggcttcctgcagcaaattgggcagttctctgccccttgcctaaaagcctgtacctctggattggcggaagtaaatctggaaggattctcactcgtatttcccacccctagtggccagaggagggaggggcacagtgaagaagggagcccaccacctctccgaagaggaaagccacgtagagtggttggcatggggtgccagcatcgtgcaagctctgtcataatctgcatcttcccagcagcctggtaccccaggttcctgtaactccctgcctcctcctctcttctgctgttctgctcctcccagacagagcctttccctcaccccctgaccccctgggctgaccaaaatgtgctttctactgtgagtccctatcccaagatcctggggaaaggagagaccatggtgtgaatgtagagatgccacctccctctctctgaggcaggcctgtggatgaaggaggagggtcagggctggccttcctctgtgcatcactctgctaggttgggggcccccgacccaccatacctacgcctagggagcccgtcctccagtattccgtctgtagcaggagctagggctgctgcctcagctccaagacaagaatgaacctggctgtgtcagtcattttgtcttttccttttttttttttttttgccacattggcagagatgggacctaagggtcccacccctcaccccacccccacctcttctgtatgtttgaattctttcagtagctgttgatgctggttggacaggtttgagtcaaattgtactttgctccattgttaattgagaaactgtttcaataaaatattcttttctacagtttttgtgctgtgagtttttaaaaatagaaaaattttgggccaggcatggtggctcatacctgtcatcttaacattttgggaggccaagatgggaggatagcttgaggtcggaccagcctgggcaacagcaagactctgtctcaaaaaaaaaaaaaaaaagtatctgagtgtggggatgtgtgcctgtagacccagctacttgggagactgaggctggagggtgggtcccttgggcccaggacttcgaggcttcagtgagctatgatcgtgccactgcactccagcatgtgtgacagtgaaaacctcaaaaagtttgaataattacatcatcaaaatgttattgacactttggacttagttgagatttgtatatgtatttttttcaaggaaacaaaatactggttttattttactgctaacattatttggactcctatatcccaggcatttttaagtaacgtactttttttt

SEQ ID NO: 1225 - DNA, 1383 bp, Homo sapiens
gtccgccgtccgccctccggtagggttcgggccttccggatgcggcttgggcgctcttcggggacctccgtggcgcggaagacccgagcctgccggggggaggccggcggcgccgcacctgcccgcctcggcgttcgtgactcagccgccccatcccgagtcgctaaggggctgcggggaggccgcagcaccttctggaagacttggccttccgctctgacgcagggccgaggtgggcagtccaggccgagaggccggcggccctgaaggtgagtgaggccctcggcagctgcagccggggtgtctggtacccccccggcgtggtgcttagcccaggactttcagacgcggccgctggccgggaggctttggtgggagagacgcgatcgccgatttcggtctggcgccccttctgcggccgggacccaggcctttcacatcagctctccctccatcttcattcataggtctgcgctggggccgggacgaagcacttggtaacaggcacatcttcctcccgagtgactgcctcctaggaggacatttaggggagggcagaggcctgcagtttggcttcacggctggctatgtggacagcaagagtcgttttcgcggaagccgactggcagccaggcctgtcgggccccccgacgccgccccatttcccttccagcaaactcaactcggcaatccaagcacctagataccagcacaagtcggttaatccctgtctggactgagcctccgttggcttctgaactggaattctgcagctaacccttccacgactagaaccttaggcattggggagttttagatggactaattttattaaaggattgttttttttttaaatggagcgtttgttttcattttgcaagagagttgtagaattagtgactttctatactttcctgataataggggtgggaggggccatgcaatataaacaggctctactgttaactgaaggggcaaaccataggaatttaagattgtggctctgtttcttggtgttcctgggagacaatttattctgtgtgaaatgaaaactattgaggcagaagcagaaaggacgtaccaggagaactctgggcaaaagtcccagcctctgaggtaaggatgaaagggctttgtgtttgttcctatcttcccgccaactccacacgcgcacacacaacaccttcagaactggtttattagtaggattggttacattcaaaggctgttgcttggacttctctaaagagatgaagcccccacatactgaggaggcaaggcagtcatcaaggccccaaggtgaggcaaatccctggaaggcttgaaccctgcagttcagtctcccggggtaatcactccccagatagcagtgagaatggggca

SEQ ID NO: 1226 - DNA, 1205 bp, Homo sapiens
attttagttgcaattgttagttgcacaatttgggggaatgtttgaggtctctatagtagttactgtatttaccaggaagccctgcatgattagaattcttgagacagtgtataaagttaaattgggtgtgttgcctggatgtgaacagtaaaaaaggagaagcttctcaccatacaattatagcttaaaaggaaccaggtacaattctgtttccaaaaatagaaagtaagtcaaatattatatggatatgtaatagtaattatattaattttgactccctggccgactttttttttgaagctatcattttttgtcagagataaaaagtagcttttaaaggaaaagatatctcagcccttaattatgtgtgtgtgtatgtgtgtgtatgtatttatttatatattttagcccttgtaagagaggagcagtggaagggaactgaaggagcatgatatagagaaaagagcctgggttttggtgtgttgcatttgttctgttactagctgggagaccttgggcaaatttacctctctgatcagcagtttaattttttcatctgtaaaaatgggaagaatacctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggc

SEQ ID NO: 1227 - DNA, 1118 bp, Homo sapiens
gtggtacaaccttggcacactgcaacctccacatcccaggctcaagcaattcttcaacctcagcctcctgagtagctgggactacaggcatgcaccaccatgacctggctaatttttttgttttatgtagaggcagggtttcgccatgctgcccaggctggtctcgaactcctgagctccaagcggtccacctgcctcggcctcctaaagtactgggattacaggtgtgagccaccgtgcccggccagtaatttggatttttgacatgcttttagcaaagtttctagtaaattattgtggaattagtgctaattcgtataatctttgttttattgaagtacaataaatatagtacaataaatacgttaatatggtaagttgcacaaattttaagtgtacatcttgatgaattttaaagtaaatatatgtaacctttatctagtttaaggggcagactatttcaagaccctaaaaacatccctcatggcctccccaggtcatagtattagagtaatcttgtattgttttttccagataacaaagctttattcgtcatttccatgtcagacaatggcgctcagatttatgaactggtggcacagacagtttctgaaaagactgtgtatgtatcagatatggctaccttgctatagctaatattttcattatcccaagcgtaatattccataaacttaactttgtttttataatgtatggaaaccaagcacttcctctgtactcttttagagacgttctactatgaacttgttcttttttaggttgatgccttttattttgattctattctgaaagtttatttcctaaagaaaaaattgtgcaaaatgtcaagtgaagtttttttaatgtgtccatagatttctcttaaggtatagttttggactctcgccttaatagtgtgttgccaaaataaagatattctctggcagagtgggttttgttgttgttgttgttgttgttgttgttgttgttgttggttgatttggtttttgtttagttttgctttctgagtatatttaaaggatatttcttttttcttttttgtattttggatttctttccaactttctgaagctggcaggacctaatctgtcggatgg

SEQ ID NO: 1228 - DNA, 1099 bp, Homo sapiens
tcaacatactaaatagcaggcacttgaaaatgggtgtgttttcttccattgtcgtcttttctattgagggttgggatttgggtgggagaggaaagcaaattttattttcttgactataaatttgttattcttggtatcatttcatttttataattatacattagacattggcacttgtgtaaaactgtccctgcagattgagcaggaagtaaaaacaaatggaaatgcttcggatagtggcaggggtgggggttgctaaggaaagggtgggatgggagtgggtaaagagtttgggaaggttatctaactgaatcactactgagttgaatcatggctatcattagccacaggtactgctgattataaggccagtaaaattttagtacctggaggtttgactctaatttttgcactgatggtgccaaagggccctgagtcaaaaggatagccaagggtggagtggaaaaagatatggtgaaggcagaactgctcacaccagctccagaagcacgtcctctgacttcactgccgcagctctttccacacggggccgtgattgaccctaaaaattgcagaccagcacatacactggacactgcaggcaaggtgttggtaactgcctgctctaggatgaatagtagcgttagcagcaccctacagagggtaagtttcagaattgtaatttgagaactccttcaattatattgactttctttggttttccttgtgcattaggtatatattttttgaagtatttttgccaactaaaatgaagtctgtaaattctgttaataaacaaggagttcatccgttgctcacatctttcattggtgccctctgaactctgtgggttgctaggatgtaattttaatgcttccctgcagtccaaagatgattttttcaccacaaatggtaagggatgcccacctacttttataaacaccactgcaacttaacaagtttatttatctatgtccagatttctgtttctgtcctaaattgatctgtgtttttaggtggatcaacttggatctttagacctcatctataaattgaaattatatttttagtcataagccaagtacaatctaactcagaa

SEQ ID NO: 1229 - DNA, 1148 bp, Homo sapiens
tgaggaagtaggcataatgaactaccaattgttaatttccattgctgtgtaacattttattttatgaatatattgtaatttacccaattgcctgttcttagatataagggcttctccacactgcattcccccccaccgcaatcctcccaggatttttgcagttttaagcaatgctgttgttacggacattcttttacttatttcctggtgcacactacaagttcctgtagagtttatactgagaagtggaattgctagatcatagagtatgtgcgtcttcaactttactagacagtaataaattattttccaaggtgtttgtaccagttgatactcccactggctacattgccagtttctgttcttctgcattttctccaacacttggtattgtcagagtttttaagttttgctgatttgcataaaatggtatctcattgagattttaatttttgtctctgaaaattattgaacgtgagcatcttttacatatgttaaacattttaattttatcttttagtaagtacttgtttatgtcttttgtccattttcctattaggttgtcttcctccttcttactgtttttaagagttctctgtattagttacacgtgttgcaagtatcttttttccagtttttggcttgtcttttcatgtttttaatgtcttttgatgattgaaagtatttcttttttctttctttttttttttttttttttttgagacggggtcttgctctgttgccaggctcgagtgcagtggtatgatctctgctcactgcaaccttcacctcctgggcccaagtgatcctcccacctcaacctcccaagtatctgggactacaggcacatgccaccatgcccgactgatttttttgtggagatggggtcttgctatgttgcccaggctggtcctgaactcctgggctcaagcgatccttctgccttggcctcccaaagtcctggaattacagatgtaagccaccatgactggccaagttttcatttggctgcttaactttatttttatggattttaaaaatgttttctttatgaaatatttccctaaatcaagatcataaagttcttttcctattagaagaaataacttatttttttctcaaggagataaagtttgctttcatatttt

SEQ ID NO: 1230 - DNA, 1111 bp, Homo sapiens
aaggaggcactgtcatctggtcttgacagggataatggtatttcaattgagttactggtgcctaagggcgtctagctaagagaaactagagttacacatacacaggtaatttaaggcttttacttagagttaatttctttcctaggccgtttgagcaaggaagacattgaacgtatggtccaggaagctgagaagtacaaagctgaagatgagaagcagagggacaaggtgtcatccaagaattcacttgagtcctatgccttcaacatgaaagcaactgttgaagatgagaaacttcaaggcaagattaacgatgaggacaaacagaagattctggacaagtgtaatgaaattatcaactggcttgataagaatcaggtttgtgttttttttttttttttttcctcccccactcaatggaggggaaggggatggtaaaccaagcttgagctggatttcagtgtagggtcacaatgatgaatggtccaaaacattcgcggtttccaccagaattcaaggtgttggcaactaccttccttggatgtctgagtgacccaagatgttaaggaagaataaggccctattttaatgttggtagtggccctcttgtaagagtttgcgccagacttttagtatcagattgcgtcagggagaaagaagggttattaacattaaaagaacttgcagtaattcctttttctcttcctcagactgctgagaaggaagaatttgaacatcaacagaaagagctggagaaagtttgcaaccccatcatcaccaagctgtaccagagtgcaggaggcatgccaggaggaatgcctgggggatttcctggtggtggagctcctccctctggtggtgcttcctcagggcccaccattgaagaggttgattaagccaaccaagtgtagatgtagcattgttccacacatttaaaacatttgaaggacctaaattcgtagcaaattctgtggcagttttaaaaagttaagctgctatagtaagttactgggcattctcaatacttgaatatggaacatatgcacaggggaaggaaataacattgcactttataaacactgtattgtaagtggaaaatgcaatgtcttaa

SEQ ID NO: 1231 - DNA, 1201 bp, Homo sapiens
gaggatggaatctttgaggtcaagtctacagctggagacacccacttgggtggagaagattttgacaaccgaatggtcaaccattttattgctgagtttaagcgcaagcataagaaggacatcagtgagaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaccctggacccagtagagaaagcccttcgagatgccaaactagacaagtcacagattcatgatattgtcctggttggtggttctactcgtatccccaagattcagaagcttctccaagacttcttcaatggaaaagaactgaataagagcatcaaccctgatgaagctgttgcttatggtgcaggtaacaatggtatctcaattaaccctaaaggcaggcaggcccaaggtgactcgctgtgatgagtgattgttaaacattcgtagtttccaccaaaagcttggctaatgatggcaacaccttccttggatgtctgagcgagtgatagttaaaacaggagctatgtactgggttttcttttaacttcttttaacgttaactttttgtttgctagctgtccaggcagccatcttgtctggagacaagtctgagaatgttcaagatttgctgctcttggatgtcactcctctttcccttggtattgaaactgctggtggagtcatgactgtcctcatcaagcgtaataccaccattcctaccaagcagacacagaccttcactacctattctgacaaccagcctggtgtgcttattcaggtatgtttctgtacttctcttgtttggcttactgataacagataaagggaagtcttgactgactcgctatgatgatggattccaaaaccattcgtagtttccaccagaaagtcttatgttggccagttccttccttggatgtttgagcgaccattcttccttagcaggaccctagcactgtcacagacctggagtccattgtagtaatttgttttatttcctaccaaggtttatgaaggcgagcgtgccatgacaaaggataacaacctgcttggcaagtttgaactcacaggcatacctcct

SEQ ID NO: 1232 - DNA, 1203 bp, Homo sapiens
gttcagtctcactctggaaagagaacacattcatagtttataggccaatttggagaccttctcaggctgtgtggcggtgttgggaagtgactgagcaactcacctctgggtctcagttttcaccctgctggaagatagactggaagggagaaggtgtaggttccctctctgctatagaggtcacgctgtgtggtattcatttgtggggagccatagactggattgcgcattgttctttcccctgcaggcagcatgagctgatgctcttgacactgaggttggaggcagagaccctctcacatgcacacaccccgggcccccagtctgcttgctgctgctggctctgcccccagtgctttcctatcactaagaatagagaccttctctccaggcatccagcttcccacacagtctgactctgcccaagcctctgcccttgaagatgccaaagtggtttctgtctcagagtctttgcgcttgtttttcccttgcccaggaatgctctttccccagatggctgcaaggctggctccttgcctttcaggtttcagtgcaaacaccacctcagtgagcgctttcctgaaaccctctctcacccctgccccagctaaccagggactctgcctagtcactatcactttgccttgttatattttctccctaacacttatcagtgtcttttttttttttttttactcctatgcatttctgtttttgtctgttcaggctgcttaacaaattactgtagactgggtgacttataaacaacagaaatgtattcctcacagttctggaggttgggaagtccaagagcaaggcacaacaggttaggtgtctggtgagggcctgcttcctcgttcatagagagccacgtggtggaaggggtaagggagctctctggggcttcgtttctaaggctctgctctcatgacctaatcagtccccaaggccccacctccaaataccagcaccttgagggttaggatttcaacatatgagctttgtgggaaacacacacattagaccgaatgtgccaatgtacttgtttactgcctgtctctgcaatagccaagacttcgtctatatcatttacttcatttacttctgggtccttggtgcttaggacagtgcctgacacagagatgctcatgtactcactgaaggtgacacagctggtaagcaatgaagcctgaatttgaatcc

SEQ ID NO: 1233 - DNA, 1195 bp, Homo sapiens
tcaggcatcagagaacacacactggggagaaaccattcacgtgccctacctgtggaaaaagcttcagcagaggatatcacttaattaggcatcagaggacccactcagaaaagacctcctagctaggtccccatgtgaggagatctgctttcagccctcacctaagggaggtgaggaagaggaaaagccctcttgtcagcctgggaagaccttttcgagggagtctccctgacctgctcagatctgacattacctcttcctgcaactaaacacgagcctgggcagaacctctcagccttcctctacgccttgaggggatgtttcatccaaagtacaacctgaattgaggcttctccttcactggagtgcacctgcctctacctcatgggtataaagtaggagaactaagagacttaagaggtcgtggttcctatatcgtccaaaaaataggctgttacatatcctaaagactgctcaacagcttcaagttgaaagtggccaaggacagccccttaggtttgggaagggacgagcctgaaggattctgtctttactggggtcaaatcttaaagcacacagctctggactcaagacaggaggtttgcgtcctgatggctttgccacacattcacaggataactgcatagatccctcgctgtctgattcacttcttaccatgcactttcctttgatgctgaggagaaatggaagtgggcgaaaaatctcaaggctgcttcatgtggaccttgtcaagctgctccctcccccagcgtcaaattgttatcaggtgccaaacactgctagaaaggagggcctagtcagaagcctctttccatacgagttttggttttgtttttaatatttttttctattaaaatactcatgcatttaaccttcccgttattcaaccagtctcttggttgcatccctagcacttctactacaagtgagatggtagtgtttgagtgcttattgagtaaagcataattcggtcataatgaaatcgttcacattccctcatatgcacaagcccaccaaccccttcacaccccccttcacaggggtcgtatgagtaaggggatttggaaactgtcaacttacaaaggcactataacaattacagaatcatgattgccatgggccactttatttacatgaagacaactggagaacgactaagaccaaattatggaaa

SEQ ID NO: 1234 - DNA, 1282 bp, Homo sapiens
gcatccactgtagaaaacaatatggaggttccttaacaaattaaaaaaacaatgacctcatgatctagcaattccacttctggctatatctccaaatgagttgaaatcagtatctcaaaaatatatctgcatcctatgtttatttcagcattattcacaatagccaagacatgaaagcaacctaaatgtccatcaatggatgaatggataaagaaaatacacacaatagaatattattcagttttaatgaagaaggaaatcctgccatttgtgacagcataggtgaacctggaggacataatgctaagtgaaatagatcatataaagtacacatactacatgataccacttatgtaattaatctaaaatagtcaaacacataaaagccaaaagtggaatagtgtttccagggactggaagggagaggagaacagggaggtattagtgaaaatgtacaaaatttcagttacacaagatgaataaaaagtcctagaaattgactctatagtataatgcctatagttaagaatcttgtattaatccttacctggcagaggtgataccatgatcatgaaggtggttttcccagggcgaggctgatccattcactctgggtgtgctgactcctgtgatttccccaaatgtggtagacttgactgcataatttgtggtagtaggggactgtgttcatgctttcccctcaagaaaaccaaccaaacaaacaaaaaaaagctgtattgtatacttaataatttgctaaaagagtagatcttatgttaagtgttcttataataaacaaacaaaatgataataataaatagagaaggttggaagaaactttctgagatgatggataggcctactgtgtggattgaggtgatgatttcgttggtgaatctttatctccaaactcatctgcatgttcacaaatctcaacgaacaccaaacaatataaaccaaagcaaactatacctacacatatcataattaaattactgaaaatcaatgataaaggggggcttttcttcccttcaggcccaccttgtggttttcaactgcaagaaggcaagctagctgttcaaacatgaatctgggcaggaggaggggaaggggcctctgtgaagtttttgaatcaagactgtatatattaagatgtatacattaatatacatagtttttgtatgtcaatcatacatcaataaagtggttaaaaaggaagttttatatttacagtcatacttaccacgtccagtggccttttgtgtgtgtgtatgtagatctg

SEQ ID NO: 1235 - DNA, 1249 bp, Homo sapiens
aagattcttaataaacaaacactgaaggcctctttcatatttgtatcatctgcatttttttttatatgcttgtcatgtggctttactttcagcctcactcttttcttcttccaaatggattatccttaaaccttttacctttaaagagcctgagatttatatttaactcgaacaacagtttgcctctgttgcccctgtgttcatgttttcctaagccagagtttcccacgcctcctgttcctggcagcccaagtgccttcgctgggctactcccacctggcccttgcttttcattccttagggcagtcacttagcaccttccaaagtgcctgcacatgtttcttatttcatttcttaaacattcatattaccactatttagattgaaggaacagaattggtttgggcttgaagagaatacaaagagatctgtcttcaattatctgatagtagtaaagtttcacgggagaaagaaagatttcggttccacataaggaaaaacttggaaagttttgaatggaaagttcatagagagattcagtaaccacctgtcaggaattttgtaaagacgtctacggccatatcaccctgaacgcgcctgatctcatctgatctcggaagctaagcagggtcgggcctggttagtacttggatgggagaaattttataaagaacacatgaacactagctggcctatgtggcctttaaaatctcttccaatcctgagattcccacaactctggataaaaaggggcaaaagtattagacatttcactcccattaatatgagggaagtaaatgacattgaggtccaatttgtctgtagttcagaattagtccaatacagacccttagaccaactagggaacaaaaagcaagcatttcaagttacctataagcctgggctcatcagaatatagaaacagccatgtgctagctgaaagccattcaatgaggctttctattaatttcctttaaaagcaatggttattattgaaactcctaaatgctaaaatctgaaggacccatccttatatctaagttctgatcatactgaaacagtcatttagcaacattgctctgatgtccaggaccctggtctgtaatgaaagcaatgaagggaggggctggcagggcactactggggtggtataggggacactgcttatattcacaaggccacgtggtccaagcatagcggagagcaaccacagtgccatgacaagaatcgatcgccagggtcagggact

SEQ ID NO: 1236 - DNA, 1179 bp, Homo sapiens
tttcttcaaaattaacatccaaatgttcactgtatgccaaagcatgccttagtaatttctattttctttccttttttttaattaaaataatttgttttagagacaggatctttctctgccacctaggctggagggcagtggtgctatcatagctcactgcagcctcgaagtcctgggctcaagtgatcctctcatctcagcctcctgggtagctggaactacaggaatgtaccatcatgcccaattaatttttttttttatttttgcctttttagagataggggcctcgctatgttgcccaggctggtctctacccctggcctcaagtcatcctcccccctcagccttgggatgacaggtgagagccaccatgttcagcttgtccagtattttctgatcactgttactaaaccttttctcccccttcttagtaatgaattgaaacaagtacttcctagtttatgataacagagtttcagctagagagaaatggacatgcccagatatctctagaaaagccagaaaacacttcagtttctttcatgttattgtcttatcaagtcctcgtctactgcacagaatgaaatttaaggcacgcacacacacacacacacacacacacacacacacacacacctcaaaatttaacaatccaatcacgttgaaaacagatgcactatgaacaaatacacagtccagttaacaagtattttaaaagttaaatctgaaattccttatgaaaacttccagcaatgtaaactgaaggagacttttgtggtaaattaaaatgcttaccgtacttatagttagatccaatccaatgagaccggccttattttgtgatcaagcatagtctttctttcagactattttgatcgaaatgggagaggatgtagaaaaaaatttatgtttcagtggaaaataatgtattgtctagaggacacccctccaaagtgacctgattttagcctaaagttctccttggtttaacaattctgcaaactgtagataaatatgaaaaacatcagttttgcctccatttgcacatccaatccaacattcttttatctatataaatttgtgcatttttttccttttttcttggaaccagttgaaacatctacttatttccctcatgaattaaatgtttaatgcacgttcatttttatatctgtatga

SEQ ID NO: 1237 - DNA, 1160 bp, Homo sapiens
tggcacatggttagccctggttggttgtccaggggtggagtcaccggcctgtcaaccagcatcctgcacctgtctggccttcggggccgtgtgagcggttggagaggggaccaaggagctgaaatgagggctcccatcctgattttggagtggcttctttggagagtctgcttttgaaagagcaaaggtggccgagcctaaggctgcagacttctctttttctaccctctttatctctgttttgacccctccctaccaggcaatgaccactactactactaataatagcaatagcagctggcagtttttgaatactgtgcctggcactgtgctaaacacattacatgtattactctatttaatcctctctagggatattagtatccccattttacagatgaggccattgaggcagagagaggttaagcagcttcccacagttctccagctggcaagcaacagaaccaagatttaagccctggcattttggttcccaagcccaggctcttaatcaccattacatgaaaaggaggaaaggtgtgtgcgtgcacagagagagagaaaaagagagacagagagacagagagagacagaaagagagagacagagacagaaacagagagagacagagaaacaaagagacagagagacagagagagagtcgggtgcaggagaggggagggagggaaagttgaaaatacctgcttctgaaactacgtactgtttatcccaataaactctccccagatcccaacaggcagggccctgcattttttcctctatagggaaacctgaaagctaagcttccagactcaggaaaagctacttggagccagaacacactacttggcatgttgcaggcatttaatattttttagatgactcagaggatggatggacaaatgaatacacttctggcctaggtgtcaggagaggaggtcttaagctctagcgagattgcagtgtgtggccctgggcaagtcttgtgctctatcctcgtcccctcctccaggaaatgaaagtgctgataatagatgcttatctcagccccaggccaaaatgtgctgtacaagttgagaatgtgagcttgaaggtgtcactggctctgctaacttccagggctctgggctggctctggttcagggagcgctgtttggagc

SEQ ID NO: 1238 - DNA, 1194 bp, Homo sapiens
taactggggagctaacaagttgggtttcttgccttttagtctcttccagttgcgcctcttctccttggtggtcttcttaagcaacagactcttccacaagacagtctacctgcagtcggccctgagcagctctacttctgcagagaagttcccttcaccgcatccgtcgcctgccaaactgaaggctactgcaggtcactgagttgcctgccatccaaaggggatgggcgggattggaagaagctgtggcagctcttttccctgttcacctcccgcctgccagggaaggcaggacccgctctgccaagggccctctgcgtattcccttctctctgaggaattgaaatttttgtctctggtgcacgtaaggcagaatgttccctgacaccagtgtgtggatttttaacatcaccgtgagtctgaaaggaccacaggtttttctgcagctattttctagcatttgccagtccctgtgcctggactgattggaacactttgtttttctccctgtgccatttacccttccacctttccatcctgccttctaccacccttggatgaatggattttgtaattctagctgttgtattttgtgaatttgttaattttgttgtttttctgtgaaacacatacattggatatgggaggtaaaggagtgtcccagttgctcctggtcactccctttatagccattactgtcttgtttcttgtaactcaggttaggttttggtctctcttgctccactgcaaaaaaaaaaaaaaaaaaaaaaaaaaaaaaaaagcctgaagagatgagataggaggaaagacctcacagccagatctgctgggttttgaggagtgattttctttcttccccttgaaggggaaaaagctattttcattggtacatttaaagtcccccaactatggggaggtaccaattctggacaagtgccactacaacaacactaaacctgaacttttcaactccgttggtggtgggaggcagcgggcagaaatttactgttggccactgccaggtctatttcatatttcaaaggaatattgggtgctgcatataggaactgaaggggtcaatgtattaaacctgtgattggttgttttcctgtcattttgagagactaaatgtggggggcagatgtcaaaatacctgtacaattttaaaatgtcacaattaaacatgagctggtt

SEQ ID NO: 1239 - DNA, 1197 bp, Homo sapiens
tgcaaactcactgaaaattttacttattttagattgttcttagagagtagatgatcccagtctgccatcattttggcggttgttgcagtgatacttttccagctggggcttgactaaaccagtttctgtgattatcaggctcacgggtggggagagtgcaggaaatagagaaaaagttcacatgtttatatttagctacattttcttctctctctgaagaacttaaggtatatagagtcatatagaaccacataggagtatatctctcatataagaaaagattgagaacccttgatctatgtggagggtagatcagtaatattggtcctcacagaggtattccaaaaggctaagcagagagaatctagtctctagtcagtgcttgtgtattcacagccctaaaccaggctgcagaacccaacataatcctgcccactctgggtgaatccattttagtagaaaatttctccaaagttgatctgattgtaaatattaaactgacatctttatgttgcaggtaaaggacctggataatcgaggcttgtcaaggacataaatgtcacgtccagctctgatatgcttcgcactgagcacatcacatttaggacgttgaagatttttttttttttttttttttaatatgcagtttgtaagaacaaaactggatggcatcagaattgtctggaagttttgtcttgggcagtatgggctgggccaaatgaaatgatttttataattctaaacaggttaccaaatgaaatgtcatggctttactttggtcaattaaaggggggaatttttttaaaaaatgtgccttatttgttttgacttataactgatttgagggaggcaaaagctatgctaggctgccagaaggacataagcagaccttgtccattctcttagctccctaaattagccaaatagagacttctttctcaaatcaggaaaactatcaaagaccaattcagatcctacatttacagacagttttgtcataaccctttgcattgcagcacctagtacaattccttggaaacagcgtggctcaataaatttttattgaatgaataaatgtgggaccagaagagtgctagaagagtgcctttctgggctactatgtctctgttctcaatgtcttttatccttagacgctctttgactttataaatcagcagttttgaagactcaagacaa

SEQ ID NO: 1240 - DNA, 1222 bp, Homo sapiens
ataacttgaggcatcaaactttgggtcttgttttctttcccagaacaaacccttttaattaagagccacagactagcagttgtcctaggaactcatttctggatctaaaagaaaatagctttacattccatgttcaaacaaaaagaaccaccagctgcacacatctctttacagaatttgtaaagttatagcattctaacatggtttaagaggcagggttagcataaagctaatgaaggttagtcttcagaactctgcactttcatgatccccttctagggaagtcggaagggctgtgtattcataatttcttatggagagtgaagttggaggggtactggcattttgtatttgttttatttttcttatagagggccctccatattgtttagctttcaggctcccacatgcctcttggtatgattgtgacgagaactagagagactttgagagagctgtttgtgaagtgttaacaattctttcttctgcactccttccctaaaattgggttttcttgatgtgttccccatttcccacctgaagtcaatgactggcacccatccaaacatggctcacctgtagatgtgcttgaaattggtgcacctgaagcctgttcccctgaagcgtgctcacctgaaggctgttcacccgaggcctgctcaccagaaggctgttcaccggagccatgttcacctgaaggctgttcatctgaaggctgttcacctgactcaagctcactcaaaggctgttctccggagaggtgttcacctgaaggctgttctcctgaaggctgctcacctacagtatgctcaccttcagcatgttcagtcgcagcgggctcacctgaagcatgctcactctcagcatgttctccagaagtgtgctcggccacagtgtgcttgcttgaaccatgctcactggaaccatgctcacttaaagtgttcaggcctgaagaagtctcatataaagcctcagcatcagaagggttttcaagtgaaaagaactcacctggaagttgctgaactgaagtttgatgatctatggagccagaaagctcattaggctgacttgatgttcctgggatggagaaggaacagaagagagttggtgaagctgacagaatgggataaagactatcttcctatggagttaggctaatgttatgagactcctaggtttcctatgggcctagattgggcacctgaagactgcagatgttggg

SEQ ID NO: 1241 - DNA, 1179 bp, Homo sapiens
ttatttcttttgcctatttttctacagggttgtttattattattatttttttttatttaagaccgtgcctggccttttttttttgagatggagtcttgctgtgtcacccaggctggagggcagtggcacaatcttggctcactgcaacctcctccctggttcaagtggttctcatgtttcagctagctggaattacaggcacatgccaccatgcccagctaatttttgtatttttagtagagatggggtttcagcctgttggccaggctggtcttgaacccctgacctaaagtgatctgtccatcaaagtgctaggattacagcgcttacagctcacaggcgtgagccactgtgtctggcccaggttgtttattcttttctatttgatttgtaagtattcattttatattttgaatgttagtcctttttagattacagattttgcagatactttgtgaatctgaggagccctttaaaaatatgtatgattgagacttacccacagaagttctcattcgtaagtgtggtggttgtggggattggcatctgtattttaaaatttgatatacaatcaaatttaagaactatgataagattatggagaatggaggaatttaggacagtagctaagacctcaaaaagatgtgtgttcaactctcaactgtgtcatttaacagctgtggggccttgggcaggttattaaatgtccataagctttgttttcttcatctgaaaaatggaaacagtaggatttatgagatagttaaataagattgattcttgtgaaatgtttaacacagtacctagttcataggaaaagttaaaaaataaaaaatagagacttatttttctattcaagcaatcaaaatattaagactataaaatacatgttatgttatttgtgaaaaatgtccattaaggttcaaaattggtaaccattctcggtatcaggttcatggaggaattgaaatcaatcagttgggtcttgctgatggaacattcttgagttgtagtgtcatatcattaggaaggacattcttgtcacagaagatctacaaaatctgtaaaatacgataaaatgtaccagatagtagctgaaactgaagtggagtgtctgcgttgtgaaatagtgtgtgtgagtaggattttgaccccgtggttagtgattatacaaccgac

SEQ ID NO: 1242 - DNA, 1156 bp, Homo sapiens
tcacaactgctaaggaatttcttggacacatcccatcccatagacccctcagcagcaggtagagggtactctgtgctgagccctgaggggagtgaggatggagtgtggctacagccttcccgagaaccccagtgttttgtgcacccgcaggttcagagcgcctgggccggctattacgactacaacacctttgaccagaatggcgtggtgggcccccacccgctagttgtcaacatgtactttgctactggcttcagtggtcacgggctccagcaggcccctggcattgggcgagctgtagcagagatggtactgaagggcaggttccagaccatcgacctgagccccttcctctttacccgcttttacttgggagagaagatccaggagaacaacatcatctgagcatgtgtgctctgcactggctccactggcttgcatcctggctgtgttcacagccttgtttgctgcttccatcttccccagtactgtgccaggccttctccccctccccagtgtcctctcctctcaggcaggccattgcacccatatggctgggcaggcacaggcagtgaggccgaggccaatagcgagtgatgagcgggatcctaggactgatctgtagcccatgctgatgtcacccaccagggcaatccatctggaggcctgagcaccctggcccaggactggcttcatcctggcactgaccaggaaagactgcctctgaccctcttagcagacagagcccaggcatgggagcactctggggcagcctggctcaggtttattgattttcgtctgtttaccctatccattaatcaatacatgtaattaactccttccctccagtcttctgtctcttcttttcattgtacagcaggagcttttgaagcaccccattagccttataccagtacagggagtttttttaaaaaaaaacaaaacacgagcacaaacccacctttcattagttaaatccttgagcggtgcagtatcacacagattgtgtgtctgtagtcttagcaggaagattgggaatttggcataaaccatgccactgtttccgtgaacccaagttactttttcccagattactctggttttgtttggtgtgccaccagaagtcgctgtgtggttctttgctttgtgtacatga

SEQ ID NO: 1243 - DNA, 1225 bp, Homo sapiens
agaaagggaaccaagtgccccctgggcacttcacatacattaatgccgttaatcctcacgataatccaggagggagaactgttattggcctaactttataggacattgaaatcaagaaagacttggtaacctgctcactgtgtgagtcaggaatagaggccttattttttccactacctcaaactaccagccagttggtaggaacgggagcttaggggaatacttcggtgtgggtgattttatgttttttttctaggaaactcagctatagctgcccagttatccatggcgtacatcttccaggttatctgcatacttctggaccagtgtctttgtgtgtgcgttgtttatgtccctctgaagctttctgtgtatatataggtcacacattcctgcaatgtaaatcagtcaagcaggcagcttagaaattcttatccattcagacctttggcctttgcttgtgtaaactggaaatgtgggtgtggagagtcaatgtggggactagaatgttggaagaatagaagagaagcccacaggaggtgtgtgagggcagaaactgtacttgggggattttgccctgaggttcaagtatggctgtagctgcggggacctggcttctgccatgaaggaggacttagatggaggagctgtgccaagaaccagcaaccctggagtgggtacatgcctggcccaagcatgttcacatgcacgagttcactgacagctttcagaaccagcatgactgaaaatactctgtttagcctaccaaatgttccacatctccccaagctcccaggatgtctccggcacccaccaaccactcatgtactcaggttttccagaatccaaaaacagattctcaaaaaggccgaacatttggcagggaagtatttctaggtaaatgatatgcacagttatgtgatctccatcccagagggaaacattggctaagaggattggttgaagaaaaacaactattagaaaatgtgttcaatggggtcatgtttatgctccttctgtcaactaaaactgtgtgtttaaacaatgtctttggtttattacagtcatcacactgtcagtagcagataatgtgcttgaatttcacaagtgtatgtaaatgatctagggtagcagggcagctgtccccagtcaacgttttcacattgtgataattctcaggaaagagaaagacatacttaagagttgtacgttatctgtcttctca

SEQ ID NO: 1244 - DNA, 1905 bp, Homo sapiens
gcaccctgtgcaggtctcttcccagacaccacaatgaccctcaggttttgttcttccaggttgatccaatgctcaccccagaagagcgtcacctgaacaagatgcagaaccatggctatgagaaccccacctacaaatacctggagcagatgcagatttaggtggcagggagcgcggcagccctggcggagggatgcaggtgggccggaagatcccacgattccgatcgactgccaagcagcagccgctgccaggggctgcgtctgacatcctgacctcctggactgtaggactatataaagtactactgtagaactgcaatttccattcttttaaatgggtgaaaaatggtaatataacaatatatgatatataaaccttaaatgaaaaaaatgatctattgcagatatttgatgtagttttcttttttaaattaatcagaaaccccacttccattgtattgtctgacacatgctctcaatatataataaatgggaaatgtcgattttcaataatagacttatatgcaggctgtcgttccggttatgttgtgtaagtcaactcttcagcctcattcactgtcctggcttttatttaaagaaaaaaaaggcagtattccctttttaaatgagctttcaggaagttgctgagaaatggggtggaatagggaactgtaatggccactgaagcacgtgagagaccctcgcaaaatgatgtgaaaggaccagtttcttgaagtccagtgtttccacggctggatacctgtgtgtctccataaaagtcctgtcaccaaggacgttaaaggcattttattccagcgtcttctagagagcttagtgtatacagatgagggtgtccgctgctgctttccttcggaatccagtgcttccacagagattagcctgtagcttatatttgacattcttcactgtctgttgtttacctaccgtagctttttaccgttcacttccccttccaactatgtccagatgtgcaggctcctcctctctggactttctccaaaggcactgaccctcggcctctactttgtcccctcacctccaccccctcctgtcaccggccttgtgacattcactcagagaagaccacaccaaggaggcggccgctggcccaggagagaacacggggaggtttgtttgtgtgaaaggaaagtagtccaggctgtccctgaaactgagtctgtggacactgtggaaagctttgaacaattgtgttttcgtcacaggagtctttgtaatgcttgtacagttgatgtcgatgctcactgcttctgctttttctttctttttattttaaatctgaaggttctggtaacctgtggtgtatttttattttcctgtgactgtttttgttttgtttttttcctttttcctcccctttgaccctattcatgtctctacccactatgcacagattaaacttcacctacaaactccttaatatgatctgtggagaatgtacacagtttaaacacatcaataaatactttaacttccaccgagactgctcgtttcactgactgcggcattgatctgcgtgatggtcctacccccttcctccaggagggtgataacttcgttccacgaaggaccccagctgcacctcacaggcggaaatacgtctgctcaagctgtgactcaaggcttccagcgccgtttcgcatttagaaagcaaagtaagagggaacatctgcacagagcatttgtctggcaaaatttaggctactgatatttattaatatgagacttcttaatgctactgggaacaatgagtagggcttgtggctgaattttcagaggaatgcttgcagcttccatttgcttaaataacctgacactgggaggccctgtcacctcactgatgggggtgtttggtttgttgcct

SEQ ID NO: 1245 - DNA, 1417 bp, Homo sapiens
atgcaaccagcagagtaaactgctccaacacctcgggcatgtcctagggcttgccctcccaccagggccagcccaagattaggtcctcagcagcatcaaggtctgggagagccactggcccacatgtcaccattctattcctcagcctccaacaggactcttcattttggggagggaaagggaagatggggccatagcccctaccttgaaattgtacagtgtggaggggatgttagtgcctacctgtgacctttctgctccactgctcagcaagatgaggtaaggttgggtgtcagaggggacctccagcttctctgaagagccagcccttaaggcacttggagcaaaggtcattgagatcagctttatgtggagtaaggaggaggcctgggaaccgcttgtggcatcagttggggcgacaggtggatgagtgtgctctgatggagcttttacggcccacagccactgccaggagcctgagctcttccccatgcttgggacacgttccttggtccccacagcagaatggacattgaattttggtgcttttccctttggtagaaggtggaggtatctgaggagttgtttctgtcttgctacctctgtctactatatagagcaagagtcgggaatagggagatgtgtgagaatcactctcccatggatcagtgtgggccctgtccctcttccccactgtcaccaaccagcagcttggggaaaaggctctgtcgtggatttttgctgcctgcttcccgcttccactcttcttggcggtagatgttcatggtgatccactttgggcggtctgaaagtaggaggtgggggaagaggcaagcctgcacacacacttcctgtccacagggggttgcctgtggcattggagggtggagtctcagagtccagggactgggaggaaggtacttgatgggatggtcttgattctggaactttagactgaggtgttagaaaggggaattgttggctaggggagaagagcagtttaacgctccacttgctaagtcgtctgtatcagtgtcagaaggtcttgacctcccattcagatttaatttcctaactgccaggtgtggggctggggatagagggcccagaagggggcgcagtcactgacgtgaagggaccacatcccgcttcatgtcagtgactcctgccccttggtcttcagtgtttttctcttccccaggagggactttgatcatgcaggatagaattctcccatcgcacacctgggggcaagttttagatgagcttctttcctccatttcacctggtggtctgaggacacacagagggtgggggtgagcaggcagtgtgggtggggaggggctacctcccccagaccccttacaaactctgtacctctcggtgcgcggcagcctcttgctgtagttcttctttt

SEQ ID NO: 1246 - DNA, 1417 bp, Homo sapiens; identical to SEQ ID NO: 1245

SEQ ID NO: 1247 - DNA, 1168 bp, Homo sapiens
ccctgagggcttcctcctgtgacagtgtcctcggaggccagcagccctcctgcagcccgtggacggcgatgggattggtggaacgcagttccctccgtggatagagggtgaagatgtcacaggcacaagtttaggtgctgggtgtgggcatgtgtgacagcgtggttgtgagcatgtgggtgatgggggtgtaaccacctctagggaccagtgtccttcatagtctgcctttgaacaatggcagtgactactgatcagcttcttaggacttcggcactcactctgtaggagatcacgccttccaaacttccccttttacggtctggcggccttgcagtagacacgactcagatgtaaacctgcttctgtgtctcagatgtctgtctgcctcttcagcatcatggctgagaactgtggctgttgtagtgtcaggtgacccacagaccaggaagaggggaaaacggttcttagcggggcctggacaactgcatttgcgtggggagagaagatgtacgacgaggcagagaggcgaagcctgtcttgatttgctggtgggctgccgtgggctccctggtgctgagcggggtcctgtgctggattgttggggtggctctgggcccagcatctgggagtggccctgcctgctgccagtctgcctctaagcagcttccctggagagactgggggtaggacaggccttttgagatcctactttcttagcaggaaggacgcctttttcccagcaggctggcggggtctgtgccctcctttgaggtgcttagtcccacaaccatgcgcttgggggaagactgaagccgggtggattgagccgagtatttcttgttatttttccatgctctctgtctttatttttgatttgtgatctaaaatatttggggttgaactgatttaatttattcctctgccctttttgtgctgaggaaactggggtaaggttcaaatgtgaaattttctgattttatttggggtgggggacaaggttgacgaaacagtagcttctagggagaaacagatttcacggagcctccagcatctttggcactgcccacgatctgaatctccagggctgaagactgcgtggctggaatctgtttcttcctattttgttagcaaaagccttttccaggcttgggggtggggtggggga

SEQ ID NO: 1248 - DNA, 1357 bp, Homo sapiens
cttccctgtgtctgtctgtctgctctcccacctggcttccctgtgtctgtctgtctgctctcccacctggcttccctgtgtctgtctgtctgtctgctctcccacctggcttccctgtgtctgtctgtctgtctgctctcccacctggcttccctgtgtctgtctgtctgtctgctctcccacctggcttccctgtgtctgtctgtctgtctgctctcccacctggcttccctgtgtctgtctctgtctgctctcccacctggcttccctgtgtctgtctgtctgtctgctctcccacctggcttccctgtgtctgtctgtctgtctgctctcccacctggcttccctgtgtctgtctgtctgctctcccacctggcttccctgtgtctgtctgtctgtctgctctcccacctggcttccctgtgtctgtctgtctgtctgctctcccacctggcttccctgtgtctgtctctgtctgctctcccacctggcttccctgtgtctgtctgtctgtctgctctcccacctggcttccctgtgtctgtctgtctgctctctcacctggcttccctgtgtctgtctgtctgtccctgtgtctgtctgtctgtccctgtatctgtctgtctgtctgctctcccacctggcttccctgtgtctgtctgtctgtccccgtgtctgtctgtctgtccctgtgtctgtctgtctgtctgtctgctctcccacctggcttccctgtgtctgtctgtccctgtgtctgtctgtctgtccctgtgtctgtctgtctgtccctgtgtctgtctgtctgctctctcacctgcgcttcctctatgcagacccagcgcgtgtcctcaacatgccccctgtgatttacgtgcccgtggggatccatggctacatccgctgccctgtggacgcagaaccaccggccaccgtggtcaagtggaacaaggacggccgtcccctgcaggttgagaaggtgctagagagatgcatgttgagggttggagtgagggctccccccagtactgtgatgccacctctgggctctggatttctgccaggactcctggccccttccaaaagccctgggcaaacagagagctgcttctgtaggggtctgcgggtgccgcccgccccgggctggagctcctgtactatcctgcgtgctgcctggcccagctgggacccagcctgggatggagcgcggagtctctgaccagcgttccctgccctatcgtctgtgtctggcagaacctcggttggaccctgatggaggatggctccattcgaattgaggaggccacagaggaggctcttggcacttatacctgtgtgccttacaacactctggggacca

SEQ ID NO: 1249 - DNA, 1446 bp, Homo sapiens
gccctgctcggaggagacccgcccctgcaccgcccctcctcccgctcccctcccgggccctctggttgggagagtggagaagagtcgagaagagtggagaagagtcgagaagagtggagaagagtcgagaagagtcgagaagagtggacaaggcgaaccgtctgcagcgaggcggggctggggggcgcggggaggacggggttcaggccggtgtcgctctcaaggggcagccctggtgtcacccccaccccctcccacgctgaagccttccggccgagctgtggcatccacgcaaatgggtgggcccaggattgggttttcggcttggcggtgggggtgggggcgggggcgcgcggctagagactgcaggctcggaaggatcagatctgttaactccgagtccctcccttgaaatccgtgccacctttcccttcctctttcccagggccgcctcggcacctccaggccagaatttaaatgttatcagcggcaattgatctgctcgggactgaggtttcgggtcctctgcggaattgggaggagcgtggatggtgaaggagctgctgcactgtggcacgggcttggccggggctgcctggctctgagcaggctcgtgggacggccctgtaaggaccccactgcaagaagggcacagaagcacctgagttggcgtctcagcagggacccccccaggaaatgcccttctacagctggtactcaagctctttacacacttagccatcgctatacacagtccacgcttgtgcacccacacccacaagcttatgctcacgtgcacttttttttttttttgagacggagtttcgctcttgtcgcccaggctggagtgcaatggcgccatctcagctcactgcaacctccgcctcctgggttcaagagattctcctccctcagcctctagagtaactgggattacaggcgcgcgccaccacacctggctaatttttgtatttttagtagagatggaggtttgccacgttggccggctggtctcaaactcctgacctcaagtgacccgcccgccttggcttcccaaagtgctggggttacaggcatgagccaccgagcccggcctcacaggcggattcttgaatccgtgtgtataattcttctcttacagtcatccagcaaacatgtacagaccctgctcacgtttccacataaccatcctcgtcttccttttctatccttcgggtccgcgcatttgccatccatacatgttactggatacagttagctggaacatatgaaatgccctttcctagcacacacaatggatctacgtatgtacaggcctaaaaacagaatacacatcctacatgacatgtacacatgtgcacacagaaacaacagccttcacgccgtctgcatatgcgggccatgcccaggtcccaggcacacaggccaggcgacagtccacttcat

SEQ ID NO: 1250 - DNA, 1232 bp, Homo sapiens
gcaaggacttatgttctgggaatcgaaggacaatgattgcagttcctgactcagataccagcttgcgtatgctggtggccagcctcggactgcgtgagtgctgcctggtctccaccggcggtcatcgtactccggatgttcacggcactccggatgttctgctgtgcccggttgcatggatcctggcctatctgtgtctggtcatactctgcatggcagaccagaaagagatgactgtgaccccagtgaggcctcccagccgtaccatgaccccggttcctgatgagtgtttgcaggattgacgggtgatgcagggatgcccgctggcatggcaggacgcatttcaagcctggcacacttcactcaaggagatcctttctggtggtgacaggatctggctcacctcccacccagccgccctgcaagatcccctctgaaacttgacagccagtcccattcccagaaagaggtggtgaccttgccacctgctcatctgcccttttccatccactcacatccgggagcactttttactacacctggaatctcctgcctgctggggcctgccctgtacccttcatcctcaggacccacctcaccagtcaaggaaaaattactccagagggctccacctccccctgcttcctcaccacggggcacagcagaacttggtacctatgtcctctgcttcaggtttccattgcaaccaatttttgtgtctgcagcttgcccagccttcagcacgaatagtgcatgccccttttccacttgccaaaagggaactggtgaggatgggctgtagaggtcttgttaggttgtgcgcggccccatcagaagtcctgatgtgcctgccttcctccaggaaccccaccttggaccatgaccatggccaccctctccatccaggtggaggagcggagcctgactctgagcagagcagacctgggcactgagcactgagttcagggtttgctgtccggactcttctaaggtggaaaaatcgctttggataaatgaagccgagatacataggcaacaggaatcctagcagaaagtgttaacataagctccagttcaaaagaaggcaggtgttcctggtttcatcagataaaggtccatcgtggatgaactgctccccaagaaaagtgacagaaacacgctgggcttccttaggatttggttagctgcttggtatcaagcctaatttaggagtaaagtcttgctgaccttta

SEQ ID NO: 1251 - DNA, 1228 bp, Homo sapiens
gaagggggttgtattcatcaatggccagaaccttggacgttactggaacattggaccccagaagacgctttacctcccaggtccctggttgagcagcggaatcaaccaggtgggagcttccagccccttcctgttccccatgacgccctgcccacctgccgtcccagggagccttcggtcagggtggaggggcgtgtcagcgggttcttcctccctcctcctcgctgcagacgagttgttggtccctgtcccttccagcctggttcccaaaccctttccttctgaccctgccacctctcagcacctcccctggctccaggacagacgtcagctgccctcccagccgggccctctctccacaggtcatcgtttttgaggagacgatggcgggccctgcattacagttcacggaaaccccccacctgggcaggaaccagtacattaagtgagcggtggcaccccctcctgctggtgccagtgggagactgccgcctcctcttgacctgaagcctggtggctgctgccccacccctcactgcaaaagcatctccttaagtagcaacctcagggactgggggctacagtctgcccctgtctcagctcaaaaccctaagcctgcagggaaaggtgggatggctctgggcctggctttgttgatgatggctttcctacagccctgctcttgtgccgaggctgtcgggctgtctctagggtgggagcagctaatcagatcgcccagcctttggccctcagaaaaagtgctgaaacgtgcccttgcactggacgtcacagccctgcgagcatctgctggactcaggcgtgctctttgctggttcctgggaggcttggccacatccctcatggccccattttatccccgaaatcctgggtgtgtcaccagtgtagagggtggggaaggggtgtctcacctgagctgactttgttcttccttcacaaccttctgagccttctttgggattctggaaggaactcggcgtgagaaacatgtgacttcccctttcccttcccactcgctgcttcccacagggtgacaggctgggctggagaaacagaaatcctcaccctgcgtcttcccaagttagcaggtgtctctggtgttcagtgaggaggacatgtgagtcctggcagaagccatggcccatgtctgcacatccagggaggaggacagaaggcccagctcacatgtgagtcctggcagaagccatgg

SEQ ID NO: 1252 - DNA, 1190 bp, Homo sapiens
gaaatcggaagcaacagggacgcttttagggaggtgagtgagagggatgcccgcctccaccatctcctgggtaaataatctccctgctgtccaggacctgcagctgatccacccccaggcacctgcttcatcctactggctttataatttccagtctctttccattgcctcggcgcatactcagccaagccctgagcctgtgtcattcaccagcaaatacttactgagcacgtagcaaaagccaggaactgttctaggtggttgggatacatctataatcaaaacggaccaattccctgtcctcatagggcatacattctagaggagggagacagacactacacaataaatgggataaatgagtaaattaggtagcattccagaattaatgagtgctatagaaaaagaacaaggagagctgggtaaaggggatcaggagtgtgggtgtgggtggtggcaatttttaaaagggtggtcattgagagcatgtgagcaaagccttgccaggagtgagagaactggccatgtggatattatggggttgggtgaaagtgctttcctctaggcagaggaaacaaaggttgaaacgaagcaagagtctggctggcttgtttgaggaggactcaagcctggagctgggcaagtgaatagaaggtaaggtcagggaagtaaatgggctggggacagggagaggggcagatcaggtatgtcaggttggccactctcagacttcagcttttgctctagtgacattcagatgcagggcagggttttgggcagcagtaatctcacattatttccgccccctccaagatggagtctcgctctgtcacccaggctggagtgcagtggcgtaatctcagctcactgcaacctctacctactgggttcaagtgattctcccgcctcagcctccccagtagctgggactacaggcgcgcgccaacacgcgcggccaatttctgtatttttagttgagacgaggttttgccgtgttggccaggctggtctcgaactcctgacttcaggtgatctgcccaccttggcctcccaaagtgctgggattacaggcatgagccactgcgcccggacagtcatcttacattttaaaataatctctctagctggtatgttgagaactgagtataggggagtgaaggcagaagctgactggttataaggcaaaaatc

SEQ ID NO: 1253 - DNA, 1258 bp, Homo sapiens
agtgatgcatgcttttcggggaaaacttcattcacaagtattccagacaccaggcttcaggcatggccatgagcaagaccagcaaataacagctttttgccttgcagccctgaccccaatgtctgctgtttccaacactggtgatttctaactacggcccacagcagatgctgttgaataacaccatggcttcatcagaggatgtggggttgtagtacctctgggtgatgaagttgttttagtaaatccatttttaaaaaaaaaaaaggacttgtttttacttttttctaaatgtctctgactactgactgttctatacatagattatttttccttttttaatatacatatatgaatatataaatatatatatttactgttaccagcagcatatgacagagtttcaacatcaaaaatccatttgggggcttgctttttcttttttgctttaaaaaaaaaaatcccattccttctttgtagtacaaggagttagcactccctcctccatcccagcctgaccagatcttccattttgcttttgttcatatagataattatatgtcctttgtgtgttgggacttgtccctgtctgttgggaaacttggtctcactctagtctgtgctggctcttttttcttttgtgtgtgaatgtttgaaactatggtgctgtgtcctcttccctcctgttgtgttctctgttcttcttaaggtattaggtaagctgtatgtaaactcttattagaaggggactaatttttttttaaaggacaaaaaaaaaaatgactaaaaatagtgttttgtcatcactgtctggtgtctttattttggtttaaaaaaatctgtggtttgacttaaattcatcagttttccttttaaaggggggattggggtggacctagcaacagcttatagtttcctcttccctttttgccccagtctcttttaaagaactgtcttctagtaactagaagtgaaatgtactgtccagttacagtttgagtgggtatgagatttaactcaaaaggaatcttacaaaaaaaaagatgttttcttataaaatccaatttctgtaaatgttttctctgaagttcatactacctactttttattcattcttaatactgtataacattttgagtgttttgacttgttcagaggtttgttagtgttgctgtgcatatgtcttgaggtctcatctgaagtaagtttgtgtatgatcgaagatttcaatggatattgcaaggtaactaattaactg

SEQ ID NO: 1254 - DNA, 1197 bp, Homo sapiens
ctttgaataaagttgttttcatttcattataacagtgatgagggggaaaaataagttcagcttgcagatcagcttggtactgcccattaatctcattgttacacttaaagtccttgcaatgttaagtgagctctgattaggtctatgattctccttgaaattagtttccacaagctcacctacatagacacaatcccaaaagatgcaggacagactttgcttcattaaatatgtacctcgtaagtaatgattttctggatggtaactaagataaaatgactgattttattttactaaataattacctacccctcctcctaaaccaagagggggctcttcctcaagcaagaatactaagttcaaagtattttaagttatgaatttatggtcacaacagaggacatcacacaaaggaaaaaaccaccaggtcaaatgcaaataaaccggcaaataaaattttcattatacaattatcgcttgctctgtgggaaaatgctcaagagtataggcttttttttttttttttttttcattcaaagatatcaacatcaaagtaaattggcaggggtatatagctcagtggtagagcatctgactgcaaagtaaatttgaacttgaattaccataagtcttgccaccattcttctcagctgtcaaatacattgctaacactagaaaatccataatcttatttttctaccctgccaatacccactaccaaagagacagtaagctaagattctcatataaattcctccacaaaaagactactccatccaaccatatgaaactgcagttgtgatccctagtcctgaaaatcatcaatacttgtgatgttttcataggttaccagtctgctttcaagcaaagcccatcatgttaagcaattctagaagagtggctgatagctaatgtgctagaaagcaaccaccaaaaatatcaaaggcctctaactagggtaaacgggtgattccagtattcaaggaaaaagctaattatacttggcatgggttgcatttcttttcagctgctcttagtcaccctatatacaacttcgtaaacaaagatagtcattaacttctggataacaacgtgcttaagaatgtaccgctgtgtgtggtataagctagtgtacctttcagcagactgccaatgaattcttcataatgggatttagcagtacactaagatgatatt

SEQ ID NO: 1255 - DNA, 1304 bp, Homo sapiens
gtcttctaaaatagaaatgagaatctttttctgaggtttccagagctcttgcaaaataatccaatcttaaaattctctgtatcttttaatgtactttaaactaatagaattcattcttgttgaatcttaagtttgccaaagttgcaagctaatattcattgttttccctgtctgcacccttcagtcagttggtcattcttaaattcatacacttgtaacacttggtgttatttcagaatatttagcatgataactgatcattatcatgatcattcattaaacctgtccttgactgacaacgcagaatagttgtgaatagttgtgatctgtcagatgtgctatgttgagttatagctctcctcaaaaaaaaaactgactttgtggaattgggagaggatggaacatttcttcatgcaactatgccctgttatcattgtacttttgtttattttgttttcacagtactgtgtttttcatgtgtgtgtttgttttgtgttgagcctcgtcgtggccgtagcatgtcggtttgtgttcccatctttctgctgttgcctctgtgtcccgcatctctcccagtgctcttccaccccaccgccagtactgtctgcacctctttctccttccctcctccggactgccccgaggaaacttttgccgaaaagctttctaaagcattggagagtgtcctgcctatgcactctgcctctcagcgcaagcaccgacgctccagcctgccttccctctttgtcagtactgtatgtaactgtaaacttctgacaaatgaacaattattaccaatgaatacatccaggcaacaagaattttaattaaaattgaataaagaacaggactaaacttggttatattatgcttctaggataccagttattcctgtaggaaacttttttgtaataaggctttaagggggaataaaaagcaaggaggtaatgagagagaatacctataatgtccttggcacataccagcatgtgtccaataaaatttacctttcattatatcttcctgtttcctatcgacataaaattctttcattttcatattctagttttaaaaggattaattttaaagttattgccttaatcaaaagcaaattttatcaaacattacccaaacattttttctcctcactttattctaaggagacactaataaaactggatgagtcctttttttttttaataaccttagtcagcaaagaataaccttggagtgaacatttattttaatttaatcatttatgtaagatgatgtatcagcaaaccaaagaactacataatgttccc

SEQ ID NO: 1256 - DNA, 1183 bp, Homo sapiens
ggctggagtgcagtggcacgatcctagcttactgcagccttgagctcctgggctcaagtgatcctcccacctcagcctcccgagaagaatgtttaaggacagtttatcgaaaaaagtagatgaggaataaattatgtcaattttgattcacatttaagtgtggtaaggaattaacacagcttttccttaaaaacatttgtttttctaggtgtgctacattgagggtcatcgggtaattaatctggccaatgagatgtttggttacaatggctgggcacactccatcacgcagcagaatgtgggtgagtatgctctccagcagtggggacttctgcactgtccagctcctgctgaaagtctgctgtgggtgaggaggtaaggtaggtggactcagctgccagcaggaggaatggttgtggcccagcggtcagtgtcctcttcaacttgctctctttcccactcctagattttgttgacctcaacaatggcaagttctacgtgggagtctgtgcatttgtgagggtccagctgaaggtgaggggatggagtagacctgctgcccggaaggatcagtgggtggtaggagaaggtgagcaggtagggaagtaggtagctggacggggacccaggctccagagttgtgtctcagccagcgttccctagagtggtggaattcaaatactcttgctcatgtgctccctaaaagaatggaaaaactgttctcttgcacatgttcaagctgacacctaaaagttttcaccatatataaaaattgttgcaaaggatgtattttttggcatatggtaaaatctgacattttaaaatacaataattttaccatcactgataagtgtttggaaactcaactttaggcaaagcaggtccttttgttataacattgatgaaaacaaaaatatgttttgttaataagttgtttcacttcaagtcacagttatttaaggtgttaagtgagcacttaccgtaaatctgttgaatcttgttaaatattccagtggactctaaatactatagaggataagatctatcatttatttgaagaaatacaatgaacaagcttttttttaatcattagaaattttacattgttctttctttatctgaactcatatttctattctatttccccactggttttaatcctaatacatatttatggttgaaa

SEQ ID NO: 1257 - DNA, 1215 bp, Homo sapiens
taaaatatctctaaaatattgtttactatgagtacattatgctgtaatcacattctgaatgcgtgagtacatacatggtagaagggctagatcttctttaagtgggggtaatggaaagtctctgagaagggaaatatttattattggaggatttaatgtgtgatcttttcattacagatatggtgtaagatacttcttcaagattggacagctggggaccttcttctgattaaccttaaaccaacttgtagccatagagacacctcacaaggttcccatttttgttgttgttgttgttgattttctgctcacacctttcctgaccttgcaaccatgtatggaagtgcccgctctgttgggaaggtggagccgagcagccagagccctgggcgttcacccaggcttccacgttcccctcgcttgggtcaccgtcgaaccaacagtacgggagggagttcgggaagcagtgttggaggtggcagtgggaaaaccctttcaatggaaaatatacaatctttaaatgctgcctatgccacctctggccctatgtatctaagtgaccatgaaaatgtgggttcagaaacacctaaaagcaccatgacacttggccgttctgggggacgtctgccttacggtgttcggatgactgctatgggtagtagccccaatatagctagcagtggggttgctagtgacaccatagcatttggagagcatcacctccctcctgtgagtatggcatccactgtacctcactcccttcgtcaggcgagagataacacaatcatggatctgcagacacagctgaaggaagtattaagagaaaatgatctcttgcggaaggatgtggaagtaaaggagagcaaattgagttcttcaatgaatagcatcaagaccttctggagcccagagctgaagaaggaacgagccctgagaaaagatgaagcttccaaaatcaccatttggaaggaacagtacagagttgtacaggaggaaaaccaggtaagttctacgtgtgtttacctttattggctgaattcatgtatataaatgaaatagcctttttttcccctttcctagatttttcccttcgtagtatatgtatcttcctttttcctattgattttactgttttgtgtcctccatttctcagccctttccaaatttggtcctgtaccctgttttcttctagctgcccatgtctccttgctccca

SEQ ID NO: 1258 - DNA, 1301 bp, Homo sapiens
ggtgtgggagttctcagtacctgtgtggagtttgctaacagacctggggtcattcggggtgtgacaggcaggccctctctcctagatccaggtccatttactaatgtccttgcccatccatgcctgcaagaaggaagagatgtctgaactgccaggaggtggtggctacagatggtccctggcacagcaagaaggcagtgccaatcaaaggaggtcggcctcttcaattagaactctgagcagatggggctgaggcagccagaaggggcacttcccagtttactaagtgtgtgacagtaagctggtggccttcagaagaccaggagggtcacctggttcatttcctttctggaaggaagggcagtgtttaggataagtcagatgagattcctcctcattggacagataataagctttattgtgagttaagcaatatgcttggccctacggatatcacattaaacaaaatagacctgaccctgaccttactagtttacaatcacacgatcctgaccttactagtttacaatcacaggatcctgacctgactagtttacaatcacacgaccctgacctgactagtttacaatcacacgaccctgaccttactagtttacaaccacacgaccctgacctgactagtttacaatcacacgaccctgacctgactagtttacaatcacacgaccctgacctgactagtttacaatcacacgatcctgacctgactactttacaatcacacgatcctgaccttactagtttacaatcacacctcctgtttcttgccacttgcacacaactcagggatggggtaggaggaggaatatcataaatgcaaattcctgtgccttacactggagctactagatcagactacctggaggctaagcccaggaatctacatttttaacaagcttcatagttcagccttgcacatattaaattttgagaactggttacttctccatcaatgcatggggtaatcagtcaccttgggcacattggtgtcttaaaaatgacttaaacacataattggaactgttttgctaagtctagcctgtgtctacgttgctagaaaagccctttttccccttattctgatggtatagaagaaaacaactgcttaaatcaaatgaattaatgtgttgattgagctttcattacctgtctagcttcatgctgtttggaaaataaatataaaagctataatcctggcccctgatgagcgtacagggttcttgagttgataaaacacaccagttaaccagttagagatgacgagaagatggtgcaagatt

SEQ ID NO: 1259 - DNA, 1169 bp, Homo sapiens
caataaaatgcgctaccttgttaaaaacagacacggctctcctgactgggcccacaccatcagcctgccccaaagtcactgttggacccaggtgatgaggaaaggggctgcagcttgtttgcctatctcagactcctggctgccaactccccagcatggattttaaatacctgggggccttcctacagccctgaggtggccttaaccagaacacatgaggatggaatgagcaaaaaggcagagaagagaatagggcctgagcacaaggaaccgtcttcaatgggtcgttcattctcattatccttccttgggcccctagacgagggtcccactagccaggcctcagcatcattgctgggcagtcaagaagacctggccccatcctccacagctgctttccagagtcctgggaggcagggggtctagtggcggagaagtcagactcagacagtgcggctccaactgttggctgtttggcctgcacaggctactcacctctttgaacctcctttctcatctctgaaaatgggcatgacgatggtggtaccatccccacaggcctgctatgaggaggagagattgtgtgtgctgagcctatggtgcatgggagatgctcagtaaatgtctgttatgattgtgacgagagagccctttcccattggcttggccccaacttctgttctggccgaggtggatgggagaggtgtcatgggggatcttttttccaatggagataattactgtatttcctttccctgcctccctctctgcctcctctggccctgctcggatctcatccctctcctgggcctgccagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactgggctccccctctcactttgaagaggggactcaggaagaagttcttccagagggcaagggaggtggcaaggcctgggtgggaggggggctgttcttcctcaaagggtgtctctgaagttca

SEQ ID NO: 1260 - DNA, 1355 bp, Homo sapiens
ggcctatacaggtatagctttaggacagatgtaggagaatgggtgtatctgtgtaattctgctggaaattaagtgtgtgttttttcacttgggaagtcagcccgtttgctgttcatcttccttgcaggccaaggcagaggcttcctcaggagaccatcccactgacacagagatgaaggaggagcagaagagcaacacggcagggagccagtctcaggtggagacagaagcatagcccctctccaccagccctactcctgcggctgcctgccccccagtctccccactccaccctgttagttttgtaaaaactgaagaattttgagtgaattagacctttatttttctatctggttggatggtggctttaggggaagggggaaaggtgtaggctgggggattgaggtggggaatcattttagctggtgtcagcccctcttcccttcctccattgcacatgaacatatgtccatccatatatattcatcagaatgttaatttattttgctccctctgttaggtccattttctaagggtagaagaggcaagtggtagggatgaggtctgataagaacccagggtggagagggagactcctgggcagccgttttcctcatcctttccctctcccagtccatttccaaatgtggcctccatgtgggtgctagggacatgggaaaaaccactgctatgccatttcttctctctgttcccttcctcacccccgacggtgtggctgatgatgtcttctggtgtcatggtgaccaccccctgttccctgttctggtatttcccctgtcagtttcccctctcggccaggttgtgtcccaaaatcccctcagcctcttctctgcacgttgctgaaggtccaggcttgcctcaagttccatgcttgagcaataaagtggaaacaataaaacctgggtgtcagacaaccctttctgttcagccttggagtggtgggtatgggtgggtacataatgggtagtagcacaatcaaggggtcacccacttagttccagttgagcttaaataagtgagcatctcatgtagatgccatagttgggcaggaagcagccccaccatgcatggcttcctgagcactgcacaggctgccgctgggatttgtgtctatggcttcgcccaaggttcccagcactccctccctccagcaacctggcagttttagtgcctctggttttcttccctgacacttaggaagacgaaagtataaagatctagaagactgggacaccatgcatgttcattttgaagttggaattggtcttctgcctacctctgatctggcagaggtatctgcattttggtttgttaacaaggtaaaactcctggtg

SEQ ID NO: 1261 - DNA, 1198 bp, Homo sapiens
ataggggaccttccttggttcttagctcacagtggaaatcagttgaaggttaaaggcttcagctctgacctctgtgatctgatgatcaggcttgtttccaaaactccctccccagtccatctctactatacctctgtttgtcctagaacctgttggtggcagtgagtgctgaaggctggtttcatttgtttgacctgacacctgccaaggtgttggatgcttctgggcaccacgagacactaatcggagaggagcagcgtccagtcttcaagcagcacatccctgccaacaccaaggtcatgctgatcagcgacatcggtgggcatgcctacctttgcaggcagccaggagagtaggagtcagtggatactagagcatatcccaagggattggggtgagagggagaatccgtattcatgtatgcatttgttatgtgctgagctcccatgataagccaggcatcactcaaggcactggaattgccatagtgaataaatagacaaaaattgctgccctcctgggccttattatgaagaaacagaaaagaaacaatataggctaggtgtgctgcctctcgcctgtgataccaacgctttgggaggctgagatgggaggatcacttgaggccaggagttccaggctgtagtgagctatgatctcaccactgcactccactccagcgtgggaccctgtctctatttaaaaaaggaaaagaaaagaaaaactatacattttgtaagataattaagtagtatattagaaggtagtaagtacacggccagacgtgatggctcatccctataatcccacgactttgggaggccaaggcaggcagatcacttgagttcaggagtttgagaccagcctggcccacacggtgaaactctgtccctactaaaaatacaaaaagtagccaggcatggtggcaggcacctgttatcccagctactcaggagactgaggcaggagaatcgcttgaacccgggagacggatgttgcagtgacccaggatcatgccactgcactctagcctaggcaacagactccgtctccaaaaaaaaaaagaaaataagtgcagccgaccacggtggttcacgcctgtaatcccagcacttcgagagcactttgagaggctaaggcaggcggatcccttaagctcaggtgttcgagaccagcctgaccaacatagtgaaacccc

SEQ ID NO: 1262 - DNA, 1185 bp, Homo sapiens
gggagggggtcccgggccggggccgggggtggggtctggcaccggagctttcagtttgttccgctgtttgaaattggcgccggcggagcgttaaggtcacgtgacggaacgtcgccaatcggcgccggccttgtctcggcattccgggctcgaaggctgtgcggtctgccaggagctgcggccccgtccggcccgggctggtaaggcggaccgcaggccggcttgtgggggaagaagtggccgtggggccggggaggggccggaggggtccccgccgcgtgggtgggcgagccgagggagagtttggggacgcgcggaagcggcgtgacaggcccgggtccctgggcccgcttttcctgccgcgctggtcacgccaggcgacacgcccccgcttcccctcaggctcctctgctccccttttcaaagctcggctttagttgatttcctcactgggggaaatcgtaccccattttcccacagtgaacgatcgtctgctccccccgattagactaagttcctttgagggctgcgtattatctccgctttcttccatcttgaaaaaaaatgtcggcaccatgaaccctacctcagcgcgaaacctgtcttttgcccctcccgaagccaagccttcggatataatagaccgtagtgctttatttattgacttagtcaaccagtctagttgagcaactgctgtgcgccaggcaccgctaggccctgaagatacaatggcagacaaggttctttccttcccctgggctcacagcccaatcctggaagaggggcacagacattttaatcaaataaacaaatgtgggctgggcatagtggctcacgcctgtaatcccagcactttaggaggccgaggcgggtggatcacttgaggtcacgagttcgagaccagcctggcaacatagcgaaaccgcttctctactaaaaattagccgggcgtggtggtgcgtgcctgtagtcccagctactctggaggctgaggtggaaggatcacctgaggccgagaggtggaggctatggtaagccatgatcacaccactgcactccagcctgggcgacagagggagacaccgtctccaaaacaaacaaatgttgaattattgctgtaaattgaaacattagaggttaatgatactttgagtatttacaataacgagatcttgagaggtagga

SEQ ID NO: 1263 - DNA, 1140 bp, Homo sapiens
tcaaaatcctgacctcaagtcatctgctggccttgacctcacaaagtgctggcccagccgagatttgttttctaagatactttgtgtcatgaacagttcagtttagtgtcatgaactattcacttcatatttttcttgtattaactgtttaaatttttaaaatatcttgtagtaactctttaaaatgtatgtaagtaaatggctgcagaaagtttttttagagaatcctgcttccatcagtaatacagcaatattaccccatccactaatggtctttgtttccttaaccactactcattaatccttaatcacctcattcaaactaattcattctgcatttttgagtaccaactcttgtcaggctcagtggcagcttctacgacctgatggatggaaaaaaatcaaactctgtgactctatggttgactgccacctctgcaaccttgactcatctgctgaaaaggcaagaagaagaaagggcagcaagccctgttttagggactacataagatgaggggagataagggggacatagatgagttctttaggattgcgtgtgttttgagtttttgtttctaactgaagaaatctgtcaatattaaatagggtgggaaaatggtttcttagaataactgttcaactgtgtgtaaataaggaaagttttcaatgagtattacttattgtaattaatgcagaaggacttccccagtcaaccgaatgtctcggccttttactcagacaagtagcatctcattaaacccattcatttagcattcattcagctggacctactgtgtcaggtccagccccaactagatcaagcagggattactgtatattttacagatgggagtttgatgcagagaatgaaccatgcacaggtcacacagtgagtgcacgctgacccaggcagtgtaacggtccactctcagcgtgtgcctcctaaagtactaacttgtaggttcaaaaccaatgtggaaacaactttgaccttagaacgccataaagccatttgtgcagtgacttgtcaggactcaggatgttttgtagggactataatgtgcatgtcggtagggagaaagggactgacatttggggacgggatttattggagacaagagtacacatttagacaggggc

SEQ ID NO: 1264 - DNA, 1152 bp, Homo sapiens
aaaaaaaaaaacagcgaaattcattcttagctcaaaggcagtacaaaaactgacggcaggccagatttggcccacacgctatagtttgcagcccctgtgctaaatcataaaagtattttttcctggaaggtcatagttattcatactgtgaatattatttaagagagcattgaagattgtttttatattaaaatggaacccgttaccttatggaataaaacccagaatttaattttcaagataaaacttggaggcgggggccgggcgtggtggctcacgcctgtaatcccagcactttgggaggccaaggtgggcggatcacgaggtcagaagttcgagaccatcctggctaacacagtgaaaccctgtctctactaaaaatacaaaaaattagccgggtgtggtggcaggtgcctgtagtcttagttactcgggaggctgaggcaggagaatggcatgaacccaggaggcggagcttgcagtgagcagagctcatgccactgcactccagcctgggcgacagagcgagactccgtctcaaaaaaaaaacaaacaaaaaaaaaaacaaaaaaaacttggagacggctgtggtggctcacatctgtaatcccagcactttgggaggttgaggcaggcgcgtcacctgagatcacgagttcgagactagcctggccaatgtgttggaaccccgtctctactaaaaatacaaaaaaaataaaaaattaaccaggcgtggtcgcactcctgtgttcccagctacaggggaggctgaggcaggagaatagcttgaacctgggaggaagaggttgtagtgagccgagatcgcgccactgtactccagcctagcgacagagcaagactctgtctcagaaacaaaaacaaaaaaacttggattctaaagatacgttgttctgtagatggtctctggaccgtactttcctcctttctcctcaatttcatttagagcataaaagcactttcttaggctgtttgaagcacttggattggaaatgttgcctgcagtaacctgtataaacatcaatatatcaataacagattattagtgcaaaatttaaatgtccaaaaactgaaagggaataatgatcggtgactgggtctatgaaattacaaaagtaaagcctaagggagatg

SEQ ID NO: 1265 - DNA, 1149 bp, Homo sapiens
gagtggccctgtggagttactgatagtccacgtttgtactgtggtagttctccataatgaaatggacttcagatccgaagatcctaatctactctttgctgtgaagagcacctgccttctggaagtgagaaatgacagcatcctgatgacaagacaggttcccatccctcggcaggtgcatcctgagcatctgtctgcctggggcttgaactgtgccgggtggcatgcaggaagcaaaagcatcctcggaaatgctccgtcgtaaattgcatgacctcatgttggaatgagaggtggggtcacttccagcacttggaggttgaagcaatagttgctgcttatgcaagagaagaagtaagctgtaccagtgcctcccatacctcctcagggcactgccagcccagcacagccagctctcctctcttggcatcagctccctccgactgcacctgccctcacccaatccacagcagccacagcacccacggtgtgcccggcactgtgctaggtgcagcgggagtatggaacggaagccctggttcctgtcctcatggaacttgcagggaaatggactgtgaagctagcagtaacatactgcaagacgaaagaacgtgcacaagcagggtctgtggcagtgcctggtaaaggatgattgattctgtcccaagaggaggaggcagttgagctggctttgagagtgggtggggttctgacaagcgtgtatatgtgtaagagagagggaagcagacagagaggaagagaaacagaactatccttgagaagacagagaaaatgtgatttgagggctattgtcatgaagtgatgagaggaggggaggtaagtgggttttgttttttgcgggttttatttttatttttattttattttattttatcttatttatttttttgacagagtctcgctctgtcgcccaggctggagtgctgtggtgcgatctcggctcactgcaagctccgcctcccgggttcatgccattctcccgcctcagcctcctgagtagctgggactacaggcaccccccaccacacctggctaattttttgtatttttagtagagacggggtttcaccatgttagccaggatggtctcgatctcctgacctcatgatctgcccgccacggcctccc

SEQ ID NO: 1266 - DNA, 1211 bp, Homo sapiens
tgagactcagaggacactgggcaggtggtggggggtaggagggtcgtggctgtgttgggtggggccacatcaggtgtgtggcacagagggggagggggagggggagtggcagtgtgttccacccagcagtccctgtgtttgacctcttcgtacactctctgttgtattagctctcagaatgaaaacgagatacttttccccaatctatgtacgttgttcttaagaatgtacacttggccaggtgcagtggctcacgcctgtaatcccagcactttgggaggccaatgtgggtggatcacctgaggtcaggagttcaagaccagcctggccaacatggcgaaaccccatctctactaaaaatacaaaaatcacctgggtgtggtggtgggcacctgtaatcccagctactagggagactgaggcaggagaattgcttgaacccaggaggtggaggttgcagtgagccgagaccgcgccactgcactccagcctgggcaacaagaacgaaactctgtctcccaaagaaaaaaaaaaaaaaaaaagaacttaaagttaagccaggccagtgattgaattgacctcttacaagtcatgtgatcttggacagacaccctctagggaacttcataatctcatttgtgaaatgggaataaatgctccgacttgggactgccactgggaggaggacaggtcatggtgtgtgaaggagcagggccacccctcgctcacggcgagctcagggaatgtgaaatgtgggtgtgtaaaaatgtcccctgactccgcccttcctgcccctaaaacacacgcacatgcacgcatacttatttttagagaaaaaaagctctaatgtccctcaaagaaggtgaggagaagaccttgagtcttggtttagcgaaaactgccccgtgcaaggttgtgcttttagattttcgtcctcatctgggtgtcaggaaaggggagggagtgttctaaatcggggagataactttgtggcccattaaggggagaaagaggtcccaagggaaggtctagaaaggaaagacagaccgggtgctgtggctcacacctgtaatcccagcactttgggaggctgaggcgggaggatcacttgagcccagcctgggcaacatggcaaaaccccatctctacaaaaaaatagaaaaattagcagggcatggtggcgtgctcttgtagtcccagtgacttgggag

SEQ ID NO: 1267 - DNA, 1150 bp, Homo sapiens
tcctgcccccaggcattgtaaccttttcccccgatgttgatagacctgctctgatgggctgaccaccctaccggctccagccttttcccacctccctttgtcccccgttactgatctcacatggacagtggtggaaatttccctcctgggagttgctgctgagtctcttggcttttcgagaccgcaggcaagtcagtccgtcatctcatctggggaaactgtttgcctttttctgatactacgtagccagtccatttaagtcagctggccaactctgttaaatggatatgaagtgggtacgaagctggtttaggggtgtcctcctataaatcctaactgttggtcaagttgatacctcatttctataatgggcacacgccgtgtttcctaactggggctgcctgtgtgtgcctcattcacaccggtggacctgggttgaacatgttcatatttaaaaaccaagagtgaacgcggtgaaatgtacaattcataacactttttcaaagaaaaatctgagccctcaggaagttccaggcttacctctggcaccccggaggctggttcgctctccctgaaaatgtttttagtggaaaggttcaagcagctctgggctaggctgtgtgtgtgtgtgtgtgtgtgtgtgtttatgcacctttccaagtgctaaatctcctcccatccatcagcctgtgttctctgaaaagctgacgctcagagggaagaaaaataaaaggactagaatttagaacacattagtgtttggagggaggtgagttgtgcttcctgagctctgtttaccatttcacgagtcacgaagtggtgtatttccttcattcgtttctggaagtctttactgaaggcccagttgttgctagaagttggggtggatggtggcatctgggaaatagaggatgagattcctgccttcaaggaacttagcagttgtatgatgaagcaagagtaaagcgtgcaaaaccctagcaaattaagaacgtaaacaaaggtgtgctacgtaacgtgttacgaaccctaaatgcagtaggaaatcaacccaaaagaaggagctcatcaggcctaacgtagaatgccggcctcccagcagagaaaacttggtgatagaaactgttcttagagtagagaaacaaaatgt

SEQ ID NO: 1268 - DNA, 1873 bp, Homo sapiens
tttttttttcttttttggttttttggttttttttttttcctctgatcacattcttcaaagacggagtattctttacctcaggtttactggacaaaatcaataactacaaaaggcaatgattcacgcttttgttttcataatacctcacaaccgtacagtttctgcttgggagcccattcgcatgaggaatacagaagcagtgtgagcagggctgactccctctcaggtggaaggcagggcggtctcactcccagggacctttttggtcatggaggccatcgggctcccagttagaccctggtatcctcatcatgatggaaaaaatacattgaaccaagggatcctccctccccttcaaggcagacgttcagtacaaacatttatgcggtaggctcagatgtcgtaatttgcacttaggtaccaggtgtcaggaaacagactaaaaagaattccaccaggctgtttggagatcctcatcttggagctttttcaaaagcggggcttcatctgcaaagggccctttcatcttgaagtttttcccctccgtctttcccctcccctggcatggacaccttgtgtttaggatcatctctgcaggtttcctaggtctgaatctgcgagtagatgaacctgcagcaagcagcgtttatggtgcttccttctccctcctctgtctcaaactgcgcaggcaagcactatgcaagcccaggccctctgctgagcggtactaaacggtcgggttttcaatcacactgaattggcaggataagaaaaataggtcagataagtatgggatgatagttgaagggaggtgaagaggctgcttctctacagaggtgaaattccagatgagtcagtctcttgggaagtgtgtttagaagggttcaggactttgtgagttagcatgaccctaaaattctaggggatttctggtgggacaatgggtggtgaattctgaagttttggagagggaagtggagcagccagcaagtaagctagccagagttttctcaagagccagctttgctcagcacactctcctgggccccaaggagtcccacggaatggggaaagcgggaaccctggagttcttgggaatcttggagcctaaagagaaaccgaggtgcaaattcatttcatggtgactgacccttgagcttaaacagaagcagcaaatgaaagaaccggacaaataaggaagggcacaagcctacccgactctatttacagtctgtaactttccactcttcctgtagtcccgaggcccctgggtccttctagcttttctctttcccatccttggggccttgtgtgatgatgggtgtggggctgccgatgggaaagtcgggggttgttaggcttttctgcctgctcctgcttaaacacaagaaggaatcctggattttgccctctccttagctcttagtctctttggtaggagttttgttccagaggagctctcccccttggatttgaacttgctctttttgttgttgttgttctttctcttctttttcttacctcccactaaaggggttccaaattatcctggtctttttctaccttgttgtgtttctatctcgtctttacttccatctgtttgtttttttctccatcagtgggggccgagttgttcccccagcctgccaaattttgatccttcccctcttttggccaaatcctagggggaagaaatcctagtatgccaaaaatatatgctaagcataattaaactccatgcgggtccataacagccaagaagcctgcaggagaaagccaagggcagttccctccgcagaacaccccatgcgtgctgagaggcgagctccttgaagaaggggctgttcttccaggaggccttattttgaactgc

SEQ ID NO: 1269 - DNA, 1197 bp, Homo sapiens
cctcataattcgtatgttgaagccttaacaccattgtgaatttatttggagttaggacttttggaggaaattgaggttaaatgaggccataagggtgaggtcgtaattcagtaggattggtgaccttataagaagaggcaaaaagagagatctctctctccctgtgtgcacatactgaggaaaggccatatgtgaggacacagcaagaaatctgctgtctacaagccaggaagagagcccttatcaggaaccaaactggctggcactttgatcttgaatttgccagcctccagaactgtgagaaaatacatttttattgtacaagccacccagtctatggtattttgttatggtagcctgagcagaccaaaatagattttggtaccaagaagtggggtgctgctgtagcaaatacctaaaaatgtgaacgtgcctttggaactatgtaaaggtagaggctagaagagttttgaggtacctggtagaaatatggacgttaagggtgatttttgtaaggtctcagatggaaatgagtaagatgtcattggaaactggaggaaaggtgatccatataataaaatggcaaagaaattggctgatctgtgtgtgttctagtggaaggtagaacttgtgagtgatgaaattgtttattcagctgagaagatttctaagtacaaagtattgaagaaatgccttggttcctcccgactgcttacaacagaatagaaaaagagagaaagaggaaatgaagaaggacttgttaagcaaaaaggaaccggaacctgaagatttggaaaattctcagcttatccatattgcaaaaaatgagaaagcttgttttgaagagaacactaagagtgtggctgaacaaccatttgatgaagagattgtggatgcgactcaccaactaacaagctatcttggcagaagccaggaatagagatgagattacatcagcaaagtcaccaccagtttgaactagaaggggcagaatgaaagaagcctgtctgacttctgatatcctacaggaccagaccacagagctatttggctgtgaatttgagctattcttcaagaaaagggaagaatgaccccaaaaggggttcagagatgtttagaactatctctttggtttcaaaggatggggccattgcctcagtttaaacaccacatggcctttgtcagaggccttggagg

SEQ ID NO: 1270 - DNA, 1401 bp, Homo sapiens
acccaactggtactttaaaaagaactggtgactgtttgtcctaactgtgcatgttagtcctgaaattccaagttataggttcactgataaatgcctctggatattgatatctctactgatgagcatgtacccagcttgccaccgtatttattcagttgaacaatttcacgtgtatttttaaacattcgattccacgggttagatctgatctgttagaaggggctctgcaggctccttcctgtctcacccccacactttctttccctcatagtcactttcgaagtatagatcctggcctcaaagaagatactctgcaattcctgataaaaggtgtttatgggtcagggggtaggggatggaaggtgtttgttatcgtttgtttgtttgtctgtttgtttgtttttcctacattttgtcagccacatgatgatatcaaggctgttgtgattcagttggtttggctaagcccagggacctttggcctgttaaaggtctgtaatcttggtgggcgatacagagttatgtgtgttcactgtaagggcagaccaacaagaactttttcctacttttgagctacctctttttaataggggtgattcttccagttgctggagagaaattgtggtaactggagtgagagagtaggaacagggcatgttcagggtatcagggccaagggtcctaaaggacttagcttgtgttatggccactgagagatgaaacacagatctttggtaatctgatggctgcaagtgctgggtgttttgaagttggggtatatgaaagaagtgagtgaaactgactccaagattctgcccctcacagtggtatcccgccactcccaggagcttccagctatcctggatgatacaactttgagtggatcagatagaaacgcccatctaaatgccctcaaaatgaactgttatgctctgatacgtctcctggaatcctttgagaccatggccagccagacaaaccttgtggacctggaccttggtgggaaggtaatttggagttttgggctcacgttatatggggtctggggagataggggaatagatggaaaagaagggaatccaatgatccacaaatcctttctgtcctcattgagaatttaggagaaagaactcaaaagtgtcacacgttttcttcctggacaagtagcgctgtggaacttgtaatatttcttccgtattaccttctatgttgtcttggtactagattgtttgggcactcagactgacagatcttgacccacttttttcccttattttttcctcaatgtatacatgatcctttttagggtaagaaagctcggaccaaggcagcccatggctttgactgggaagaagagaggcaaccaattcttcagcttttaacacagctacttcagttgga

SEQ ID NO: 1271 - DNA, 1401 bp, Homo sapiens; identical to SEQ ID NO: 1270

SEQ ID NO: 1272 - DNA, 1149 bp, Homo sapiens
aaagaggaatccagtgttgaagataaatatctgccccaaagaggtctagaattcacatttttattatcagtagtaaaagtcttcctctaccaaggacgaggatatctggctccctttaaggactgtaatgtgtcttaccactacaaggagtactcctaatctatattctgtagaaagggtttttagagtgagtgggtagctcagtttagagtatacttaaagatcatcttgaacaaaatggatgatgtgggacttgagcagattcttctcttcctaccctacacaggctctccccctgacacgtttccaggcagtggtggctttagctgtgggacgtctggcagacaagtcagtgctagtatgtaaaaatgccatccagctgctggccagttttctagccaataatcctttctcctgcaaggtaagtagacttggtccaccaaaagagaaggaattaaatggaaacagggatgaaattatgtcatttactgaccctgctattcattttacctgatagcttagtgatgctgaccttgccggaccactgcagaaggagacccagaaattacaagagatgagggcccagaggcgaactgcagcagcttgtaagtagttactgccttggagtcctaatgccagacaggcttctccttgcagtcagaaactctagtgaaagagactaagtgacactctcatttagctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaagtaggcaaaagaatgggatattcttcgtgatctgtttatgtttagagttaacctttgagaaacttacataatgtgtcttttaaattaactgcacacagatatgctgccaccaggtgatggtagatgttttcatgtagtaatggtctgaccataggcctagtccacaattaagcatgtgtttctactttataaatgtttaaaaaaactactgaaacaattaaatgttaacagtattataatcaaacatgagtcctccttcaattgaaga

SEQ ID NO: 1273 - DNA, 1354 bp, Homo sapiens
agccaaaagggtcatcatctctgccccctctgctgatgcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgtggctggggccagagactggctcttaaaaagtgcagggtctggcgccctctggtggctggctcagaaaaagggccctgacaactcttttcatcttctaggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaaccagttacttgtcctgtcttattctagggtctggggcagaggggagggaagctgggcttgtgtcaaggtgagacattcttgctggggagggacctggtatgtt

SEQ ID NO: 1274 - DNA, 1209 bp, Homo sapiens
cgggggaaatgattttgagatgattcaaacattacatttattgtgtactttattactatttttaaaaattattattattatttttagagacagagttttgctcttgttgcccaggctggagtgcaatggcgcaatcttggctcactgcagcctccgcctcccgggctcaagcaattctcctgcctcagcctcccaagtagctgggattacgggcatgtgccaccacgcctggctaattttgtatttttagtagagatggggtttctccatgttggtcaagctggtctcgaactcccgacctcaggtgatccaccacctcggcctcccaaagtgctgggattacaggcatgagccaccgcacccggcctgtgcactttatttctattattattacattataatatataatgaaataattatacatctcaccataatgtagaatcagtgggagccatgaacttgttttccgcaactagacggtcccatctgggggtgatgggagatagtgacagatcatcaggcattagattctcataaggagcacacagcctagatccctcgcatgcacagttcacgtaaggtagggttcaggatcctgtgagaatctaatgccgccgcggatctgacaggaggtggagctcaggctgtaatgccagtgatggggagcagctgtaaatacagatgaagcttcactcacttgcccactgctcacctcctgctatttggcctggttcctaacaggccacagacaggtactggtccgtggcctggggtttggggacttctgcattaggggaaccgttaggaggacttgctgacctcaggagtacccaaggtgcctttatctttgtgacctttgatctctcagggtcactaagatggagcaaggtaaagccaaggcccagagtggtgggcgggaggcagttcttccccaccgctcctcacctctctctgtctcctcccgtcccacccccaagtctgttcacacagcgagcctgcagttttcaaggtggcttgtcaaggacatctcctgacatgcacgttcacctcctgaccttgttcctgctgtaaatttgtgaattaagtggggacatagacatatgcagagactactggtggcagtactagccttgtatttcagtagaatatatttggttcatttccttcttcccagtctccctgagtgatggttccagaacccagctccct

SEQ ID NO: 1275 - DNA, 1092 bp, Homo sapiens
gacaccacctcttcctgcagaaccattctggagcttgtaactttgctgtatgtccctagctttacatactgggtgggtggcctatcagtgaattcccttgagattgggtggattcctatcatctggaattctgactcctcgggtctccttctctaggtagcccagcagcagtgaagatgcagactgataccacctccaccgctgagcagtgaccttcctcactttctcttgtcccagcttctcccctgggggcctgagagaccctcaccttccttctgcccatcttccatgttgtaaaggaacagccccagtgcactgggggaggggagggagtgaggggcagtggtgcccttcctgcagaagagacatgcagcagtagcgctggcgccatctgcaggagctggcgggctggccttctggaccctggcttctccccactgtaacgcctgttacacacaaactgttgtgggttcctgccaggcttgaagaaaatgatctgaattttttcctccttttggttttattttgttggtttattttgtgttttcttttctcctttttggggggtattcagagtgggctgggcccctgggcgagacacagctacctctgttggcatctttttaataccaggaacccagcggctctagccactgagcggctaaatgaaataaagtggaaaaaaaaaaaaaggaaaaaaccaaaagcataaaaaaccacagcaaatttcttgatgaaaattgaaaataaaagtttccttgtattttagtgctctggttcagtgtgggtgtaggtgcaggtggatgagtgtgtgcggcaggagcctggcacctgtatagttgaaaattaagggctacgtggtgtcctgataccccactgagtaactgggttctgtgtgtgggtgcagtatgtgccttgccaacgttgacttccacctgtggaaaatgagaggctgcaaaactgcgggcaccgccgcttaatggctctgtgaccttgagcaagttgtttaactttggtgggatgcagatatctcatgtatacctcatacggttgtcaagttaaaccagtgaagtacatggaacggttttaaca

SEQ ID NO: 1276 - DNA, 1302 bp, Homo sapiens
ccgagaaggcctgtctcgccagcatgtccttactagaattggtgttatgtctttgattcgcaagaaggtgagccctgagcctcttgccattgtttctagggggccaggcgcagtggctcacacctgtaatcccagcactttgggaggctgaggcgggtggatcacttgaggtcaggagttagagactagcctggtcaacatggcgaaaccccatctctactaaaaatacaaaaattagctgcacgtggtggcgggcacctgtattcccagctactcagaaggctgaggcaggagaattgcttgaacccgggaggcggagactggaaggccaataggaaaggagcctgtagctggaattgggtcttcaacttcttgtcccattgctacaggttcaggagtttgaacatgttaatgggcgctggagcatgcctgaactggctgaggtggaggaaaacaagaagatgtcccagccagggtcaccctccccaaaaactcctacaccctccactccaggggacacgcagcccaacactcctgcacctgtcccacctgctggtaagtctgcctgtcctatcattttctgtccctctctttttgtcctggcctatttttctgctcccctgtgctcagttctaacagggtagtctggcaggacacacagcaattccctctcagtttaggagggccgtcctaagaatagggctggctcttaaaggcacgagaggacaatttaagatgagacaaactgggaagaaatgaccttctctctgatctagtaccttcttcctaattgattgtcttttattgttctgcagaagatgggataaaaatagaggaaaatagcctcaaagaagaagagagcatagaaggagaaaaggaggttaaatctacagcccctgagactgccattgaggtaagagatggggtgactgaatgccatactaaagacaaatgtgtaagtccagtcttccttttagttgctggcctgtctgcttcatctgttttgtttttgtttttttttcctttgaagtgtacacaggcccctgcccctgcctcagaggatgaaaaggtcgttgttgaaccccctgagggagaggagaaagtggaaaaggcagaggtgaaggagagaacagaggaacctatggagacagagcccaaaggtaaaggtatccacattttttttgtttgtttgtttgttttgagacagtgtagtgctgccgccaggctggagtgctgtggcgcgatcttggcttactgcaacctccacctcccaggttcgagcgattctcctgcctcaccctc

SEQ ID NO: 1277 - DNA, 1302 bp, Homo sapiens; identical to SEQ ID NO: 1276

SEQ ID NO: 1278 - DNA, 1181 bp, Homo sapiens
gaatgagtcttggattttggagggaaatttgggaatctgaatgtggggaagcaagcttaggtggagaagattttattttccccatctttggtcttgtggtatatatttggatatatcctgattttaggtcccaatgctcggaggaagcccaagggcagccctcgtgtacctgatgccaagaagcctaaacccaagaaagtagctcccctgaaaatcaagctgggaggttttggttccaagcgtaagagatcctcggtgagagcccagcccatcgctttagggagggtgccatgtctaatagaaaggatgtgaccttctatcagaacctgtccttcatagtaggcacgtaagaatgtggggcgtttcccacagaacaagatgagactaggctccctgtataacggtgcttgctgggattctggtgtccccagtgagagagtactcccctctctgccactctgtccttccccttggcttgaacgtctaaccttattctttttcatcctgccagagtgaggatgatgacttagatgtggaatctgacttcgatgatgccagtatcaatagctattctgtttctgatggttccaccagccgtagtagccgcagccgcaagaaactccgaaccactaaaaagaaaaagaaaggtgtgtttctcttctgtatatttgtgatgggatgaggtgggagtgattggggaagaatctccctaaggagataggggtcggggggtggggggaggtagtttttttccaataactgggctttccctcttccttgcccaggcgaggaggaggtgactgctgtggatggttatgagacagaccaccaggactattgcgaggtgtgccagcaaggcggtgagatcatcctgtgtgatacctgtccccgtgcttaccacatggtctgcctggatcccgacatggagaaggctcccgagggcaagtggagctgcccacactgcgtgagtgtctggccattgtggccccttggaacccatgagaagaagggtgggacagtaaagctcttcggggcctggatggaaatggaaatgctggtgctgcgggttgtgagctttgggaagcattcaaaggaatgatgggcactggcttcagactgcggtgggcgggtgggggtaataatctgaatctgtggtcctttactgcaggagaaggaaggca

SEQ ID NO: 1279 - DNA, 1212 bp, Homo sapiens
agtgttcctttgacctgaccccgtataagacggcggagcatcataaggacatctgcctcactgtcaccaccagcaccatccaggtggagcacctggccagctcttagagatccgtgctgccacccactgggaagaggaagaagtagtcctggtgtcttctttctccaactcttggtgggaaaagtccttttcttccttgacaggccttggctccatctccttgggcctctgtcacggctttccttcacaggataccatcctttttctgaactcttcttcaaaaggaacatcagccctcctgattgcaaaggaatactgagctgatggtgtcatccagcagcctcccctcccaagcaaagcttctaaaactgggggtcggtgctcaagggaaggatttgctatgacctcatagaaccttgtccagtgtggccacttaccctatccttaccctccttatcctcaaagtttgggctgatgtaagactagaggctggccctcccagataacagagaaaagggagccccaaatgcaaccagcctcttgttctattcttgcctgcaaaagaacagaggtttctcaaatgcctcagtccctgagagccatttcttcccctacatcgtctcactttgcttcctattgactgctggtagaaggagatttggggtaggggctagacctccttttatttgaagggggcaagggctgagatgtggtccccaaggggccagaaattcccaagttggtcacaggtggcttagaagtgtgtgttatggttttacggatttccttgaagcctctctccttctctgcctacaaagaccctatactctcagtctccccaacccacccccaaggagctgtgggaggctttgtgttatctgtgaaactccaaaacaggggtgttgcggagaagggagagttcaaggcaaacgcaaggactggacttagctccctaggtgccacagtcagatgccggacacggatttatatataaatatatatatataaatatattatactcactcatcacggccatctttgttgtaaccatttctgtgtttataaatgcattatctctgagaattttcatatttgatgttttgtttatttttgtcctttttttccctctctccacccctgtcctctagccacagcatttttctttttgtcttttttttttttttttaaatcatggcagatttcagaggaaag

SEQ ID NO: 1280 - DNA, 1304 bp, Homo sapiens
ggcaaagtctgggctcaaaggagagcagagtcagggtgggtttgaagacctgaagcagggctgagggcgaccacgggggctctgccagagcttcctgcccttccccaatgacccatttctggctcctcagatgaggaagaagaagaagaggatgatgaagggcccgcgctgaagagagctgccgaagaggaggtttgggctgggttgctgggcctgaggggctgtcagggatgcagccgggctgggcgccctttggatttggacccagatccctgtgtggcaggggtgggggctggaacaggaccgggacagggggaggtctcccctcccattttacagctcccccattctctccctctccacaggatgaagcggatcccaaacggcagaagacagaaaatggggcatcggcgtgagcccctgccaacaggctggggttgggaggcctctctgggcctggaggtgggggtgggggcagccaagtccagccactcttcacctggctccctgctctgggccctgcaccagagctgccaccctcttctttctccccagccttctcatttccgcctctccagacactgcgccctccaccctcactctgccattgttccacctcctgacctgctccatctgagctctccagctggcccccaattgctcctctctctctttgctctctttctccctcccctaccagcctcattcttcctccggtagcctctcccacctaacctctgcatcccccagcctcatgtcctgccccatccctatcctgcctgatccctggatctccctcagatcccctcttctcagacagcgccaggccggggtggggccggggttggggccgagccccacagctgcccccctcccctccctttttgtataatttaataaagaaatggtcgcgcttctgtttttaacctgtctcctgctttcccgggggctccagtcagtgcgacaaaagggtagagagggaggagggtggctgacctcccattctgccaggacccttccctttgatacaaaagcagcagcacactcctaccacccacgactcaagaagacaagatcagccctccaggggtggcctggagcccagctcttctgagagctgacttatgtcctgttttggattctcagggatgctcctccccagcaatacacacttccctgctaacccacacaagacctagacactgctgagcccagtggaaagctaccagctctattgtgctgaaccaggcacagagaaacagcccagaaacaggaagtccttcccctgagctgggagagggctg

SEQ ID NO: 1281 - DNA, 1199 bp, Homo sapiens
ccagctgcactccagcttggcgacagagcaagactccgtctcaaaaacaaaaaacaaagccggttatgaagcgggggtggggtgggctagttttaataggtccaggcgattagtacctggcatccttaaccacctacagtttgagaagggagtgggtgataaaagcctggaagggaagggaaatcgggccgggcattaggctccatcgctcatcaatagacaaggcctttaggaaactgcgacaacggcttttgctctgggcctttactgccgaatccaggtctccgggcttaacaacaacgaaggggctgtgactggctgctttctcaaccaatcagcaccgaactcatttgcatgggctgagaacaaatgttcgcgaactctagaaatgaatgacttaagtaagttccttagaatattatttttcctactgaaagttaccacatgcgtcgttgtttatacagtaataggaacaagaaaaaagtcacctaagctcaccctcatcaattgtggagttcctttatatcccatcttctctccaaacacatacgcagcagtgttacagctcttttagaatttgtctagtaggctttctggctttttaccggaaagcccctcttatgatgtttgttgccaatgatagattgttttcactgtgcaaaaattatgggtagttttggtggtcttgatgcagttgtaagcttggggtatgaaggtttgggccacgcctgggcgcttccggctgcgccggatgctgtttcctttccgctcccaggggcgttgggaacggttgtaggacgtggctctttattcgtgagttttccatttacctccgctgaacctagagcttcagacgccctatggcgtccgcctcgacccaaccggcggccttgagcgctgagcaagcaaagggtgagaatcgtcctagtcaaggcataggctgctggcctggggtagtcaaggcatgggctgctggtctggggaggatgcgggcggaggatgtggggcgacaaacctggctacgtccgccgggaaaatggggtaggggacgccgggtaccgtccttctaagtggggcgcttgcccccaagacttgggatcttattgggttacctacagcctcaatccactaattccttgcgctctccgctgggcccgctgtctgttctccgacgcctacccgggacgcctccctgggat

SEQ ID NO: 1282 - DNA, 1100 bp, Homo sapiens
gctgtcaaccctgtttatcttttctcttgggagcaaaggagggttcaaagctgagtggggcctgaagctgtcaattaacatgtgcatttctcttctctgtttcttgttcatctggcgatctggcaccacaggggaaggtaagctgttgttgcttctgtggggtcctgcaggccaccttctccagtacccgcctcctaccctaccccctttcccacctccccgaagacaaaccctcaatcagggtaggagggtcgtagagggaatggcctagagtgtcctgcctctcacatttatgtcccctaataatgtcattatctatcttttttttcctacagtgacagcctcatcaagggtaagaaatgagcctagtcaccaagaactccacccccagaggaagtggatctgcttctccagtttttgaggagccagccaggggtccagcacagccctaccccgccccagtatcatgcgatggtcccccacaccggttccctgaacccctcttggattaaggaagactgaagactagccccttttctggggaattactttcctcctccctgtgttaactggggctgttggggacagtgcgtgatttctcagtgatttcctacagtgttgttccctccctcaaggctgggaggagataaacaccaacccaggaattctcaataaatttttattacttaacctgaagtcaaggcttcacgtgttcatgaactgggtaactggcagcaagcatgcgcacgttcacatgtgcgctcctgggtctgtctttgtgtgtgccagcagggggcgcaaaagaatctggctggggcggctaaggggaagcaaggcctgggctccgaaacaggacccaagctgggaaggctggccctgagttctcgaggcccagctgtgctcttcacacaccctccatttctcccacatcacccatttttttaaggctggacagccatggctttgctgagccagattaaaaatctgatgaccccaacaggagctgcttccttggcagcagggttccttgtggctgtggggagcctgcctgtgcctgttgaggcacttctgtgcccagaagcccagtggatcgcgtggcc

SEQ ID NO: 1283 - DNA, 1223 bp, Homo sapiens
aagctaaggcagtgcatgttgtattgagagtgaagggttaggggtcgcaaccttcctttcagctccccagtcccctcaaaccacccctcccttcccctcttcacccctgccctcaggtatccctgttgatccgccgggagctgacagagagggccaaggacttcagcctcatcctggatgatgtggccatcacagagctgagctttagccgagagtacacagctgctgtagaagccaaacaagtgggtgagtcgcaagagccgtggggtgagggcttctgagatgcaggaggaggaaagactccatgggtggggctcctgacccaggacagggtctccctgactctctcccaccacagcccagcaggaggcccagcgggcccaattcttggtagaaaaagcaaagcaggaacagcggcagaaaattgtgcaggccgagggtgaggccgaggctgccaagatgatatccttctgctggagagatctcagcccagcccctagggcacctgagttccccattctccttcatgggcaggctgatgagactaaggcgaatgcgactccgtgctctctggcccttggctccttgttgggggtggggactacagatgagatctgaaatcttagtggtagtacctgagccatgactccccactgtaaggccagatcaatagcattggtggccttgccttcatttctggtgctgcccctagttcctggcagcagcctgcagggaggcccacaggtggggtccacggtagggctgggcacaagccacctgagcgcaaccttggatctgacagcccagaggaggactggagcaagggagtgtggtaaggacagggccagggattgagacctgcccttgcgtgtaccttaaccctcctcaccttggagaagcactgagcaagaaccctggctacatcaaacttcgcaagattcgagcagcccagaatatctccaagacggtgagtgtgtcagcccagcgtctctgatggggctgccttgagaaagtgctttcagttaaggcacattgaggtgagggaattcgaaccttgcttgttccggtttctactcagattggcttctctggccggcgcggtggctcacgcatgtaatccccgcactttgggaggccaaggtgggtggatcacctgaggtcaggagttcgagaccagcctggccaacatggtgaaaccccatctctactaaaaatacaaaaga

SEQ ID NO: 1284 - DNA, 1223 bp, Homo sapiens; identical to SEQ ID NO: 1283

SEQ ID NO: 1285 - DNA, 1176 bp, Homo sapiens
acttctccacttcctgtcccaaactaccttgactgtctccagactggccccttccagcaccacaataaactacggcctccgatcttgtttcctgcccctagtcggggccgcttgggtggcagagcatcccagtcctgtgcctgctccccaccgcttcgttcacgaggcttgaatccatcactgggcgcggccatcttgcaacaataccggaagttgcgctaacgctcttaaataagaacagcgcggcttctaatcacaaatttccttccggctgccattttgaaagtgggccaggaaatggagatgacttgctgtcttgcgctgccctccctgggagggcagccttccagaaaggggcgggacttccgtatgcgcgattcctgtgcgcgaagttcgggtccgtagtgggctaagggggagggtttcaaagggagcgcacttccgctgccctttctttcgccagccttacgggcccgaaccctcgtgtgaagggtgcagtacctaagccggagcggggtagaggcgggccggcacccccttctgacctccagtgccgccggcctcaagatcagacatggcccagaacttgaaggacttggcgggacggctgcccgccgggccccggggcatgggcacggccctgaagctgttgctgggggccggcgccgtggcctacggtgtgcgcgaatctgtgttcaccggtgagcaacctccgcctgctcgccggacgcttccagtccctcccccaaaccccttgccctgtccccgcgcccctccacgggcctagcatttcctctgagcagcggcctggcctgatcaccacccatctccccacagtggaaggcgggcacagagccatcttcttcaatcggatcggtggagtgcagcaggacactatcctggccgagggccttcacttcaggtaatggcgggcagagcctgctgaccctgacctttcacccttgacgccgacccagcagtggctatagtcggacgtgcaacaggattcaacgctgctcttttcccaccctcctcatccctgcccctaggatagtgggtgctgcgagaacctccagcagcatacaaactgttgttttccagagggacaagagaatctctccttgtctgtggtcgtggagaggagcaggccaaaaaacgcgtggtgaggggaaaccg

SEQ ID NO: 1286 - DNA, 1197 bp, Homo sapiens
aacatctggagcaccctgcgtttggcattgtctatgttaggccagagcgatgcctatggggcagccgacgcgcgggatctgtccaccctcctaactatgtttggcctgccccagtgacagtgggacgggctgccctgtgagtgtccacctggagggatccccgctttggatgtgattccctctccccaaatgggcctaccaagggggcgggctgatgaccataagcggtacggcctttcaggagctgcctcaacgtaggggtgggtagtctgtgttctagttcctacataattgtaggaaaatgagctgtgtcatctctgagtcccttggtaattcaagggctgtacatccagctacagatctctctgctcatcatgccctttcttggtgctgctttttgggtaggaccccacgatttagggtaactgttatcatcagctgccatttctgatagggtctaccacatctgtaatgtctgtcctttcccccacttttactgggaattgatagtccagcttccttgggcagtgtaagtaggaggttcatctgctgtgcgcctctaatgtctgtctggatgggatgtgttaggagttggcctgttgggttgaattgttgatttggctgagcagagctgagttttggtaggagtgctcatggttctgtcattcttggacctctcctggctgagctctgattccctgtgagcacgatgctgatgcaatagtcctgtgtcatcactgcagcggtcctcaggagctgccagggccaattgctacagagtgtctgggtgtgtggcataggaggaaggtttgcttgtgaaatgaggctgggtgggagcggggagggactagatcagaagagatcaagggctctattcaggaacgttggtgggaggacagagcaagtgggaagggggtatggtgagtgcggcaatccctcatcctcttagaagcacctgtgaatgggaattgagccaactgttatagaaaattggttcagaaagtgcaatcttgccagatttctagcaaataggttcagtgttaccataagcctttgctgtacttcttgaaatgtttctaggggagagcattggaaaatccccttcccccatctagatcgaaggaagatgagggagcagcttggattcttctcagttgtcccctgcatggggagatacactaacccccagaaatgact

SEQ ID NO: 1287 - DNA, 1180 bp, Homo sapiens
ccctttggcaaggatgttcggctggtctccctcggctcccggcaggtaaacagtagccagtatttccaccaggggccatcctgctcctttccccacaactttgtcctgctcgtccaggcctgggagacgctgggtctgtgacaggctgaaccgtgtgaggagcagccccctccctggcctggccggcccatcactggaaggcaaaggagaggtggcgggggcaggtccacgtgtgttggtaggatgtcatttagctggcaccatctctttgcctctttctttctcctttgttgcagaacctttgtgtaaatgaagacgtgagaagcctaggttctgtgcagcttatcaacgaccgctgcgtggacatgcagagaagcaggcacggtagccaccgggaccatggtgtagccgcaggtggtctggagagagtgaggcaggggtggcagtgactgaagaccattcagtgtctttcatagaaagaatggcagaggagaccccagttccttcctgagtcccctctccttgggaaaaagtgttcctactctctgggtgagcgtctggtccgaatcgttggcttggagatgattttacgggctctttctggagaacaaaagtaaaaccttagtgttccgatgagacacagtaggcagtacttgggagggtcttatagaccccaccctgtggaagtgggtctcaacattacacaaccccctctcgggcccgtggacagttgctgtcttctctgttttctctctttgtgcctgtgccaccctcagagaagaagaaaggagctgaggaggagaagccaaagaggaggaggcaggagaagcaggcagcctgccccttctacaaccacgagcagatgggccttctccgggatgaggccctggcagaggtgaaggacatggagcagctgctggcccttgggaaggaggcccgggcctgtccctattacaggagccgccttgccatccctgcagccaaggtgagggccctgcagggccagaaagccgctcttggctctcactgtggtctaggccatgaggggcgtcctcatcacactgtagtttgggggatgccccccaccgtggtcaggttgatggcaccttaacccattctctcctgatgcgtgagttggaggaggcgcgtgggatcccttggggtctccaggcagcagggc

SEQ ID NO: 1288 - DNA, 1293 bp, Homo sapiens
cttcagttttcggcccctccctggctcttaccaggtcacgtgatccctccagacaacatcctgccccttgtcatctgcagcggggtctccaaccagccgctagaattcacgttccagaagagagacctgcctcagatggtcagtcccagccagctcgctgcaccacagcctggcctccggcagcaaagggttttctggggcaggggcgctctggcccaccctgagtgttttcaggtgttggggaaattgcacagggacacccacttagagccacacagaatgagcggcgtcgatctagatgcttatggaggaaggtctgagcttccccgcccctcacgccttaggctgcgaaatatgtattcataaaacctccaggcatcctctgaggacgcctcactcagcagaaagctgctagttccctttggctctcttgccctttggttatatctgcccctgccgggggcagggatgtggggcttgggggcatctcctgtggtgtgcctggggtgtgcagcccctgattgtcattgtggtgcccatcaggaccctggacagaagaagggacgactcagtgccagggcaatagggaggccccccagggacgctagtgctgtgacatgtgtcggaaaggcgcagtcagcagcagtggctgggtgtgtttggtgggaggtggcacctaccaccccgtggttcccacccaggggagccaagtcctcttctttggctgtagtcctgccgagggtctctcctcagttttgagtctcaaggtgaagacgcggtttgcgggtggctgaggggttgctccatgggggctccctccctccctcccttccttccttccttccttccttccttccttagatggacgaggtgggtcgcatcctctgtaacctgtgcggtgtggtttctggaggggtggtctgtttcttcccctcctacgagtacctgcgccaggtccatgcccactgggagaagggtggcctgctgggccgtctggctgccaggaagaaggtgagtggcctgtcggcagccttcccacttgtgaggacagtgccactgagtcctcctgggagctcttgtgctcatcgggtcaggacaggcttctggctcctcatccccaccactcccagtccctgactacagaggatttccccaaagtccctggctgtgaggttctccagtcccctggccagaaaacacaaggccacgagcagacccgagacctggcaccctgaacctgtctctgggaaatgtcctctgtctttctcagatattccaggaacctaagagcgc

SEQ ID NO: 1289 - DNA, 1147 bp, Homo sapiens
ttgttgctgccaaaataggagaagtttcactcagtacctttgtgctggacagagaatcatatgagcccatgaatagggattgtcctcttggtacctcctagactaacataggtttcaacacattctaggaaaataacagtatctcaagtctttcccattgaggaatattcttcctggtctagcattgcttctactttgacagttgtatatttgctaatttatgttctttaaagaggttacacattgcttttgcgattgacattactagacaagaaagcaaaactcaggttgtatgagcaaacaagccatatatgtttaaatcaggatgtgaagtaccttgctcactttgtttaaaacctagatctgtttttaaaatcacagtgggaattcttagtatgttctgccagtcttatactctagcagtccaaggctgttttttgagttagtgtatattctttttaattttgaggccatctttttattttcttctcagggtgcagaagctgccaatgtgactggcccggatggagttcctgtggaagggagtcgttacgctgcagatcggcgccgttacagacgtggctactatggaaggcgccgtggccctccccggaatgtacgttgtctctgttacttaaccagtgattgagaaattgttcatgcatggaattaagtgtatgtacttggagcagataaatgccttgtcttctcctggagacaaatgatttaagtgatttttattttttctttagaggaaatttttatcttattttttaaaatgtgtattattgatttccataggtttttgggaaaccggtggtgattagttacatgaataagttctttagtggtgatttctgagattttggtgcacccatcactggagcagtatacacggtactcttaaggggaaattttagcgctcagaacttttccagagccgctggtctcattagacacttgccattcagaagttgtatcagttaggatatatttggctacaagtaatagacatttaattatcttttaacaggaagacttaagggagacagtgctgaggttttttttaacaaggtttctcttcatttggctcttttttctggccagaacctagtcacagacattcactggcaaaggggaatggatt

SEQ ID NO: 1290 - DNA, 1130 bp, Homo sapiens
gtgaattatatatttgtattatgatattttctagttgattatcatataaaaatggcatttcatttcaaaaaattgagttagtaaccagctactttactaaaatgtttttaacgtaatacctgatattaaagtgatgacatttatatggaaggccaattcaagacaaaaatggcagggacatgtggaaattgagacaagaaccgatgtgaaacaatgtgtggtgatgtctggtatgactgctggcagccacttcacagtgaggtgagagagacagcatggtggtcatcagatgcatgcacttgactcccagaacttttccagaagggctacaaagggaaaccacagctggcattagtccatggaagagagagagaggagggagaatgtatctgctcagctgtcgttagtcttctgtttccccttggccagggtttccctgagttagaactaccatctctgttgttctgtcttacatcatccagtcccttggtggtggtcatgaaagtcagacctcatgcccacagtgtggtgatgcattcaagtcccaaatggaaggatgatctggatcaggcaaggtgctgaccaggggaacaggagatagtgaagggaatctgagaaagcacatgtttgtgtccaataccaccactccttgtgccactgagacgtgctcataccctccagtcatggctggctttatgagcatatgacttgcacagttgtacagggttttgtgcttataggggcttgtgcttagagtgactctatgcttggattaatgttctgcacttgctgtttggcttttcagacagagtatacttcagcattccctctgctgaagagggaatggtcttacactggtcttacactgattccatagggatttgctctcccctctcctacaggcttgtcagagacatgcacagagtcctataatgcccactatgcatgcctctagcagctttgaattccgctggatcatctggcacagtggccagagcagcctggaccagagcctatatcttctgtagagccctctttagttctgggctccatttgagaccagtagcctttagaaacatcgttcgtgagtcagagcaatattctcaaatgtggaatatgttgtctccaaa

SEQ ID NO: 1291 - DNA, 1153 bp, Homo sapiens
ttgcatacaagtctttgtattgacatatgtttttgtttctcttgagtaaatacctagatgtggaataaacagtatctagctattgccttggattgtatagtaggttgtatgtttaaccttttaggaaactgccaaactgttttcccaagtggctgtaccattttacattcaccccagtagagtatgagtgttccagtagctccatattattgccaattcttggtatagccaggctttaaaattttatctgagttattttaacaagaaaagactatcgtggtggaaatagttccccccatttcctatgtcttattttttaaatgctgcaaaaataatattttgtgtgtgaagtttagatggtctcctaatgatttatttattcttttcttattttcgacagtctttgctcacttaaaccgatttgaaacgcagtttataagaaccaatacgttttcttccttttcacttacatatttttctttttttgttctagcggcccctttgttgctttatgcaaacagacgggacttgcgattggttgatgctacaaatggcaaagagaatgctacgattgtagttggaggcttggaggatgcagctgcggtggactttgtgtttagtcatggcttgatatactggagtgatgtcagcgaagaagccattaaacgaacagaatttaacaaaactgagagtgtgcagaatgttgttgtttctggattattgtcccccgatgggctggcatgtgattggcttggagaaaaattgtactggacagattctgaaactaatcggattgaagtttctaatttagatggatctttacgaaaagttttattttggcaagagttggatcaacccagagctattgccttagatccttcaagtgggtaagtttttgtacagtgtacgaagatcatcatacctcctttcggtttttctccactgacatacaccaccctgacccctatgagaaaagaaagatcgaaaacaggaattttagattctttgggcttctttgttgagtagacttgaatgtggaaagttacgttgtgttattattatttttgacagggtttttgctttgtcactcaggctgtagtgcagtggtgcaatcaaagctcactgcactgtcagcctcccaggctgaagtgat

SEQ ID NO: 1292 - DNA, 1197 bp, Homo sapiens
cctctgaaagtgctgggattacaggtgtgagccacggcacccagcctttctgggtatttcatataaatggattcatataatatgtggtctttggtatctagtttctttcccttagcataacgtttttggggttctcccatattgtagctggtatcagtattaattccttttcatggctaaataatattccatagtagggatatactgcattttgtttatctattcatcagttgattaatttttttggctgtttataaatctgctgtgaacatttttatacaagtttttgtgggtccatttcctttcttaaattattttagatttggggtatatgtgcaggtttgttacatgtgcatacattttcagtgctcttgtatttacattttaatctggatgttatatctcactttacagaatttttttcacagttatttctctctagggtttgtggtggaacacatgtagacagagaaatagttgttaggaagacatagacctggtagtttgtcactctgaagtgggctgtcagctgaaaagcttgaagaccatgggtctagacagacagctcattccaactacaactatcatagattgaccaactcctgagaatttatgccatttacctaccttactgggccttccaataagatagactaattttaataagagtttcttattttccctccttaacgctttgtgggagatactgttgggtggaaataatgtcagtgtaaccttgtcaaggcctgtacctcttttattcttcatgtttgtatttgtgtggggcaggggactgtgtgtacctggggttgaagggaagatgaattgtcttcccctctgcctttccctctaaaatcagtgccacagtgagaatcagcaagtggccaggtgcggtggctcacgcccataatcccaggactttgggagactgaggtgagtcaattgcttgagtccaggagtttgagaccagtctgggcaacatggtgaaactccagctctactaaaaatagagaaattagccaggcgtgatggtgtgcacatgtagtcccagttactcgggaggctgagctggggggatcacctgagcctgggaggttgaggctgcagtgagccatgatcagcaccactgcactccagcctgggcaatcagagtgagactcctggctcaaaaaaaaaaaaaaaaaaaaaaaagaaaag

SEQ ID NO: 1293 - DNA, 1209 bp, Homo sapiens
tgcagggaaatcaagaacaaaaagtggcagccagacgttagattagacaagggtcctgaaagtggtcagacccaaggtagctactgactctctttctctaggagaccacatggtctactgcctccaattctctctgtttcttcattagctgcattcaccagcttctcttgagatcaactagttctgcttgtcccttattgtattactggccccaaaatggctgcccctaaatggtggccttggatctgaaattcacatgtccttataaattcaatgcttctgtcagagtgacccagtctctcaatgttctgactctaaattcttaggaggcagagtctgtttgacccagcctaactcagatacagagccagatccaaacagctgggagaacaggatggagaagagttcccatactatcttctcagcactctctaaaaagggctgttggcaattttgcctttttgtaattctatttgagcaagttggaagtttaattagctttccaatcaaccaaatttctgcattcgagtcttaaccatatataagtgttactgtggcttcaaagaaaatatggattctgaagtagtgggttttgattgagttgactgtttttaaataactctttggattttaattgtgatgcagaagttatagtaacaaacatttggttttgtacagacattatttccacgctggtggataagctcaataaaggtcatatcccaaactaaaaaatataaaataaaataaaataaaaaataaaaaaataaaaagggctgttggtcaattttataaaaggcaaagtcaaacagagggaggaatgactgatagatgaaatgactggtctcttggtgcatctgtttctaaaattccgttaactttccagaatgagcctgccaatagctctggtctaaactcaacccctgtgacctccatttcacctccatttgagtcacctgctgaacaagcatgcccttcacactgcttgtattgcctccgtggcttagacttgacagtttctctgccttgtcctctttgtgaacatctactcctcttttcaaaccctgctgggttttatcttatctgtagttctatttctctcccactctgtatccttccaaaataagttagtcacattttccttttcaccatagtactttaattttcatatatactacttatacgattgcatatgtcatattgcattga

SEQ ID NO: 1294 - DNA, 1150 bp, Homo sapiens
tctccaaaagtgttgagattacagttgtgagccactgtgctcagctgggaggagctcttgcggccaggattttaagaccagcttggacaacgtagcaagacctgtttctaaaaaataaaaataaatagttaagctattctggaggctgaggcaaggggattgctctatcccaggagttcagggccgcagctcaggctacagtgagctatgattttactactgcactccagcctggcagctctaaaaaaataaaataataataataataatataaaaataatttaaaaagcaatggtttaaatggtaatttgtatcttacttgtatttaaccacaataaaaaagaatatacaactactgggacatttttttttgagaccaggtctcactctgttacctaggctggagtgcaatgactcattgcagcctcgacctcctgggctcaagtgatccccctgccttagcctcccaagtagctagggctgtaggtgcacaccaccatgcccagctaactttgtgtgtgtgtgtgtgtgtgtgtgtgtgtgtgtgtgtgtgtgtgtgtgtgtgagagagagagagagagagacagacaggttcttgctatgttgtccaggctggtattgaactcctagtctcaagtgatcttcctgccttagcctcccaaagtgctgaaattacaggcatgagccatcatgcctggctcactggaaaaatttaaagttcatccatggtatgtctaaaagaatctcacacagtgtactgggccatattatttgtgagatgctgtagtggttcaatttcaggctctggaatcctactgcctgggtttgagtccagttactgaactgccatttgcaagttacttcaccttttaaagattttatttcggccaggcatggtggctcacacctgtaatgccagcactttgggaggccagggcgggcagatcacttgaggtcaggaattggagaccagtctggacaacatggtgaaaccccatctctactaaaaatacaaaaattagccgggcgtggtggcaggcacctgtaatcccagctactggagaggctgaggcaggagaatcgcttgaacctgggaggcagaggttgcagtgagctgagatcatgccattgtgctccagcctgggggacg

SEQ ID NO: 1295 - DNA, 1217 bp, Homo sapiens
cagtacaccagcagaggaaacttataacctcgggaggcaggtccttcccctcagtgcggtcacatacttccagaagagcggaccagggctgctgccagcacctgccactcagagcgcctctgtcgctgggacccttcaggtaggacagctcccaacgctgtggggactctcagcaaaacttctccttcctttccacggctctgcttcttctgacctcatcttagttttgctttttcttttcttccttcgctatttttctatgatcctctaagaaccaagtccttgaaacttttggctcaaagtggatacagagacaactttttctagaaagttcagaaaagtgtattttgaggacggagtctggggaaatcaatgggatggggctaaaatcgtgcctggcagtgaccgggttcttgttctaggatgtggagggagcagggactttgaaacaaactgggataggatcctgtttatggaggaaacaccacacaccttggaaatgacatcgggaactggccagatgtttttcacctcctccgttttgattccgattgcttcaggacttgaactgttactctgctcgctggttgttggttgggattttttgggtggtggtggatagataactggttttcagtttatttttgacattgcttttcctgcctgtttgcttccctattcacttctgtttaaatttaagtattttttttctcctcacaggatgggaagagggggattggtttgtttaaagaaaactgttggccgggcacggtggctcatgcctgtaatcctagcactttgggaggctgaggcgggcggatcacctgaggtcaggagttcaagacaagcctggccaacatggtgaaaccctgtctctactaaaatacaaaaagtagccaggcatgatggcaggtgcctgtaattctagctacttggtaggctgagacgggagaattgcttgaatccgggagatggtggttgcagtgaactgagattgcgccactacactccagcctgggcagctgagtgagactctgtctcaaaaaggaaaaaaaagaaaaagaaaaaaaatgaaaaaagaaaactgttagagagagaaagagagggaggcaaatggtgttttaaatgaaacgtgggaggggttcacttggtcgaagcaggagctgatgaggattccagatgccttctcttggccagatgtggagggcgggggaggc

SEQ ID NO: 1296 - DNA, 1149 bp, Homo sapiens
ttcagtttcatagatgattttactgaggtaaggagaagatatatattttagatagataaccaggaaattaataggattaatatttaaaaaggtatgtctggtcctggtatttgcactattaattgcaagagttctgcttttttggtgtgcttgataatatttctcagagattttttttttaattcctgggatattaagggcttttgtttttgtattttctatgacagtgcagcactaggcatcctgatatattcctttgtaaaacatgttgatacattgttagatagataccttaaaggtcctttgctgtgtcaaaatgatgcacaattcctgcttgtttgtccttaaaaatggatgtgacagttaactcttctgctcatggtacataagaccactcatttctgtatattaatgctaaccacaagtagttgccaatctgatgtttaaaaatgtattttctctttctgttttgtctttttttgatgattaggttgaatgccttttcttgtatatgttgttttatgaattgcctgctcacgtttctgtattttttttccaactgtttgtccttttcattcactaatagattttcttttttattctgaatactaatcctatatcactatgccattttttcaagtatttctcctaacttgtggttacttgtagtactttctgtgcctttgaatatttatattattttatgtctagtgtctttgctattatgcttaactgctattttgatagattttccactatttatttcaaaatccatttcttccttatttgttacgttttgttttgtttttgtttgagacagagtcttgctcttgtcacccaggttggaatatagtcgtgtgatctcggctcactgcaacctccgcctcctggggttcaagtgattctcctgcctcagcttcctgagtagctgggattacaggtgtctgccaccacgcccggctaatttttgtaattttaatagagatgggatttcaccatgttggccaggcaggtcttaaactcctgagctcaggtgatccgcctgccttggcctcccaaactgctgggattagtggcgtgagccatcgtgcctggcctttctttcttgtttgtgatgcttctctgtcatagttaccttttttattgttt

SEQ ID NO: 1297 - DNA, 1231 bp, Homo sapiens
tcagcaacttgaagcagtgtacaaggtcaaagaagaactgttgaaaactgatgtcaagctgttaaatggcaaccatgaaaatggagatttggacccaacctcacctttggaaaacatggattacattaaagacaaggaagaggtgaatggcattgaagagatttgttttgatcctgaaggaagtaaagcagaatggaaggaaacaccctgtatcctaagtgttaatgtaaaaaacaagcaggatgatgatttaaattgtgaacctttgtctccccataatataactccagaaccagtctctaaactgcctgctgaaccagtttctggtgatccagcccctggtgatctggatgccggagatccagcctccggagtactggcctctggtgattccacctctggtgatcccacctctagcgagccctcctctagtgatgctgcctctggtgatgcaacctctggtgatgccccttctggtgatgtgtcccctggtgatgccacctctggtgatgccactgctgatgatctctcctctggtgatcccacctctagtgatcccatcccaggtgaaccggtccctgttgaacccatttctggtgattgtgccgctgatgatatagcctctagtgaaataacttctgttgatctggcttctggagcaccagcttccactgatccagcctctgatgatctggcctctggtgatctatcctctagtgaactggcctctgatgatctggccactggtgaactggcctctgatgagctgacttctgaatcaacctttgatcgtacctttgaaccaaagtctgtaccagtttgtgaaccagttcctgaaattgacaatatagaaccaagtagcaataaagatgatgattttcttgaaaaaaatggagctgatgaaaaattagagcaaattcagagtaaagactcattggatgagaaaaataaagctgataataatattgatgctaatgaagaaactctagaaacagatgatacaactatttgttcagatcgacctcctgaaaatgaaaagaaggtagaggaagatattatcacagagcttgctcttggagaagatgctatatctagcagtatggaaattgaccaaggtgaaaagaatgaagatgaaacttctgcagatcttgtagaaacgattaatgaaaatgttattgaagataacaaaagtgagaatatcttagaaaatacagactctatggagacagat

SEQ ID NO: 1298 - DNA, 1099 bp, Homo sapiens
tatggtttttaaataagacaaattgcaaaaaacgttgccagacagcgttcgctggtttgggccgtcactgggtatggctcgtgtccgtctagatattcagaggccgagcacagtcctcagtagggctgctcggcaggtacacagctgacgctggtccttggacttatgggagtgggaacaactttcaactcggccgcggaccaggaaggcgttctgacccgctagagctcggggacagggaccccatcccggtgcctagagcgtctcccttagtcggcgtgggccagcgccagttacctcacgagcactgaactagcgcctgcgcccttctatacttctcgctctttcttcaagtcacttctacccggcgagcccgccctcccgccaatcgtcatttccggcgggtgctctgcgtcatttacgtcgtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaaggtgagcaaggccgcaatcctggtcctcgacggctgggactgggctgaaagggatcgggacccgcacgctccagtgccgaagcggtggtgtggtgaggggggagggggcgatattaacatctgagatgagagccaacactggtccggtggagaaaggagtgtgttagggaatccgcagctggagccgagaggacgcttttgtagaaactattacctccaactaagacctctctccttattttattt

SEQ ID NO: 1299 - DNA, 1130 bp, Homo sapiens
gaaccggttcctcttccccctccttgctgtgtgtttgatgtgttgaagcaggagggagaacgccgcgagcagcgccgtgagcaacactaccatcgtccccagcactgcggatccgggccctagcggcgggcccagtagcggaggtggtggcggcggtggaggcggcggcatcgaggtaataggtgactgatctccccgggcgctagctctgagcagatgcggactctcttcggtttcctaggcaagatcgacgaaccacacctcttcccgccggataattcacctttgccaatcgcaatctcgttaaattccatgatccagactcagcagttgtcgcaccatgtctgacaaacactgtattccttgacagagctttgataacgtaccatatgcagaaggagttattcctgataaggctaaggcttgtctctgttggcaccagctaatgcaatggcaggtcttctgcttggtgttgggctcctgcctactcctaacccacttactcagactggcgctgttccaccggctgctttgggggctcctactcttgttcctgcccttgctgcgcttgggcttcctggagcaaacttgaactcaatctgttgccacagatagttgctgaagcttatgagcactgttggtcccaagttgaagcatgtagctgctggtcttgtttcaccaagtctgaaatcggatacctctagtaaagaaatagagaaaggggccccacatggtggctcaggccagtaatcccagagctttgggaggctgaggagggtggatcacttgaggtcaggagttcgagaccaacctgaccaacatggtgaaaccttgtctctactaaaaattcaaaattagccgggcatggtggcgcatgcctgtaatcccaaatacttaggaggctgaggcaggagaatcgcctgaatcctggaggcggaggttgcagtgagccgagattgtgccattgcactccagcctgggcaacgagcacaaaactcttggctcaaaaaaaaatagaggaagctatgaaaagagtacaagaagcacactgcctaatttcggctgctatagaaccagagaaagaaaaaagaaggcattcaagatcacattctaggaggaggaggactctc

SEQ ID NO: 1300 - DNA, 1176 bp, Homo sapiens
ccttgtggaaatttgagaacagcaagtgctacgtgactatcattgatgccctaggacacagagacttaaccacagagacttcatcaaaaacatgattacagggacatctcaggctgactgtgctgtcctgattgttgctgccagtgttggtgaatttgaagctggtatctccaagaatggacaaacctaggagcatgcccttttggcttacacactgggtgtgaaacaactaattgtcggtgttaacaaaatggattccactgagccaccctacagccagaagagatatgaggaaattgttaaggaagtcaacacttaaattaagaaaattggctacaaccccgacacagaagcatttgtgccaatttctggttggaatggtgacaacatgctggagccaagttttaacatgccttggttcaagggacgaaaatcctcctgtaaggatggcaataccagtggaaccatgctgcttgaggctctggactacatcctaccaccaactcatccaactaacaagcccctttgcctgcctctccaggatgtctacaaaaattggtggtattggtactgttcctgttggccgagtggagactggtgttctcaaacctggtatggtggtcacctttgctccagtcaacattaaaactgaagtaaaatctgtcgaaatgcaccatgaagctttgagtgaaactctttctggggacaatgtgggcttcaatgtcaagaatgtgtctgtcaaggatgttcgtcatggcaatgatgctggtgacagcaaagatgacccaccaatggaagcggctggcttcactgctcaggtgattatcctgaaccttccaggccaaataagtgctggctatgcccctgtactggattgccacacggctcacactgcatgcaagtttgctgagctgaaggaaaagatggatcgccatgttggtaaaaagctggaagatggccctaacttcttgaactctggtgatgctgccaacgttgatatggttcctggcaagcccgtgtgtgttgagtgcttctcagactacccacctctgggtcgcgctgctgttcatgatatgagacagacagttgcagtggatgtcatcaaagcagtgaacaagaaggctgctggagctggcaaggtcaccaaatctgcccagaaagctcaaaaggctaaat

SEQ ID NO: 1301 - DNA, 1186 bp, Homo sapiens
agtgagcggagatcacaccactgcatcccagcctgggcaataacaatacgctgtctcaaaaaaataaaaataaaattcaggaatccagtcattgccaggatatctaattatttgttgcaaaaacagcttagtgcttctgctataacaatgattaattcaaaaccagatttttctgggaagaagatcccattatttttgtattgcatatagtggaaatagcagtaaactgggaggtcgtgaaacttgttgcattttcaagctttgtctaatgtatgtcatcttacttggcaacttacttcgtaaagtgaaaagactactagtcccttatgcttcctttctggaattagttctattgtactacttatttacttccgaaaatactagatattcactcattgatattcttctcgtgccctacacagcatgcctgacgttatttctgttttattttcttttagtgtgttgttggtggctgcaatgccagctttgcttctcagggagggctagctcgtcatgtacccacacacttcagtcagcagaactcctcaaaagtttctagccagccaaaggccaaagaagaatctccttctaaagctggaatgaacaaaaggaggaaattaaagaacaaaagacgacgctcattacgtaagtgttacactgagaaaatctggtgtatttcatggttttaaaagatatcttagacttttatgcaaatccactttgaacttcaactcctcttctattaaaagtaacaaacaggtaggatgcctgtctgtcagtgagagtgagaattcagtggcacatgtttgtagtagctaagggagtatatgtggccttcaaatataaactgtataaaattagatttgggggctactctgattctcttccaaaataacatttaaaatatagtaacattggtatttctagaaatattttagaaaatttgaacatgttaaaagtaaatatcaagtgaaagttaagtaatctatctactccaaagtagtgtgtgtacctgagctgggaggtagaggctgcagtgagccgtgatcgcgccaccacacttgaacctgggagacagagtgagaccctgtctcaaaaaaccaacaacaaaaaaaaccaccacaaagcaatgtgtgtggataacaaagcagtgttgctttttttttttttttttttttgagatgga

SEQ ID NO: 1302 - DNA, 1229 bp, Homo sapiens
ctcctgggttcaagcgattcttgtgcctcgttctccggagttgatgggaatacaggtgtgcgccaccatgcccagctaatttttgtatttttagtacagatggggtttcaccatgttggccagtgtggtcttaaactcctgggctcaagttatcttccccccttggcctcccaaagtgctggaattagaggaaggagccaccgcactgggcccttttatttctctcttagtaaagaaacttgctgtcagatttccagcaagtcaaaatcaagtatgaatttcactcattgagttaaaagctagccagtgtgttctgacaaatttctaatttgataagatattgccactgaaaatgtttaatttattcctcaattcatgtttaaaatttaacactgccatttcttatctgggactccaagtcctgctattaaggttgatagctgagcttccctggcttctgggaaacttgttcacttaacgtggactgatcaaagtagcagaaaatgccagaatgtgaaggcacatggaagtgtaaatctaaaattaatgttactttattattgacttgttttttaattcatagtctgcctgatgtgtgggtgaatgaaagtgaacgacatcagttaaaaactaaagtagttcatttatcaaagctacccaaagatactgccttgcttttggacccaaacatatacaggtaatttaattcttgcctttatgttttactttttgatttgtaattttctctccccaaattttggataaattaggacttagttttaagtgctgaattttaataccaagcatatctcattacttcctggcttttttttttttggatgtggactcacaaagagttaaaaattgtagaatccagaaaaacagtattttgctaataaagtttatatgcttgtttaatcccagatttatcttaagtatgttagattgtaatatacatagtaatttgaaaataagtgccctttaacaaggtaattctttttataataacagacttttgtggacctaagaatatgttgcatgagtctgaataccaaaactgtttgattttttttagcttaccctttctccaaactttccaaaagagcaattcaaatattatttgttttttaagacatagcttagagtgttcacatttctagtaattttatgttttgagctttttttagtgtgctgtgcttatgaaggtatgtgggggaaggagaagagac

SEQ ID NO: 1303 - DNA, 1199 bp, Homo sapiens
gtcactctgatctcctcccattctgctcttacctttctcccatggagcaggttataaaacccaggaaggattttctgatgttcctctgaagcaggtcataagcccctcatgggagaggtatcttctctatacctggagaaaaggagcattcttatttccaaaggcacagggtcacaagagaggaatctgcatgaacaggccttgtttacttatgctatggagcaaatgggctcactgcctgatgcatacagaagtgaagaactatggcaccagtttttgagaaaagaaggcctttattgtaagaccagtcagcaaaggaggcaggagggggctcaaatctgcctctctaatttgaggtctggggcaagttttaaagaatcagagggcaagggaaaggattgaagagtgttggctgagcggggtctgattggaggccttcacatttcaccatttacagtaagatatgttacggcagattttagccctggatcttcggggccaacagacctcttgcttctgaaagagctatgtgtttaggttctggtcatgttctagaacttcttggttctgaggggagggaatcattggttccgggtgtgttagaggtaaaagctttttctattgcacatgcccgtgctacagaatttgtagtttttggctctgttatacccaaaaggtaacttgacaatttgttatcaacagaataggcccagtttgggctggtttcatggttacacttacaccctttaccctatcacattattctaccatgactctccatttttcttcaaaaacctactataaaaagcactcagatttaactgtttctttgggtcttcgtttcctcatgaagggtctcatgacacataaaacttatattaaaagcatttgtatgcttttctcttgttagtctttcttttgttagagggtccccagccatgaatgtagaagggtaggtaggggagaaaaagtgatattctttcttcccccattgcaaggttcatggctgacaccaccacaacaaaagatggactaacaagataaaagcatggcacatttaaaaaatactagttttacatgacctgggagtcttcagaaatgaagacccagagacccagggaaaactgtgtttttgtgcttaggttcaatgagcagtggacacttgtgtagaagaatgactggataaaaaagggggtatg

SEQ ID NO: 1304 - DNA, 1202 bp, Homo sapiens
tggatttttagatcttagtttactggttcaaagggtatgaatttttaataatatatgtattatatatattttatatgtgtgtaaatatatatatacaatgtgtataaatatatatttgttatatagtagcaatatatatgcttagtttactccctgttttccaaatattcaacattattaatttgcaaatataataggcaatagtagtatcttgtcattgtttatattgaatttcttttacttccaataaagttaaatgtctttccatagatctatttattttgtaagttgttctcactcttccctcagttttttactagggttgggattctttcaaatttgtaagaacccttgatatcttgaagatattattctttacctaagtttactacagatattttaccaatgtgacatttgtgcaaatactctaaagttttatatagccagatcaatttgtcctcttttgtaataaaaaaaaaaagtctttaaaaaaagatttacggacaggattgacagattgatagctctttctcgattccgtgggtggtggtgcatggccgttcttagttggtggagcgatttgtctggttaattccgataacgaacgagactctggcatgctaactagttacgcgacccccgagcgggtctgcgcctgccacctgtgcgggggccggcaggaccccgacaagcagctcatgtgcgatgagtgcgacatggccttccacatctactgcctggacccgcccctcagcagtgttcccagcgaggacgagtggtactgccctgagtgccggaatgatgccagcgaggtggtactggcgggagagcggctgagagagagcaagaagaaggcgaagatggcctcggccacatcgtcctcacagcgggactgggacaagggcatggcctgtgtgggccgcaccaaggaatgtaccatcatcccgtccaaccactacggacccatcccggggatccccgtgggcaccatgtggcggttccgagtccaggtcagcgagtcgggtgtccatcggccccacgtggctggcatccatggccggagcaacgacggagcgtactccctagtcctggcggggggctacgaggatgacgtggaccatgggaattttttcacatacacgggtagtggtggtcgagagctttccggcaacaagaggaccgcggaacagtcttgtgatcag

SEQ ID NO: 1305 - DNA, 1366 bp, Homo sapiens
tatatcaaaatttattaaagtgtatttaaatagagcagtgttcaataaaatacgtatataataaaattaaataagtacttgttacttacaaatatctaattttctcatagtgtatgtttgcatattctatgtataaaacctaattcaaaacataagtattggggaaatgtggacctgtaagtgatgaaaattagattagggaatgagttcaggcctatcaagttttctacaattctttctgttggaacatcggacctttgattattctcttttttcccccctttagagattagttcttgctctgtcacccaggctggagagtagtaccgctgtcatagctcactgaagcttcaaactcctgggctcaaacagtcctcccacctcagcctcctgtctttgatcatttttacttacagtttcatgtcttaatctcgatgctttgttgttctggcaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtgcttctgtttctgggattccttccttaatgattcctgaaagatttcagtcagtctgccaagtcattcttaccacacgtcataaatgtccctaaattccaacatcatctacactcctccctctggatgagacaaaaattcttttttgcaacaggtgccacggtttgttgttgttgtcctgagaatatgattatctttttaaggttataactgaagaagttgtaacggatgtcaatgtatatgacatttacaaaggaagcccgttttaaaaggaagaacccctaaaatggaaactttgttagaattctatttaataatgaaggaaaatgaaagtttggtctggattattcagattgagtctacttggagatagcataacatgtgaatttacagggaaacttaggtagacttcctttaacaaagagttccaaatttacatgtcatatgtaggggtcaatttaggtagtgtttaaaacatgagttttggtgtcatataaacctggacttgagtgctggccttatcgttgattaactgtgatcttagtca

SEQ ID NO: 1306 - DNA, 1168 bp, Homo sapiens
gagtattagaaatccaagttttagtttccagacaaaaccaaacacttcactgccttccttcccttcctaaattttaactttttaagataaaagtaacttaaaattggtttttgtttttgtttttttttttttttttttttgatgtctacctattggagtcactgtttacacttcattttattcctgacaattcattgaattcatagccaaaaacatactttcgggtcatctttattttctgaggcagtttgatgtttggattattgcagtgtagctcaagggagaaaaaagaagccacaggaacattaaacttcaagcccttacaatacagaaaacttaattcacatatatgttctagaagcttatgtatggttaggcttttagagcatgtcatataggttatgttataatgaagagttgcatttaaagtacctgtttttgcttttctttttaaagattattctgtgactgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccaggtattattgtatactttaagtctctgttctgttaagttcagtgttttggtgtttctgttgttattgttttggactaaaatcagtcccagtattcatttacagaagcagtttacatgtcttctttcattggccctaaatagtggtgtttgcaaaacaaatgcctctgtcccaggccagatgttcaaaaaatgtgacaagagttttagctaaagcaatttcatgtttttgcttcatctggcttggttatagattctgaaggcttttaaaacttttttataaagattatcctgggatggagaatgaagcattcgaacatagtttcaatttgtaagaaacattttgacatatttgaccttttattttctggaaaatcccattatacagaattgaaacagatcaactttgaaaagaagcatataagaaagccattaaacaattctgttttaaagatagaaatagactgaattgatggacaaatatatgctaacaccaaatgctctgacttaaaaattgctttccttgctaacttgacatctac

SEQ ID NO: 1307 - DNA, 1202 bp, Homo sapiens
accttaatgaattcttccattaaatgggtctcatggttcttttttttctttttttccttttgagacggaatcgctctgttgccaggctggggtgcagtggtgagatctaagctcactgcaacctccacttcctgggttcaagtgattctccttccttagcctcctgagtagttaggactacaggcttgcaccaccatgcccagctaattttcttttttttagtagagacggggtttcaccatgttggccaggatggtctcaatctcttgacctcgtgatccaccagcctctgcctcccaaagtgttgggattacaggcatgagccaccatgcccagccgggtctcatggttctttaaaatatattctgctttctagaatatcattaggctcattttaagttgtacttcagttcgaaattgcaacagtaacattttaaggatgatttctatttggatttcatatgcagatatacgtgtaatgttttgattctttccttgcagtgcaaaatggcaactcttaaggaaaaactcattgcaccagttgcggaagaagaggcaacagttccaaacaataagatcactgtagtgggtgttggacaagttggtatggcgtgtgctatcagcattctgggaaaggtacatttcaagaacaccatagatgatagagaagttcagcatgtatacacagtttctttgggcaccttggaattttattatatctttaaaagatttctttttttcctgagcaatttgaagttgtagatgtaatcccacttcactttcaaatatttaagcatgtatctcctaaaagaattatattctccctatgtgaccataaatagttactacacttagagaatttaacactgatgcaatactatcatccagtatacactattaacatttaaaattctccatgttgtcaaaatcatgccgtttatagctattttcacctcagtccaagatcatgtgtctcatatacttacgtctcttcattctttaagctggaactgttactcaacctttctttgtttcttgtgtcattgacatttttctagcatccaggtgagttctgcagaatgtccctcaatttgtctgtctgatgttttcttgtaattcagctcgggttgaattttttgggtgggattggaactaggtgatgtcatgtccttctttgtgcagaccatcaggagacacatgat

SEQ ID NO: 1308 - DNA, 1205 bp, Homo sapiens
atcagtcattcagttgatagacaaagttagcgatgctttatgctaggaaacttgttgacagtaacctgtgcgactttatgcagaagacaaatgctagtaattattatgcacagaggaaaaatcattttaagtatgtggtaaagcagcttcatctttcaaaattgatttgctctggtttttctttagtccattagattccagaatgtccttttactgggaatttagttatgtattaagataacctgttttcagttctttttgaaaagaagacattatttatattgaaccaccttattttaaaatttttaacttttatataccacttgtgtgattccagtgtcatgtcttgggtttgatgtcgttggacagaaaagtgtatcaattattttaaatgaatttttccccatgtttgaggcttagtctgtaaatgtgttgctgtaacagaaaatacttgggtatgcattacttgaatacttgaaaactgaaattaataagatgtattacataatgaattagatttctctgaacagtttttacactgaaaatcttcatttctggattgcagtttgaaatggaatgaagacctgaattatttgggtagaaaaaattatgatagtgcttataagaactgtaaactgttttaaactattttgtgtttgacgcatcaaacttcaagttttttgtaagtttctctcctgaaattttctttctcttctatactttatgcacttactatactactgatgtaataaaagagcagggttaaaaatattgtatctgtattcattgtgaatcctgtagcttttctagttaacaaaaaatcgctttctaaaatactcttaatcccattgttttggttaacatcttacccatttgttgtatttcaaatgccattaatcattttagtacaacacctatgtttataaaaatttgaaaacattacatattgtatttaaaactaattagtgaagagtaagaaaaaaactagccaacagaattgtaggtgatgcattagttaaatttcaaaactcataataaaggaactttcagagattggttgaaacccagtggtatccctgtaaattagctcctgtgactggaaaagaccccaaaaaggcagtagaggagattagtgtttacttgctgtggttgtggtgtgctgctacttaattataggtagtgacacactgaaattcttatttgtc

SEQ ID NO: 1309 - DNA, 1194 bp, Homo sapiens
ttaattttgttattccactgaccatttttatacaattcctcttcacctcactctcatacattgctttacaagtagtcttccttcctgattctgtttttaaatttatctcctgtgcaatgatcatgttttcctaaaacaaagcctttgtttcattgatcaatgaaaacttttttttttcaaaaaatttactgagatcttgcctttgccaccagccctgcaaccattctgttctaaccaagaccccagatcttttcatttgccatgtccaggaacaaggatgcagcccttgttttacttggtgtctctgctgaatgtgaggtattgactaattcctccttttcacaatttttacctctattggcttttaagaaatgttaggttagttttttctttatctttctagctaccctatcttaagctcctttatatcatcttcttcctttgcgcttgccttaaatgatgattatcttgccggttctgttgggcgttttaccttctattttgccagttttctttgagtaatttcattcaggtcaatggctttgactgctactgaaatgctcgtggtcaccaaatttttatcttccgtccataaactcatctattacaacttttcactcaccattttcacttgaagctaccacaaacagcttaatttcacattttcaaattaatgatattttcctcagtccaaccaaaatctattcttctgtagtctacatccttgtaagactcttcattacaaaagtatttatttagcaccttctgacagccagtcattatttttttggcattgagaatgtaacagtgcagtaaatagagaaaatccaggttgcaaggagcatacattttagtaaaggagaaaaacaaatcatatacatattgtacaatgagtttctaacaactgtattgagatataactgataatgaactgcacatattcgaagtatacaatttggtaagtattgacatatgtatggatccaaaaaatagtcaccattatcaaaatagtgaacatacccttcacccctaaaagttttctcatgtccctatctgttttctgtcactatagattagtttgcattttctagaattttatacaaatgtgattatacacatttatttttttcaatgttcttttttgtgacggaggcatctggttttactcaccataattatttaggtttatccatg

SEQ ID NO: 1310 - DNA, 1106 bp, Homo sapiens
agtctcgctcttgtcacccaggctggaatgcagtggcgccatctcagctcactgcaacctccatctcccaggttcaagcgattctcgtgcctcggcctcctgagtagctgggattacaggcgtgtgccactacactcaactaatttttgtatttttaggagagacggggtttcaccctgttggccaggctggtctcgaactcctgacctcaagtgattcacccaccttggcctcataaacctgttttgcagaactcatttattcagcaaatatttattgagtgcctaccagatgccagtcaccacacaaggcactgggtatatggtatccccaaacaagagacataatcccggtccttaggtagtgctagtgtggtctgtaatatcttactaaggcctttggtatacgacccagagataacacgatgcgtattttagttttgcaaagaaggggtttggtctctgtgccagctctataattgttttgctacgattccactgaaactcttcgatcaagctactttatgtaaatcacttcattgttttaaaggaataaacttgattatattgtttttttatttggcataactgtgattcttttaggacaattactgtacacattaaggtgtatgtcagatattcatattgacccaaatgtgtaatattccagttttctctgcataagtaattaaaatatacttaaaaattaatagttttatctgggtacaaataaacaggtgcctgaactagttcacagacaaggaaacttctatgtaaaaatcactatgatttctgaattgctatgtgaaactacagatctttggaacactgtttaggtagggtgttaagacttacacagtacctcgtttctacacagagaaagaaatggccatacttcaggaactgcagtgcttatgaggggatatttaggcctcttgaatttttgatgtagatgggcatttttttaaggtagtggttaattacctttatgtgaactttgaatggtttaacaaaagatttgtttttgtagagattttaaagggggagaattctagaaataaatgttacctaattattacagccttaaagacaaaaatccttgttgaa

SEQ ID NO: 1311 - DNA, 1179 bp, Homo sapiens
ctttttatctttgtaccctaaaggtggtccgttcagaaaatgattgaggcttgctcatatggagacacagggagctggcactgctgtggccttcactgtagtgaaatagaagatcagatcttcaggactatcaatccaatacctttcattggctatacatttacttaagaaatattgttttcaaacaaatgtacttgctcccaggaggctgtgtggttgagtcaatttgctttgcctaatacttacgatttgctctcagtgattttaaatgcacaggcaccattcagtgtaattgatcttttgagtagaaggattatggcaagccatgttcttctttgtcacttatagaagttaaaagcaaatgcacatacaagctgatgaactggatattttccatattctttgcaaacatttcacttttagaagcatacatctgttttatacttgctaaaggatatacaacccaaagctttctatttctactaataattaagagcccttttttcttttacaacagcatgggtatattttattctactggagagtcacttaaatagttgaggacaaatgtgaatcccacttacacatcttctgtggaacagcatgatatgtgtataactctgaatcattcgagtatcatctccatgtgaatatgcatgtggttagaatagaggagtggacacagtctggaaatggtttgggtctggtttgttatttagttatcctgttaatatccttctacctatctgtgcttgctgtttgaacgggactggggttcaactttggatctccaacatggaacaataaagtctacatcgttcagtgaactttgggcataattactgtgtctaggacaccactacaatttcttttcactgttgtcttcctgcccatccttgaactcaccataatttgaaaaggcagtagatcatagaaaactaccaaaagaccaaccaagagctaaatagtttcttcatagcttctctcattttgcttttgctcaatttcaaattcttgggagtttccatagctaagcactgaaatgtgggcctattcccagtcaggaaccagataatcctttttgttggtatatatgttatgatgtagaaaatgaggagtcacttaaaaaaaattcaatggagaattccatttatttgtaggatttctttttctttgagg

SEQ ID NO: 1312 - DNA, 1099 bp, Homo sapiens
cagagtttaagtttcaggagaaaacaggaacaatagaacactctgcctgttatttttgttgtaatcaagcttttccacagttcttgaaaagtactatgtttcaaatttcaggaacaccagcgttagctgtaaaagttgcagcaatttattggctagtcatagaaaatttttgaacttttaactgtattttaattgatgtttattaaaaacactttgctatcagatatttggcataaatctgtactcttcattatagttttggggggagagaagattcagtcagaaaacttattcaaagtacctaagtattataaaggagtcaaaaaggtacaaagagaaaaggtcaagacatttttcaaatgagggaaaactaacaggatttatcactagtaaacctgctctaaaagaattcaagggaagctttttaaaaagaagggaagttatagcagaaggaaacttagaatggcaggaataaagaaggcataatgtatagggtaaatataatagacttctcttgaggttttaaaaattacatttgttatttgaaagaaaaaaattaacgttgttgtatgtgattctctgtagaggatatacagtttttttttgttgttcttgtttctgtttttttaaggtgaagtctctgtcacccaagctgaagtgcagttctgtgatcatggctcactgcagcttcaccctgggttcaggtgatcctcccacttcagcctcttcagtaactgggactacaggcatgtactaccacgtccagctaattttttttttcttttttttttagagatggggtctcactctgttgcccaggctaatgccaaactgctaacctcaagatattaatactatacagtagactataagaaattaagtatttgtatcatccctagagcgacacagatttttccctaaaaaactacagattattttcaaaagcattaataaattaaggtggaatactaaaaaagattcaggtaacccaggaacgagaaacagaataaaacaatagtaaacctaaattttattttatttcattaatacagcaataattaaatgtcaatgatctaagctgatttaaatctaaaaactg

SEQ ID NO: 1313 - DNA, 1154 bp, Homo sapiens
tgctcaattaactttcctggtcattctcaatgcaaacatatgacctggaaatcatgattaacaagagcagtcacagattttctgaaagaaacaacagctattttggtgaccttttctcatctcttccctggtcctgctgtatgccagtaggtaacaatagagactagactaaattttagtttaatatattacaggtctagaaggaataagagtagtatgtagttcttttgccttctttttttctaacttacttttctaaacatttgtttccaaagaaaaatcatctccaactttgcagagcatctaacataagaaagtttttgagttggctactcatagcactgtattttataaaaaaattaataattttttttggctaagaaatctcttttaaaagaaattattcacaagtaactgtcttttataaatgttcataaggctagtaatgctctactttttagtaaactaataagagcagagacttttcaaaatgaatggctatcttcttatatataaatatgtatgtatatatgtatatatatgtgtataagaatataggcacatatatatatatgtctgtctgtgtgtgtgtgtgtgtgtgtgtgtgtgtgtgtgtattctgatttcttccttttccccctccaatgtaaattctttacctgtactgatttgaaaggactgtatcatgacttgaccttgcaatttctaagaagttagtcttagtttggtattactacatgtattttattttattttctcattgtagcggactcaaagtttcagaatccatggagtttatttaaattaattctttggtttgtttgttcatttgtttattcattcactcacttagcatatatttgaaaatttactgtgtttcagacaccaaatgccatgacccgtgcaccttatttcattttcagtgatgccatataaaggctgtcatctaaaaggacaggatgtctcatgaaatgtgttgttaatattggcaaacactttcatcagtaactttaagttcaaatctttgatagcagctacatgaaaagaatattatgtcagaaagtgttgtcatgttgccattgtgtacaatgtgggtggtgctgttttagaggcaaagaactgttcactttttatgtttaactgtataaatataa

SEQ ID NO: 1314 - DNA, 1291 bp, Homo sapiens
cagagttctaatattctaatacatggtaattaagaaaaaaaatatagaacagagttatcaggtgtccaaatgtcctagatgttgttgtataggaaaaacaggaagcaaataaacacctggtaaaaagctttctcctgtcctatagcagttagaagttgtaaatttctttcatcaaaatttcagtcttggctctgtcactaacagcggccttagccaaatcactacttgtctctgatcctcagtttcctcatctgtgaataacaacatctacactatttatctcccaaggtttttgtgagaagatactgaaatatgtgcatgaaatgctttgagaattgttaatataaagtctaagatgtaaattataagagttgctgatatattaatagtaaatggtattgacagtatctaagactgataaggtcttttgtgtgtgtgtgtacagactttaatatctatatctatacataattttatacatgataatagtaattttcatttaaattacatttaacactccttggaggacttattatgtccattattttatgtgagtccctgagtaaccttgtgaggtggaccaagtgttgtcttatctttccatgttgataatgcagatctctgctttctgaccaaaaggaaagcctctcctctttggcaatttccatagcttctgtcagtccttgttgctgttgcccgtcacctccagattattccctgatatttatcaaatatgtggctcacatatgtcctctcctttcctacttctgagagtattcttaacattgaagtccatgtggatgaacattcagcactctgatgctttgacctcacactttcatcagttttcattttaagcactaaagcacccgatttttagaaacctacttccaaggcaagtcctcaggctttgacattgctccagacagctatatctgaaatctctaaatctgacagttcactcttggacagtgaccttctttacttccagctctcttagtttctttctccccctatagctatggttccagttcagcaggactttcattctttaaactccccacgatccctgcccctgatacagataaacatatgcactttctcatagtcaatgagcttcctctggatcttgcttccttctctgtgtagcctaggtcaattactttaagagtacccttgccaactgcttctattcctaccctttttatttgttactcccaatttggatcttgccaataatcgatttttcctgctccaaccaccagcagtcaggcgttgctggagaaaaacc

SEQ ID NO: 1315 - DNA, 1199 bp, Homo sapiens
aggaacctaagagcgcacaccaggtggagcaggtgctgctggcatattccaggtgcatccaggtgcgggcgtcatgctgggcttgggtctgagatcgtgtgggggtggcagctggaaacgttgtgggtgtcatccaagttttggctcagcaactcagcgtctgggtttctcctacaggcctgtggccaggagagaggccaggtgacaggggccctgctcctctctgtggttggaggaaagatgagtgaagggatcaacttctctgacaacctaggccggtaagtagtggttctgctcgtctcctgggccgtgatacatggccggccctcactcccagcagctgggcccctgcctgctctctgctgccattagagcccacagctgggctgcgactgctcagaccagccagctggagggaggggctcagcagctctgggtttggtcctgggagagcagttggattttaggctacccattgctgtatcaggacccagtcaattggcctagacgggatctctcagccgaacaagccctctccaggtggtaggtacagagtggagagaggctgagttttgatcacagtcggagaggctgagggaaggggtagaacggagcagctggtgacgtgggtgatgacccgggaggtcctgacgtccacctgctgggctcttgtctcccccgcccaggtgtgtggtgatggtgggcatgcccttccccaacatcaggtctgcagagctgcaggagaagatggcctacttggatcaaaccctcgtgagtgaccccagtgtcacagagggtgacaggagagtaggcagtgggtgggagtggcatcacccccagggctgatacagccaggccttccccgctgcgctggcgtctcctgccccctccggaagcttggatgcccctccacaccctcttgatcttccctgtgatgtcacctggacccctgctgctggcattggccacgaagcctcctggtctggctccaaagcctggcagggtcttttcccagggggagctgcaggcagggaacagtcctgatgggtcttccccttcactcccagcccagagcccccggccaggcacccccagggaaggctctggtggagaacctgtgcatgaaggccgtcaaccagtccataggtgagcctggctgcctccagctgggtggacagatgggggctggagaaagggag

SEQ ID NO: 1316 - DNA, 1199 bp, Homo sapiens
atttgtagttattaggaacaaaggtactattaaacatttatataccagtctttttgtggacatgatttcatttttcttgggtgaattcccaagagtgtaattgctgggtcatagggtagttatatgttacttactgttttttatctagtattaagtcactttacaaaattctttaagaattacagttttttggccgggcatggtggctcacgcctgtaatcccagcactttgggaggctgaggcgggcgcatgccttgaggccaagagttcaagaccagcctggccaacatggtgaaaccccatctctactagaaatacaaaaattagccaggcgtggtggtgcgcacctgtaatccgagctacttgggaggctgaggcataagaatctcttgaacccgggaggtggagattgcagtgagctgagatcacaccatggcactccagtctgggcaacacagctagactcagtctcaaaaaaaaaaaagaatgacagtttctaaaatatcgtgtctttgattttctaaattattatacaatttgctgataggtataattttgagttagatctttatctgttgatctggaggagtttctgggactttttttttttttaaagaagcacacaagttgcccagaaatgtatatagtataatccaaattttgtaagacaaacaataacatgtatgtatatgttcgcgattctataggcaaaagaaaagatgtgaaagatgttcactggcatgctaaccatggtttcgtggctggagtggcggaggtggttaaggggaggtgtagagggttgagtttacaaaaaaaggaaacagggataaagaaaacacattattaaagttaaatgatttagtagagtataaatatataaatatatttatatatttatataaaatatatataaatattttaatatatatttaatatataaatatttataaaaatataaatatttatataaaatataaaatatttattgcaaaaactttttaatgataaaaatattggaaccagcataaagatgagcttaccaaagttatttgcagctgttaaaaatagtgatatacgtgtgtttagaatgtatgttaaattcaaattcagattgcaaagcagtatgcattctatggccctgactactttgtgctaatatgattgtgattatgggcatttttgtttactttttaaaatc

SEQ ID NO: 1317 - DNA, 1200 bp, Homo sapiens
gggggccttgcaggaggggcagctaggaaccaaaacaatccctccaaggccaggaggaggacaggaggggatcccaggaccatgggcccaggaccctcacgcctgggagcacaacccgtcctgagtgggtccgatgtggtggaggcttgggagctcaggagactggggaaggactggagcgtcggaggaaagggggcctcccggaaagctcaaagtctgagcaggggatggaaaactctggcgtccccactcaacagcagggcggtgctgcggcgatccagtgcacgcccttgccgccggcgatggcgggaggctcttggaggccggaaagcgcagcgcagcggcccacagtgctccggcgtggagggggagagcagcccggcagggggcgagtggctgaggggtccctgatccgagccccgcggcctccgagtggggatgaagcctggagtcaggcaggcgtggctgggccaggctcttgtgtcatccaggcatcactgccggtgtctatggccataccaccctgaaggcgcctgatcttctctggtctgtgaaactaagcagggtggggcctggttagtacttggaagggagactgactgggaataccgggtgctgtaggcttttggcttcccgctccctacctctttcccttttttgtcgccctgcttcccaaccaccccctgactctgctaccccttttccacctgcctgcgcccccaccacagctggagacttcctcctggggctccgccactgcagcaccgccaggcagcagcatcctacctcttctacctcactgcagctccaccagatcccccactctagccagagcagggcgggccaggaccagacccagaaggcgcaggcccaggttccctgccatcctggttgccttcctgctccacgaacgcccaggcaattcaattcactcatctggtgccaccacaaacatccaagcctggggaaggggcgggcaggggcagagggtcccacagacaccagccaagacctcctccagaatgcatgggctgcattttccagggaaggacattgccttcaccagctgtgaggaaaacgtccctgtgcacccggattcccattgccatggacttcatgtaaactccaatcccgaggacatgagagagacccaggcctcaggcaccattggcacgcttggcgccatggctcccgccagaa

SEQ ID NO: 1318 - DNA, 1217 bp, Homo sapiens
tgggtgaggcaagagggggccttgcaggaggggcggcgagggaacaaaaataatccctctgcggcaaggaggaggacaggagggtatcccaggaccgtgggcccagggccctgacgcctgggagcacaaactgtcctgaacaggtccgatgtggtggaagcttgggagctcagtagcctggggaagccctggagcgtcggaggaatggaggctgcccagagaacccgaagtctgggcaggggatggaaacctctggcttccccactcaacagcagggcggcgccgcggtggtccagtgcgtggccttgcctgtgatggcgggaggctcttggaggccggcggaaggcgcagcgcggcagcctacagtgctccggcatggagtgggagagcagcccagcagcaggcgagtggctcaggggtatcccaatccgagccctgcggccctggagtggcagtgacgcctggagtcgggcgggcatggctgagccaggttcttgtgtcagctaggtatcactgcctgtgtctatggcagtgccctgaagatgcctaatttcttctggtctgtgaagctaagcagggtggggcctggttcagtgcttggaagggagaccgcctgggaataccgggtgctgtaggcttttggcttcccgctccctccgtctttctcccttttgtcgccctgcttcccaaccaccccctgactctgctaccccttttccctaccgcaccccagggcctcctcgtgggggtccaccgctgcagcaccgccaggcagcagcatcccacctcttccgccttgctgcagctccaccaggtccccaactctaggcagggcggggcaggccaggaccagaccccaaaggcgcaggcacaggttccctgccatcctggttgtcttcctgctccaggaaagcccaggtaattcaattcactcatctggtgccgccgcaaacgtccaaacctggggaagttgcaggcaggggtagagggtcccacagacgccagccaagaccccctccagaacccatgggctgctttttccagggaaggacattgcctttgccagctaccaggaaaacgtccttgtgaacccagattcccattgccaccgacttcgtgtaaactcccgtcccaaggacaagagagacccaggccacaggcgaggattctctgacttgcacccagggtgcttgtctcgcccacgggggcactgggcg

SEQ ID NO: 1319 - DNA, 1187 bp, Homo sapiens
atattataacactatagctgtggtgtgtaaactcattctatgtaggaagactaaataataaaccaatcaagagtaataactacaagaacgtttcaagacatagtacaaaaaaatataaatagaaacaacaaaaagttaaaaagtgaagggatgagcacacccgtcctgagcgggcctgatgttgtggaagctcgggagccgggtgaaggcctggagcatcgccagaagggagatcgcccgtagacccctaagcctgggcaggggacggaggcctctggcgccccagagcaacagcagggcggcaccatggcggtcctgcgcgtggcccggcagccggcgacggagggaggctctgggaggcaggaggaaggcacagagtggtggccagcagtgctcgggggaatagagggagagagcagctcggccggctcggggatcccggatccaagccccgcagccccggggtggcgatgatgcctggagtccggcgggcgtggcagtgccgggctcttgcggcatccaggcgccactgccagcgcctacagccatatcaccctgcccgatctcatctgacctcggaagttaagcagggtcggtcctggttagtactcggatgggaggccgcctgggaatgctgggtgctgtagggtttggcttcgccctccctctttccaccttttgtcgccgtgcttcacgaccttcccctaattctgctcccgcttttaccgtcacctgcagccccgaagcagcctgggacctcctcgtgggagtccaccgctgcagcaccaccaggcaacaggatcccacatcttccgccttgctgcagccccaccaggtgcccagctccagccggggcgggggcggtacatgttccctaaggtgcccggtgtcttcacgctcccgggacgcccaggcaattcaatttactcatcaggctccatgcaacagctcaagccaggggaagtggcggccaggggcagagggtcccacagacggcagccaaaaccactgctccaggacctatgagctgctttccccaggggaaggacactgccgtcaccagtcacgaggaaatctgtccctgtgcaccccaattcctattgccaccgacttcgtgtaaactccagtcccgaggacacgagagagacccaggcctcgggccccgtcagcacgctccatgccatggc

SEQ ID NO: 1320 - DNA, 1131 bp, Homo sapiens
cctgaaattgcttactgtactatttaaattgctacttaatatttcatttggttaatacttatgtattttttgtccatctcttccatcaacctttctttgtcttttgtggacaatttaatgctagattttttttttttgtaaatcaaatctaaatcagtcttttgatgactaaatttgaaaaatatatgcttattgtatttattattgtatggaggcttatttctcccatcttattttagtttttattcatcgtactttattgtttattttttcgatcttttctatgttctgtcatgttgacaactcagattttaaactttttgtttttaagttacaaggtctattgttctcttatctctaacttaagattcattgcatttgtttttttcttccaatgtgtaaaagttaatctgtcttcccctgcaataagaaacctcagtagtctttcaactcactcctctactatgatctctttttctttcatgttggcatcatctggagttttcattctatatgttttttgcttactcaggtaacaataaatttactaaggtatttactctccattggttaccttatctcttggctttctctggaatgcacttctcttcttgttggaacacatctttcaagatatctttcaaagaggactcatcattatgtgatatactttataagacaaagaagccactagtacttcttcctacgccataaatctgtggtcacatataaaactattctgtttctttactcatttgttcaacggctatgttgtatgtaggccacgtacttgtcctagacctgagaaaagaaagtcaacaaaaatctttgcctactaacgtttacacaagacacagcagggaggggcagaggatactcgaggccagatcagcagttcctggcaatggccccacactatggcagggctccagagctgccaggatattgccatgtagtttctggatggcactgaacaggttctgctgctttctcattataataactgggcaagtgatatttttactaggcaactcagagaaaaacaggccaactagagagctcttcccaatccatccctaatctgtggctactgaatcttcctcgattataacttttctatccatattagga

SEQ ID NO: 1321 - DNA, 1203 bp, Homo sapiens
gtttttagtaatttctcaataaacatattcaacagattttaatggagtatctttgatgtgttaggcatcatgttatatgatgtggggggtatagaaaaaggaatgagataatctgctgttgaggagcttgtaatttagaaattccctccctgaataaatctctttgatttaccagtacttatgctactgctacaatatgtctggacatggtagatacttaagaaatatgtatgcaataaattaataaataattttaaattaccattcatcttcccttataggattactttgttatatattcttcaaagaaaatgtaatgcatttcttggtcttcgaacgggttttgaataaaaacagatgtctgcatggttaaattgcacaatcattgagattaacttatatatgtttcaaatataaatacttgaacagttttaattgaattgaagtgaatttaacataaaattctcttatgttctttctagaaatgagggcctaaataattttggtatgaatcacttatcagtttaagtactgatacaatgacctgtattcaatgactcttttacctaaaaaacagaatgtcaatgattacatcatgctcccaggaggactgtaccttccatgttgacgtctcttaatctgaacagcagctaataggagttatgagatcatcagtctcattctcccttcaggggtggtctcgtgtcagaagacactcagaagttttgtgtacctttagatttgtgaagtggaataaatgcctgatattttaacaaagatattcagatactgtgcagcatgcagcagcctcgagcatcataatcctatgcagcagcattaggtagaacgacttagagtggaacctcagaaagcacagtggcagcagtgatgaagccttcttattagatgtgggcatctccacagtggagtaaggccatacaaagggattattacagcacaggaagtctttaaaactctcagggtacattgagtgagctcttggatctggcactatttctttacaggtcttatccttttatgcttatatgtgagagcaaaagagaaaggagtttgaacattctatcctgctgacataggatttttttctgctgtattaaattcaaaattctactttggatctagatatgattcacaggtatcacaaagcatatttcttttgtagtagtctaccaatctcagatc

SEQ ID NO: 1322 - DNA, 1203 bp, Homo sapiens
acctatttttggaccatggttgaccttggattactggaactatggaaagcaaaactgctgattgggggtgaggggactactgtatagtctttgtgagtggattaaaatttacttcattaaaaccaaaaaaaatggacaactcctgtcacttttatctagtgattgtttcttagtagaagtcaaagaaaagggcagtgcagatactggagaactgaaatgtgcaggttggtgataatatgctgttatattgtcatctccataattaacctatgatggtagtgattgtattgaggataatgagacctgatttttgtacagatgtcttttaaaggttaatgtgcttgggaaacagtctttaaaatatataacagcagtgttacttagggatagggattttgtctttcatttattattttaatcatacaatccccttgttagagtggtaaggaatgttttctttcatggtacctttgaaataatcatttatggtatgtaaattccttgccagcaaatatagtgtatttcctcccattgaaaactttcctcccattgaaaactgctttaaggtttttttttctgaacattgtcctgaacgtatccactccattgtcttttgctgttaaagagactgtactgaattgtgttgcttatttctatctttaagataattgacgattatttatctattatgtgtctgttttcattagtttcattgtcttctattgggggtctcaattataattcttgccccagagttctgacagttttatattgttctccagttttatattatatctctgacagctttatattgttcttcagaagtttcagatcatatgaagtcctaattttatattgttctccagaagtttcagatcatatgaagtcctaatgataataaacattttttaaatctagagggtttaaatagtactcattgtaaatctctaattatctgctttagaaattctttgtagctttggaaaagcttaaagaaacacttaggattctgtcagtagaggctttcttacatacaaatatgttttcattccatgtttttttttttgcagtacattctctattgtgattgtcaaaactgtaaggaccccatgtaaagcaaaagagtaaataatgttaaattgactttttacttgaatctggcattaagggagggtagtttgaagcatgtctgatttttttaaa

SEQ ID NO: 1323 - DNA, 1193 bp, Homo sapiens
cttgtggtgagactgatggaaataatgcagttacaactaaccaatatcataattggaaaggaaatcactataggtgctgtaaaaattaaaaagataatagaatattatgaacaattttctgccaatattattgaaagtttagataaaatggaaaattcatttaaaaatataatttgacagtattatgttatgtgaatactataatgataatcctgtaatcattaaatgaaccagtagtttaaaatttttccatatagggaaggtcagggccagatgtgttcaatggttggttctactagacattcaaaaaaataataattcaagtctacacaaactttcctgagattagaaaaaataaagaagagtccccccacctgtttcttactttatgagaccacacctaaaagatagaagactgctttgcaaccaagaaatccttcatgaacacctctttaatcacaagtcctcaactccaaggttagctttatttcaacttttataatacttttcttacttttcttgatagctttaccacccatgtattcattcctaaaaaatacacagttttgtctgattttgaattttatgtgaatggaattgtacatatctgtgtttgtgtcttccttgttttactcaatactgtttctgagatcaatcacattatttgttaatattttgtttaggatttttgcatctctatttcagtgtgtgtttggaatgtaaatttccattctcagactatcttttggcctgaatttggttacatgagtatatgttctaaaaatattacttacactttcaataaattttaaggacttttatattgttatgtatcaaattttttagaatgcaagaataaatattataaaacatcctttggtttgaggaaactactaaatctgttaataatcctttcagctctattgaaacagattcgtttttaaaagctgccctgtttttgctttggggtttggggaacacacacacacgcagatgcacacaaacgaacacatatattgaacttgcatatatatatatatatatatatatatatatattttttttttttttttttttttttttttttttcttgagacagagtctcactctgttgccaggctggagtgcagtggcacaatctcggctcactgcaacctccgcctcccgggttcaagcaattctcctgcctcagc

SEQ ID NO: 1324 - DNA, 1170 bp, Homo sapiens
ttgcagtaatttggaagaagtccattgaaatgcaatagtaagaagtgtagattagtctgggcacagggctcatgcatgtaatgcagcactttgggaggccgcagccggagaattgcataaactcggtagattgagacaccagcccgggcaacatagggagacctctctctactaaaaataaaattagttgagcatagtggagccttcctgtagtcctagctactcaggaggctgaggtgggaggatcacttgagcttgggagattgaggctgcagtgagctatgaaagcgacattgcactccatcctgggcaacagagccagacatgtctcagaaaataaaaaaagtgcagctaggtcaattaaaatactgattcaaaaatattttggcaatgatggccaaatggtatgtacattttggtattttaataccttttcaagaatgtaattttaattagtaaacctaagaagttttaaaagttgaacgttttgaacctctaatcagtttatattttatatatatatatatttatattatattttatatatattatatatatatatttaaagctgtgttctgtattcaagggatattcaccataaaggtatctgatctttgatatacttaaggtattttttttctttgttagattatctgcgtcaaagttatgggctgtccatggactttaattcgccaaatgattataataaattggtgctttcactgttatctggactcccaaatgaagtggactttgctattaacgtatgcactctcctatcaaatgaaagcaagcacgtcatgcaacttgaaaaagatcctaaaatcatcactttactacttgctaatgccggggtgtttgacgacagtaagttttaagctgaatgtattatataattcttctgtaaaagttttttttttaaggtttttaaggagaaagtactttttgtttgtcaacataatagcattctttattttctgtttttatattatgcattatttaagataatgaatgtttggggggttttaaccttaaatatttgaatagtaattttgtctcagtgtttttgaagtaaaagtcctggtttttaagttggagtaatatatagatttcctgagttgagacgattgcttgctacaagattttgacaaagaaaactaggatctggaa

SEQ ID NO: 1325 - DNA, 1169 bp, Homo sapiens
aaattaggccagtctgggccgggtgtggtggctcacgcttgtaatcccaacactttgggaggccggggtgggccaatcgctttgagctcaggagttcgagaccagcctgggcaacatggcaaaacccgatctctacaaaaaattagctgggcatggtggtgcgtgcctgtagtcccaactacttgggaaactgaggtgaggccatcgcttgaacctaggaggttgaggttgcagtgagccgtgatgccgctgcactacagcctgggcaagagggtgagaccctgtttaaaaaaaaaattatgatggctgagtctgtgtcaaagaaaattaacttattttttggtgttaactaaattatctttaggtaattacattttatatagattgtgatgatatatggcagtagttttcctattactactacttttttttcttgtttttcctttgtgtttttgtaataccagtggagccttttcttaaaatgaaactaggcaaacctaagacaattatgcttaaggaaaaaaaagggggggaatcttactcagaactgttttttgaaacggatcaaatggaatggctcagagcaggtgtgatggctcctcctgtaatcccaacactttgggaggctgaggtaggaggatcgtttgagcacaggagttcaagatgaagcctgagcaacatagtgagaccctgtctctatgaaaaaagttaaaaaaaaaaaaaaaaaaaaaagctaggcacggtgatacatgcatgtatcccagctacttgggagggtaaagtggaagaattgcttgagccccaggagttcaagcctgcagtaagctgtgatcaggtgactgcactccagcgtgggcgacagagtgaaaccctgtgttaaaaaaaaaaaaaaaaaagtaacagcttagattaaaactgtcataattcaaaattgtaaaggaaggctgggtacagcagctcacgccattaacccctccaaggcaggttgatcgcttaagcccaggagtccaagaccaccctgggcaacatggtaaaaccccatctctatgaaaaatacaaaaattagctgggtatggtggcatgcacctgtagtcccagctactcaggaggctgacatgggaggatcatctgatctcagtctgggaggcaaaggccttagtgacccatga

SEQ ID NO: 1326 - DNA, 1109 bp, Homo sapiens
ggggtagagatgccaccagactacaggtgaccagattggcctgaaacatggtgtccagtaaaaacggggaggaataagtccatgactgctggagagcttggtggtaggaggagggtgaaggagggtgagggggcctctcatgggtcagaaacctccagggacatccctcagctggtaactctgctgttgtccggagggttcaggcttggtgtgccttcttctgtttgtctgacttttggctcctatggttcatctcctgccctgcccaccacagaaaaggatgctgctgcatagcttctccaatgtaccagtcattgaggccagcgcgcagcacttttaatgtttttagtgctagtaactgtgttttaactctccaggaataagctgggaggttagaaaacaagaaaaaagggggaaaaaaaaacctctccacccactttccttttttacagttacagaccctgttgagaaaaagaagcacccagatgggtgatggtgatagggcttgtggtggacacagggttgtggtaagattcctcagtgcttcggcgagcacctaagactattaccctggaactgactgctttctagagcttgattcatgcctctaagccagtggttctcaaagtgtggcccctagaccagtagcatcagcatcatcggggacctcattagaatgcagattctcagccccctcccagacatggtgaagtcagaagctctcagggagggactcagcaaatgattctaaagcgcatcaagtttgagaaccaccctaagccaatgagtctcccttttacttcccattagtcctccctcaccagatgattcctaggactcatggtgcaacatacaggagccaggctttagggaggggaggaaaggagcctggcggcaggggtctctgcaatggcaagaaagtgagtgaatccagcgctgccacctggttatccccttctcgttgaaaatagcagcgcaggtgcaaattcctaaacacaggctgcctgcactcggtgttacctcgggctgaggcatgataatattttattttttaaagctgtgaggaaatgaaagtgaggctttggttggggcgaggcagttgtgaaaga

SEQ ID NO: 1327 - DNA, 2202 bp, Homo sapiens
ttttttcctattttcccatccttgcagaatcagattcataaaattttagaaagattctcacagttcagccatggttgtgacaaactctgaataccagaggacacaaagggagaggaaaaactgttctattttttttccccaggtacatgtggaaaaattttgctgcactgaaaataacccttgcctttctcttgctccaggctgcccttttcttgggcctgggggtgttgttctccttggtcagcattcccttggtcatctatgactgggcctgctcatcgagtagtgacgaaggccactgaaacccgccgagaaaaagaaacatccctgttgtctgctcagtcaagtccccacacatcagcaatctctcaccacttcttttgcaagtttacagaagcaaacagaaatgtacaggatacttaaaatggaataactttttggttgcaaaacagagacatggttctataatgcttcatgtccctccaagatttgagatcaatttagggattgtgaaatttttttttcaaatttcatacaatcatatttcccagtacttttcacaatcattttttacccatctaactctatgttttgtggcttcccggtctcttagaactttgaaaacatgatatacaataatgtttatttattatacatccagattctgaaataattttcctactgatgttcagctcacactatctgtacctttttagaagagaaaagaatcttgaattgtatatatttattttgctttacagaaaaaaatggtttcgtaaataatttgcctattttggttaacatagcacatggagataatcatctgaaagttatagggcactgccactgctgaatcagagcatgcccaatatttgaggtggctctgatttcctggcagctgaactcgggtagtccagtggcctagctggtaccacatctattcccatccagagacattctctggcaagtgttctcagctgaaaagtggttggggatgattcttaccttggtaattaaatgaagctacacatttgggtaatctagcaaatgaagtattttttccctcttggcaacttgtgtcagagttactctggtctgagtcaactttcgctggggaaaacctatggaacctactgcaaaaagattgtccaaaatgcctaagaaaatactcctctgatgcatttagccttcaaccctacctgtcttgctgaagggagaaaaatgttttagtacattataggcccagcagcttttattcatgtccaccagctagttgcacagagaatcatgtgtacctaactaaggatgatctaggataagtaactcctgttttatattgagtattttagggaagtctttaaaagacttgttttatatctataaatctaggttattacaaatacaagaattttgtaccttaaataagcctcatttctatttcttcttcattaattctccatctagtcttgtgaaaaaaaaaaaaaaaaaaccctcagagatagtctttgtgaagagcttctgacagaatcactgagtaccttccttcccccagatgaggaagacaagggggtctcagtgtctgtgctgtctcctcttctcttccccaaccaaggactgtgccattactgcccgtctcaactgtccatgcaggaggacagagttgcctggtactcttacccttgtccctctcctaaagggagcacaaggaaactgaagagactgaaaaagaagagagtttgtagctgaaaaagaatagggatagcaaggaaacccagaactgcattcccctaagtggggccatcccatgtgattgaattgtccatagcttgcctatggtgagaaatgtgcatgctccgtgagctggtctcttgaaacaggacttatgcttcctctatattctggttaaattttccaaacacataagttcactgagcacagatttcttatccagagacaagtagaatctaaccgcagactgttggcagagtttccaggcacttagccatgttcccttcctgactcaaatccccaaaggccttcactctcactgagaatcacactactgtcccatagataaggcaggcattgaagcacctgtcgtgatcctctaggggggagaatgaaaggttatttcctgcattgcatcatcatagcttttaatataatgctacagaatcatatccacattaggttagagttcag

SEQ ID NO: 1328 - DNA, 1146 bp, Homo sapiens
cgagctccccgccgcccctgccacttcggtccccttcccgccaacccgggccatctgcaggctgtgcccagggccagccctccgctccaacgctgcccgtagtcccaggcgctgcccgcggctctccgggctgcgctcggacctgccactcccgcggccatcctcatgctgcgcccttcccacaatgcaactccctcgctccttcggccccggcggggctctggcgtacccaaaatgcaggccccagcggaacgcacagccctcctgtcctccgccggtgcccctttagccgccccacccccatccctaagggctctcattctccagctgcagccgcagctgggttccgaacacgccgccgggccccgggagggagaggggcaggtgccagggcggcgcgcagcctctgctcccggtgccagcttcagtgcgccgggcacacgcgcgccccgcaacccctccctcaccctttccccgttgctcaatctccgccagccgcggtcgctgcatcgtcagagagctgcaagagggaggcagcaaggtgcggccgccagcagtgacaccatgtgaccggcacggctcactgacacgcagctttggttaaagagcgggcgcacaggaggggaggagaccgcgcgcgggacggggaggaatggcctgtccgcgttaaaccatcacaagccatggttgcggaagggccacgcgtcccccagtaggagaatgactccgattcgtgaccctcagcgccggtgcatgtcgatgtaagtgcgaggccggcgagcagagtgtgagtgggggttggtggtgaggggagattctgatgcaatcggcccggaaaggaggagagccaggcgagcgcggactggggcggccacgccactccgccagaaggtcgccaggagcctccgcccttcaccttcctccgaaatccgccaggccacgccaagctccctgcccaacccttactgacgggggccacattttcccggcctccgcagccagaccttgacacaaaggacatcaaactgccgagggtaaaaaccccggaagggcggacacctccacatcgccttttgccacctttccctttatttccggaggtaaggtgattatccgttcccggggagggctgggcgagcggcaagg

SEQ ID NO: 1329 - DNA, 1133 bp, Homo sapiens
caagttaaatattctttctatagattatatagtggatagattttagtaattaaagcacatttcaaaaaatagaagaaatgtttagcatatatgttttattacttgctgatcaattttctctatgctctttgcaggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgca

SEQ ID NO: 1330 - DNA, 1148 bp, Homo sapiens
ccagtataaaattgaaaaagagtggtgaggggaaatatcttgctttgttcctgaccttagagggatgctttcctcaaagtttcttagaattaagggtaatgggaattgtggttccttgtagaagttctttaccaaattgaggctattcccctctattccttgtctattgagttttgttttgttttttggtatgaatcagtgttggattttgaaaaaatgttttttctacatctattgatatgatcatgtgttttttttctttagccttttgatgtgatgaattgtactaattgatttttgcacattgaaccagccttctatgcatgggataaatcccacttggttatggtatataattcattgcatacattgttgggtttgatttgctaatattttgttgaggatttttgcatcagtgttcatgagatatattttttttcttgtaatgtcattatctgtttggtattatgggaatgctggcctcaggagttaggaaagatatattagaaaagaagacagacctaacatcaattatccaagctgtcaccttaaggaactagaaaaagaagaaaaaataaatccaaaataagcacaagaaaagaaataataaaacttattgcataaattaatgaaattgaaaacagaaaatcaataaacaaagtcaatgaaactggaatctatttctttgaaaacattaataaaattgatgagccccttgccaggctaagcaaaaagagagaaaacataagtgactaatatcacaaataaaagagggacatagctgcttctatcttctgaaagagatttttcagaattggtttaatttcttccttaaatgttggtagacttcaccagtaaacccatctgggtctaatactttctattttgaaaaactattaattattgattcaattcctttaatagatattggcctattcagatagtctgtttcttcttgtgtgacttttgacagattgtttctttcaaagaattaatccatttaattcaagttatcaaatatatggccttaaagttcttcatagtattctttgatcatccttttaatgtctgtaggatctgtagtgatgtccctttttatttctaatattagtaatctgtctttcttttttattagtgagcctggaaga

SEQ ID NO: 1331 - DNA, 1179 bp, Homo sapiens
tactcagatccttcggcggggaaagaggtcccttggaggggtctctggctgggaggtttctctgagcattgccccccatccttgctcacccatcagggtgaagagacacctgtgccctggtgagctgtggaggtcaatgccggcagcggcgcgggaagcggggcgccgcaggctgtgtgaggggtgggggacaggatgtgcaccccccaggcctggggtctgttggtgttggggagtgtgagagcaggcggcaaatttggcggatgggctgggttcccacgaccagagtttctaggcctgtgggccaggagagagccctctggggcccgcaggccacccagtgccccacccccattgcttcccgctgtggctgcccgtttgggtctgacctccccagccacggctgctcctcactccttctccccgctggctgtcttgcgcacccaaaggcctccccctgcatctggacactggctgtctcgctgccaacgctccctgcccactcccctaggcaacatctgcctgaggcccagctctgcctgccgctttctagggtgagaatggggcatcggccctcagcggccctgctgggagctcaagatcaacttctcagcctgttccctggacttgcatctggacctgtgggaccttcctcaggacccctattcagctatagggctggcaggagactgtgactcaggtccctgccctccaatgagacgctttggcggccctttccccctcccaggactccataggctgctaggctgccgctacccatgggttattaagtcattttcttcttctctgcagtcatttctgagggaaactaaggcacagagtagtcccagtgagtggtacccagcccagtgaacctagactggaaccaggtcttggacctattgggactggtcctctgcctttagtcccctgatgtccctccttgcccagcagggccaggctcagaggcaagctcagagctgcctcctgatgttgcacctggaatggtcctggtgcagtgttctccagaggcctctgtgtcccttattcggcgggtgtctctgtggccaccgggtcttacagtgggttttggggcagggaagtttgcatgtctaagctgttcactccactttgacactgaagttcagtttccccatcagtaaaatggggagaaaattc

SEQ ID NO: 1332 - DNA, 1267 bp, Homo sapiens
tctcctgtggggtaaaatcattctcgattgagaagccttgtttggaaggccacctcctggcacagtatctctgtgaaagtggaaagatcttctggcctcctggttacataaccatgaggatatgtgcctggggcccgtgggtattgttctctgaacttgcaaaaaatttcctgggacatttttctggcttatttcatcccccaaacataattaattcttcttggttttcttttccctagaacttcagtgaagatttcatacattggcctcatgacccagagctccttggagacacatcactatgtggattgtggaggaaattccacagctatttaacaactgctattggttcttccacacagcgcctgtagaagagagcacagcatatgttcccaaggcctgagttctggacctacccccacgtggtgtaagcagaggaggaattggttcacttaactcccagcaaacatcctcctgccacttaggaggaaacacctccctatggtaccatttatgtttctcagaaccagcagaatcagtgcctagcctgtgcccagcaaatagttggcactcaataaagatttgcagaatttaatacagatcttttcagctgttcttagggcattataaatggaaatcataacgtggttctaggttatcaaaccatggagtgatgtggagctaggattgtgagtgacctgcaggccattatcagtgcctcatctgtgcagaagtggcagcagagagggaccatccaaatacctaagagaaaacagacctagtcaggatatgaatttgtttcagctgttcccaaaggcctgggagctttttgaaaagaaagaaaaaagtgtgttggctttttttttttttagaaagttagaattgtttttaccaagagtctatgtggggcttgattcacccttcatccattggctggaacatggattggggatttgatagaaaaataaaccctgcttttgattcatctgtgtctcctctgattgcctgggtgttttgtagggatctctgggggaaccgtagaatagttcccttccaagtgggtcaggatggaataggaggaaagagactgcaccctgattgtactcccgttcccatgagttcctgtcacagcaagcagcctcattttcttccatctgcctcttgcggcagggggctaccctgttcccttccaggacagagcactcagtgccccatggaggttggaattcagtcttgaataagacatcctggtttgaggttgtaagtt

SEQ ID NO: 1333 - DNA, 1212 bp, Homo sapiens
atttggttccatatgaatttcacaattgctttttctaattctgtgaagaatgatgttggcatttcgatagggattgcattgaatctgtagattgctttgggcagtatggtcattttgatgatattaattcttctgatttgtgatcatgggatgtttttccatttgtttgtgttgtctacaatttctttcatcagtgctttgttgtttctcttgtagagatctttcacttcctcggtttaatttgtcactataggtattttgttttacttttgtagctattgtaaatgggattgctttcttgatttctttcctagttaaattactatcattctatagaaattctattaatttttgtacatttattttgtatcctgaaactttatttaattcatttatcaaatctaagagttttttagtggagtctttagatttttctaggtataagatcatatcatcaactaagaaacaatttgacaatttgacttcctcttttccaatgtggatgccttttacttctttctcttgcctgatttctatggccaggagtcttacagtgctatgttgaataggagtggtgaaaatgggcatcctcgtctttttccagttcttagaggaaagtctgtcagtttttccccattcagtttgatgttggctgtgtgtttgtcatatatggccttgattattttgaggtatgtttcttctaagtctagtttattgagagtttttatcatgaagtgatatttaattttatagaattcttttctccatctattgagatgatcatatggcttttgcccttcattctgttgatataatattatcacatttattgattttcatattttgaaccatccttgcatctctagtataaatcccacttgattgtggtgcattatcttttttttttttttacttttattttaggttcaggggtacatgtgcaggtttgttatatggataaattgcatgtcatggggctttggtgtatgattattttgtcaccaaataggtagtttttcagtattatccctcctccctccctccctctgctctcaagtaggccctggtgtctgttgttcccttctttgagtccatgtgttctcatcatttagctcccacttataagtaagaacatgcagtatttggttttctgttcctgcattagtttgcttaggataatgtcctccagctctatccatgttgctacaaaag

SEQ ID NO: 1334 - DNA, 1240 bp, Homo sapiens
tctcttttttctaggacttggatgttgtgggtgatggtatgcagtgtcctccttcacctttgctttttgatccttcactaacccttgaagatcatttagtcaaagaaattgctgaagacccagtggatattttggcaagtgaagaacagtcccacctgtttccctcatgtagtgacctggccaggcagagggttccctgctagatagcatgtgctcctggaggggagtggggtgtcatcactagtataaagatgctccacatgtctctcacttattgaataccatataagcaaagcacttttaaaaatgccctactctgctcctgtgtacccttgttgctgtagttctccagatgggctcttagaacacctaatggcccgtgatcctcatatcccagagtaggacatacatttatttaaataaaagcttgagacaaggaatctagggaaatcataccttctgagggagagttcatcactgaaattgttctcattgtagaaggaccagtaaagtaatgtgatttgagttctgtccgtgagccttgggtagaattccagtggccctgactgaagaccagcagttgtactgtggctgttggtttcaagcagaggcctaaaggactgtcttcctgtggtctgttggctgttctgggacctcagtagggaatggctatttcatttggaagaaacaacctacagctcaccatcccattggaagaggctcaggaataggctcttccaagggactaggatagctaatatgggaagagcatctgtccagaattaatttctgttgtattgttcttattgctagtttaagtggccactgataagtcagattcatacttcagaccacagtgaatgaattactaactgaagtgcctttatttcttttaacagggccagatgcagatggctggagatgggtgcagatcccagggatctcgaaattctgagaaagcctctgcaccattgtctcagagtggattggctactgcaaatgggaagccagaacccacttctattagttgatagtttggggaaccattttactttggtggatttaaatttctcgttcttcaaagaagtatttctgatcatctctcacaaaacacaggcaacccagactaccttgtttttcttctggattgagtattatagtcaaacgtaaagccaaattttgaggacgtggaccgtgggtttcttcccactcagggcaaggaagagaaagagagataatc

SEQ ID NO: 1335 - DNA, 1240 bp, Homo sapiens; identical to SEQ ID NO: 1334

SEQ ID NO: 1336 - DNA, 1240 bp, Homo sapiens; identical to SEQ ID NO: 1334

SEQ ID NO: 1337 - DNA, 1211 bp, Homo sapiens
gcctcagtgtcctgagtagctgggactacaggtatgtgccaagacgcctggctaatttttgtatttttagtagagatggggtttcaccatgttggccaggctggtaattttttgtggagactgggtttcaccatgttagccaggatggtctcaatctcttgacctcatgatccgcccaccttggcctcccaaagtgttaggattgcaggcgtgagccactgcacccggcctgagcagctttaagtagattttaaaattatatatattctttaatgtgaagatgttgtgattctcatttttggtgattagcacaccaacaaatgggaaaggattgcaaattcttagatttatttaaaagcgtagaactaagcttctcgtgaagctagatgaatagaaacacggagcatctataaactggattaaacataggggggtacaaacctcctggatatttttaattcttaggaagaaggagaatttagcaccagactcttgaaaagcagtggcatgaaagttagtttgatatattgtttgagtttgtattgccttaggccctgaatcaagaccaatggtttgctgtagctgttggtttcaaacaggagctaagagtgatgtcttccttgtggtctgttggctattcagtattccagtgcgaattgccaattcagttggaagaaacatagtctagaatgtaatgtcattttttttttttttttttttacagagcaaaactatgttaggcttaagaaccagggagttggccgggcgtggtggctcatgcctgtaatcccagcactttgggaggctgaggtgggccaatcactggtcgggagatcaaggccatcctggctaacatggtgaaaccctgtctctactaaaaatacaaaaaattagctgggcgtggtggcacacgcccatagtcccagctactggggaggctgaggcaggagaatcacttgaacccaggaggcggaggttgcagtgagccgagatcacgtcactgcactccagcctgggcgacagagcgagactctgtctcaaaaaaaaaaaaaacaaaacaaaaaaaaccaggttgttgctctgtcgggatagggacttaaccaaaataatatttcctagccattcagaggaactgtgagttttctgttgtccttcctttcttcctaccttctccctttcccttgttggagcttgtttgcttgctttgtggc

SEQ ID NO: 1338 - DNA, 1181 bp, Homo sapiens
ccagtctgctaagggagcagagacattgtatcgcttgactcttttggaagggctgtttaggggcattttcaaggctatttgcatttgccactacatgtttcttctgaatatgtgtgtgttcctaggagtgttactgctacttgcttaagggagaatgggatggtgtctagtttaaatgaccaggatcctgaaaaggaggttggggacaagttttaaattactggtagagctagaatttgatgctagtaaatgacatttattttgagaagtaactttaaaaattgctaactgcatttggtattctgtatcaaatgtagttgtaatttatcttatatagtccacaccttgagttttatgtggcagacaatgctatttgtattttatgctttcgatagattgtgttttatttcccttgaccatttttctacagatatttgtcaggatacgaatcaggttctcttcaagtgctgccagggatctgaagaggtaccctgcaacaaacctgttcctgtaagcctctctgaggatccctgctgcccactgcatttccagttgcctcctcagatgtataagcccgagcaggtactgtctgtgccagacgatctggaagccggccccatggatctgtacttgagtgctgctgagcttcagcccactgagagtttacctctggagttcagtgatgtaagttagagaagctctgctttggttcaggcccttgagacaaagccttatttattaatggtgagaataggttagtctttgtggttaggagaatcgacaaagtttttgaagtgatatatacgtatagttgtatttatatgttagcatattcatttagagaaatctaccctaccttatatttttttccagactcttcccatacctttttagggatacaatttacatactataaattgcactctttgaaagtgtataattgagtgatttttagtatattcgcaaagttacgcaactaccaccactatctaatttcagaaggttttcaccatctccaaaagaaactcagtacctattatgacactcttcattttcttctcccctcagcccctggccacgatgaatctactttttgtctctgattttgcttattctggacatttcatatcaatgtaatagtatatgtatccttttgtgtcttgcttgtttcacttagcata

SEQ ID NO: 1339 - DNA, 1172 bp, Homo sapiens
gaacgctgtcctggctgccgccacccgaacagcctgtcctggtgccccggctccctgccccgcgcccagtcatgaccctgcgcccctcactcctcccgctccatctgctgctgctgctgctgctcagtgcggcggtgtgccgggctgaggctgggctcgaaaccgaaagtcccgtccggaccctccaagtggagaccctggtgaggagatagtcccgaccctcagcccccgtgggccgagccttgttgggtggtaatactggggtctcagcgaacctgggagccgggaggagaggaagtgcgggaactgagttgggggtggtgccgggtctaggggcgagaacgggatctttggaagagcatccgtgacccctgtagtccgatcgtaggtggagcccccagaaccatgtgccgagcccgctgcttttggagacacgcttcacatacactacacggtgaggggtctggggggccggggcggggcctgggagggggcggcgccctgctgaaacacgtcagctttggcttggacacgtggcaagcggttcgggagaagaaactcggggctctggggtcgtcgagcacgtggcgaggggagagacgttgctcttccgtgcctcttttccctccttgcttttctgccagttcctacctggcacggagaagtgcagggtggagagatctccgagaagcgccagccttctggggcttcctgttccttacagcggtaaggggaacgctaggctgccgcactaagggggctgccgccgcccagcggtccaggtgtgtgttgcgcgcctgctgggagggagagggtgctagatgtatgctcttgatgctctctccccccagggaagcttggtagatggacgtattattgacacctccctgaccagagaccctctggttatagaacttggccaaaagcaggtgattccaggtatgtgacctgtgcctcccattccacctcttcccaacctaagccctttcttagcctcttcggctccaaagctgccctggaaatcccccctgaaatgagtaagaccctagggctctacgagttacctcctgaggttcaaacctcacttctagtactccacttgtcccatatcctattggaagccagagatttaagaagtgagggaaaggtcaattgaggatggaggaggaaga

SEQ ID NO: 1340 - DNA, 3175 bp, Homo sapiens
atcatgtccacatgcccagcaagagccttgcctcccctgcctcccctcctttttcctgtccacctatatgaccaatccctaattgctgtcctgatgatgagtcattccaatttactggatttaaaacaaaaagttgttacggtttcatggggtggcccctctctctctcaccctctgggtttcgggaggtcgagtggggtattctctttgtttggcagtggttgctgtcctcttggcatctgagtcctttccctgtccccacaagcccttctactccctgtttgcctttcctttgccaccctctccctgttttacatggaaattgcacgggcctctctgtgtttgcgtgcatgtgtgcgcctgtatatacatgtatagagagatatatttgtgggggccggggggagcggggagggggtggagtgaagctcagggcttgcagccaggacactgcccactggagcctgtcatctgccccttccgtgttggtgagattaagggaagaaggtgggagggcattagtcaagccggactgccccagtctttgactggttaccctcctctctgcaggtaggtttttctggatgataggacagatgatggattcttcaccaccattttccttgtactcttctctccacccttcttagggctggaggatggcatttatctctagatgactgttcccaaggagatgccactctgctctgccttactgttgggaaggagagaggaacccactcactcttatcagcttagagtgttcaactgatccttccccaccatcttcagatctgttcctctggagcttgactggggggtggggatggcaagtccatggtgtgtgttagggacccagggcattgggggaagggaggcgaaggcctgaggttttccatcttcattctcttttgttattaggagaaggtgaggcatgggccaatcccattcctgccttccagtgccccaccacccttctgatcttaggggttggatgggtcatctgtccttggtcagaattttctcaccctagtactcctactggcctgaccagggctgactgggtattctaatgaggagctgggaagtggggtgacatagctgaccttagtatcaacccccctcttctccaactcttgttttctagtccaggatatgctaaaggacgaagattttctattgtttccaggccctcagaccatccttgctgtcccttcaccctccatgcccctgccatcctcactcacttctcataaatggatctgggggttagagtggaggaaataaaatcctgaagtggttgtcagtgcttgtgggatgcagtggtcttcaggattctccccgcattattatgtagttgttcagaagctgttgctactgcgtctctctgtctgcagggggcacttgttcctgaggtcctcgcctgggtcctgacttctgtagtttctgtgaagacgtggctgtcctgtgggctcctgtgtgtgctggctgcgccctgagctccgagacagctgcccataacctgctaaggtcagggcccagggccccccacagcatggctgagggaccccttcccagtagggctgtcccaagccccactccatggggccaggtttcctggccacttttgttgatagcagatggatcaatattagtaaccccatccaagattgaactgtgaaagagaggttccaggggtatctccctcagtgccagttacttagtgatgtgttacccaggatgcagcaggtgtgtgcaggtatcttgctctctaggcctgtgtgtgtgtgtgagtgtgtgtgtatatgggtgtgggtgtgtttgtgtgtggtggttgtggggggggtgttggaggttctatttcatttaaaaatgtattcatttccctggccccacagatgcttccctccatactttttatttgctctgtttcctcagatttattttgtcttgccccattgcctctccttccttgaactctttccttttcaatctcaactcattcactgctgttgctcatttgcccttttccatgtattttttcctacttaggattttccactctatctttgtggttcatgaggactttgcctcttctcctgcctcattccctgactttctctagttagatgtcagtcctaaataggttttcctcacttcaggcctcacccctcaccttgtttttttgggggctccagggaccaatctggggctggaaatgttaggaggttgccttggtgctgccccagatctgtccagcagggggcagtaagtgatcttggtagtatccctggctgctaagcccttggcaggggtggtcctttctacattcccattcacttaacagctcttttgggattgggtgtttcattccatttctgcccactccctctcctctcctctctggtaggtttaattttatgctttccctgattccagctttctgcttcctgaggactcccgctccccccaccccaaagtttgtctgtggtgttatagtggtaactgcagttcctcctctggaatgtagactgtatatgtttaataactcaccttctctatccttgctcaaaatgtgggataacgcgatgactgtgaccctggttggaaattaaacttgttttatgcagctttggagccgaccttcatctttgctgtgcagcagccgtgggacagtagtttcatggtgaggggagtcctgtttctggtccctctctccatagtgctccttctttcagcaaaggggtaaaaggcacacttgattgatagagagtaaggttatggaggaacttagtgccactccacactggttatttcttcccatcataccccgcggcgggggagcccaaatgaattgggcatcagagtgtgagggcttcgtgactttcctcctctagttctaaagggtttaaacctgaaatcagctgtatttctcacctgttggtagactgtatggacttcactggctgaagggccctgaacttggagggccccatgtgcctctactctcagatctcctcagccttgcacatgaggtgcttctagtttgaacagagaccccctcactagtctagttctggactttggcagtgaataaacatgaaggataaacgtctgggcagtgtaatgaccttaatccttcttacaactgatggccctgcatcagctctacttc

SEQ ID NO: 1341 - DNA, 1211 bp, Homo sapiens
atcagcacaagatcccctgccactgtggagcctggaattgtcggaaatggatgaactaagaagctttgaggctaccaggcaggggagtccccctacccacaacctcttccctgaaagggatgagggggaagagaggtagcagccagagccaggacccagggttggggctgccggctgacccggagcccctggagcaggaggctggggcagagggccctaggccaagcccaccctgggcaccagggacaatcctcttccccaccaccggccctcaggctggcatctctgcccccagctccaggaggggccagacagaagcagccattgggcatctcaggtttgagggggatatgggccgggaactacccagaagcatctgggaggcagcagggtgggggaagaggatgtgtggccgggcctcacagccctgctgctcccactgacctctccggcccaactcacggctgcaaagagacttgactaagcttgacaatcccaaaggccgggtcccacacctggccctgcctgccgggtcctgcccccaccctcacccccatccccctccctcttgatctgtctctgtttccctcttttcctctgtgtttctgtctctctatgggttgtgtttccttgttttccactctgacaaatgcaacatgaacgggaaagaggcgcccagctgcctaggagggcaagctgggcaagccgggcaaggagaccccgcacccacacctacctcatttaagtgttggattttttgctgttttgaaatgtgagaccctctccaagccccctactgccccaaccctctcccccacctcactgccctcttctgagtgggtggaaggggggtaggaggaggaagaaaaacaacaacaaaaaatccatctttgtttttaattatgggcatgggatggtggttgaggcaaatgatgatgaagattggggatgactggcccctagttgctctaggacttccttctccatctggacatgggggcaggagggagctaaacctaggaccaggatatctccctcctgttttcccaacctcatcatgagcctgtttgccctccagcccctggacgggttgggtggggggtagggtgagggctatccctgagtggcatgcccatacctagtgaggcagggtgtggcccggagctcccactttccctcagtcaccaaactgctgctggtctggtgggaag

SEQ ID NO: 1342 - DNA, 1155 bp, Homo sapiens
ggagtcctggactgttcctggccatgatcatttgtagacctgtggtgtcacctgaacttcccagtcttcctcaacagtgtccttcattcccccacagaactgcccaagatggaatccaaggacctgcagcagctcttcaaggatgttctgggctctgaacgagaacagcatctgggttgtggaacccctggcctagaaggcagccgtacgccactgcagaggccctttcttcaaggtaatacaggtgggagtggtctgaagactgacataaccaagcttgcctccaggatgggccagttgctcttttctctgatcctgtccgtcttgtaggtggactccctttgggcaatctgccctccagcagcccaatggactcctacccaggcctctgccagtccccgttcctggattctaggttggtgtctctgcgtaacctttgtgggcagtcctcgttgtcctttccctccatctgagttcatgctttgcctccctcggactcctgcagcacttcccctgctcctccccattcccttgttagtgaccctcctcttttggggcagggcagtggcctggggctctaggcagtttgtctggggtgggacttggcatccctgcgccctgtgactctctgcccctgcgccccagggagcgcgggggcttctttagcccggaacccggtgagcccgacagcccctggacgggctcaggtggcaccacgccctccacccccacaacccccaccacggagggtgagggcgacggactctcctataaccagcggagtcttcagcgctgggagaaggatgaggagttgggccagctgtccaccatctcacctgtgctctatgccaacattaattttcctaatctcaagcaagactacccaggtacctgtgggatgagggcaagggagacagcctggcaacatggcaggtggaggagtcgcctgccaagtcttctctgactcactctctctgccctccagactggtcaagccgttgcaaacaaatcatgaagctctggagaaaggttccagcagctgacaaagccccctacctggtgaggcagaaaggagcatggattagcgtgggaactgagagggagggagggatctttgggtaatttacctcagttctttccgctccccactcctaa

SEQ ID NO: 1343 - DNA, 1233 bp, Homo sapiens
aggattacaggcatgagccaccatgcccagcctgcctcctctttagtacctgacaggaaagtctgattttttaaaaaatccatacttaacctacataggtatatttgttttttgttttttgttttgagacggagtctcactctgctgcctaggctggagtgcagtggcgcgatctcagctcactgcaacctctgtctcccaggttcatgccattctcctgcctcagcctcccaagtagctgggactacaggcgcccgccaccatgcccggctgctaattttttgtatttttttagtaagacggggtttcaccatgttagccaggatggtctcgatctcctgacctcgtgatctgcccgcctcggcctcccaaagtgctgggattacaggcgtgagccaccgtgcccggccaggtctatttgttttgtttgtttgtttgagacagagtctcgctctgtctcctaggctggagtgcagtggcatgatcttggctcactgcaacctccatctcccaggtttaagtgattctcctgcctcagcctcccaagtgagtaactgggaaaacaggtacgcgccaccacgcccggctaattttacatctgtgtgtctgtctgtctgtctgtctgtctgtctatctatctatctatctatctatctattttttgagatggagttttgctcttcttgcccaggctggagtgcaatggtgcgtgatctcagctcactgcaacctctacctcctgggttcaagcgattctcctgcctcagcctcccaagtagctgggattacaggcatgcgccaccacgcccagcaattttttgtattttatttttagtagagacagggtttctccatgttggtcaggctggtctcgaactcccgacctcaggtgatccgcccacctcggcctcccaaagtgctgggattaaaggcatgagccactgcacccagcctattttttttatatatatttttagtagagatagggtttcaccatattggccaggctgttctcaaactcttgaccttgtgatctgcccgccttggcctcccaaagtgctaggagtacagatgtgaaccaccatgcccggcctctgttttttttttttttttttttgagacagagtcttgctgtattgccaaggctggagtgcagtggtgccatctcagctcattgcagcctccatctcccaggttcaagcgattctcccacctcagcctccttagtagctg

SEQ ID NO: 1344 - DNA, 1241 bp, Homo sapiens
cctgagtgacagagcaagacttcacctcgggaaagaaaaagaaaatttacacctttaaagtgtacagttcagtggtttttttttttttttttttaatttttttctgtaacccaggacagtgccaaagttcagtggtttttttgttttttctttgtttgtttatttgagacagaaactcgctcttgttgcccaggctggagtgcaatggcgcagtcttggctcacagcaacctccacctcccggattcaagagaatctcctgcctcagcctccaagtagctgggattacaggcatgtgccaccatgcccagctaatttttgtatttttagtagagatggggtttcaccatgttggccaggctggtctcaaactcttgacctcacgtaatcctcccacctcggcctcccaaagtgctgggtttacaagcgtgagccaccgtgcccagccaagttcgtgatttttaacacatttatagagttgtgctaccatcatcacactctaattccagaacattttttatcatccctaaagaaactcattgcccaggctggagtgcaatggagtgatcttggcttattgcaacctctgcttcccagttcaagcgattatcatacctcagcctcctgagtagttgggactatagatgcgtgccaccatgcccagctaatttttgtatttttagtagagatggcgtttccgcatgttggccaggctggtctcgaactcctggcctcaagttatctgcccgcctcagcctcccaaagtgctgggattacaggtgtgagccatcatgcccaaccctgagatggcttctgaggggcttgatatggagggagagggcctaagtagcttcagaatgaaaagaacaagccaggattagagggttagaactttcagccccatcccccaagacctcagggaagggagtggtgactggagattgagtttgatcaccaaaaggtcaagccttaattatgcttatgtggtgaaaactccggccaggcacggtggctcacgcctgtagtcccagcactttgggaggccaagacaacggatcacctgaggtcaggagttcgagaccagcctggccaacgtggtgaaaccccatctctactaaaaatacaaaaattagccgggtgtggtggcaggcgcctgtaatcccagctagttgggaggctgaggcaggagaatcgcttgaacccgggaagcagaggttgcagtgagctgagatcttgtccccc

SEQ ID NO: 1345 - DNA, 1163 bp, Homo sapiens
acttccctctggccacatatgcccctgtcatctctgctgagaaagcctaccacgaacagcttactgtagcagagatcaccaatgcttgctttgagccagccaaccagatggtgaaatgtgaccctcgccatggtaaatacatggcttgctgcctgttataccgtggtgacgtggttcccaaagatgtcaatgctgccattgccaccatcaaaaccaagcgtaccatccagtttgtggattggtgccccactggcttcaaggttggcattaattaccagcctcccactgtggtgcctggcggagacctggccaaggtacagagagctgtgtgcatgctgagcaataccacagctgttgccgaggcctgggctcgcctggaccacaagtttgacctgatgtatgccaagcgtgcctttgttcactggtacgtgggtgaggggatggaggaaggcgagttttcagaggcccgtgaggacatggctgcccttgagaaggattatgaggaggttggagcagatagtgctgacggagaggatgagggtgaagagtattaacctgtgtgctgtacttttacactcctttgtcttggaactgtcttatttttgttctgtaaatgtctattgccgtaaattgttaataaaattgaagtttccattttaaatgtcgagctgacttaaatacttgatccagttaaagttggatgtatgaggctggtagatgaaaccacctgagtcgagggtcttgctctgtcacccaggctggagtgcagtggcatgataatacatagctcattgcagcctcgagctcctggactcatgtgattctcctgcttcagcctcctaagtagctggggactgcaggtgcacaccaccatgcccagctatttttatttcttgtagagatggggccttgctatgctgcccagggtggtcttcaactggcttcaagtgatcctcctgcctcaacctctcaaagttttgattataggcatgagccactgcccagcttcttggtttatctgtttaatttgggcctgaattaagtggttatagaatcattttgtaagtgaggaaacgggttcagattgagccagtgcttctctaactaaaatggatgtgaatcacctgtagatattaaaatgcaggtttggggtcaacctggtg

SEQ ID NO: 1346 - DNA, 1228 bp, Homo sapiens
gaaacttacagttagatgtaataacaaaaagaagtttatgcgtatcactttttgtgccattctaagtatttttggtttcttgtctccttatttcctctttaccatttttggaggggaagctattttttttccttgatctttcccagtgatatggattgaatctggttggtcatttccaccaggaatcagaggcagctgttaccaggtttcggccttccagttgatccctccactgtccaggctgtctcaggaggaggtgaatcagagctagtctgtcacctttccaatctaagccgaagccacaggtgcctgacaggttcccttctaacaactatttgaccaagagaggcaatcagggggttgtatactgcactggattcgccagagaagggaaaatttaattagtgaaaaggaaagaacactaggaaacatttgagaacctgcctctatcccagaatgtgctggagatttgacactcaaatcagtgtttagtcttctgcttggcaccatagcttaacctgcagtttcttcaaaatgcccaatgccttgtttcctattaccttagattgcaaaccagtctagggaagtctatgagaaagtagcatttaattaaagtttaaaaaaaaaaaggttgggcgttgtggctcatgcctgtaatcccagcactttgggaggctgaggcgggtggatcactaggtcaggagttcaagaccagcctggccaacatggtgaaaccctgtctgtactaaaaatacaaaaattagctgagcatggtggcgtgtgcctgtaatctcagctactcaggaggctgaggcaggagaatcgcttgaacccaggaggcggaggctgcagtgagctgagattgtgccactgcactccagcctgggagacagagcaagactcagtctcaaaaaaaaaaaaaaaagcatttttctgttttaatgtttggagacttttttttttgttctctccctttcctgaaccctattctgatcctgaaccaaatttatagcaatataattagtgttaatctaaggcattactcatcaaaaaaattgctgcagtctttacagttgaataaataaaaacaactgcataaatatgcccacttttgtttcatagcagcaagtggtttcatttcattatgtttttctttgggcctcatgggggtagaagtcactcagacagcttgttccaggattaaatgagggtatctgattcccaagtc

SEQ ID NO: 1347 - DNA, 1206 bp, Homo sapiens
cccacatcctcctgtatatattaaatggtctctagattacttataatacctaatataatataaacactatctaagtagttgttatactgtttagggaataacaagaaaaaaaagtctgttcatgttcagcacagacacaaccatctatttttttctccgaatatttttgatctgtggttgattgaatccacagatgcagaacccatagatacagagggccaactgcattaggggatttataagttacatagagacaaaatgtatgacaacagtaggacaaaggccgggagggaagaaatagatgtatactattgtaaggttcttacacatgaaataatattatttgaaagtagactatgataagttaaagatttatattgtaaaccctagagtgcagtggctcacgcctgtaatcccagcactttgggaggccgaggtgggcagagcacatgatcaggagttcgagaccagcctgaccaacatggtgaaacccagtctctactaaaaatacaaaaattagctgggcgtggtggtgtgcacctataatctcagctactcaggtggctgaggcaggagaatctcttgaacctgggagttggaggttgcagtgagccgagatcatgccactgcactctagcctgggcaacagagtgagactctgtctcaaaaaataataataataaaataacaaaacaggctgggcatggtggctcaagcctgtaatcccagcaccttgggaggctgaggcgggtggatcacatgaggccaggagttcgagaccagcctggccaacatggcaaaaccgtgtctctactaaaaatacaaaaaaattagccggacatggtggcgggtgcctgtaatcccagctactcaggaggctgaggcatgagaatcgcttgaatccaggaggcggaggttatggtgagctgagatcgcaccaccacactccagcttaggagagagagaaagactctctcaaaaaataaaaataaaaaataacaaaacaaagaggtatggctaatatgtaatatgtcaggagtggagataagatgaatttacttgaaaagctcagttactccacaagaaggcaggaaaagagggaaaaaaacaaagaacagattagacaaatagaaatgaagagcaaattatatatttaaactcaactgcgttgataatcacatcaaatataaatagcctaaaaccacc

SEQ ID NO: 1348 - DNA, 1219 bp, Homo sapiens
gttacttttaaattatacaaaatttcttgcataaattctttttttaataacatttttctctttcacaacttttgcagacaattctttgacatgcttcaactttctgacttattacaaatatttctttctttaaacaaccagttaatttaattcaggacaaaaatttaccatataatactctttttacataaattccgccccccccccccccccttttattccttaggatgcttctgaactggtgaggtgtgctcagaatgaggtttcctgtaagtttttttttacttttttctgttagcaaagcagttgccgctacagattgaatgcatttgggccatccacgggttactgggttaaggatttttgataggaaggcctcagtgctttcaagatacgcccttgtttacactgtcaacaaagtggtattggagtgttatagggttacggagaataccttcaattatcaattacaggttttaaatttaccttggcttttaaaggaatagggtacacttttcttttaactacttgtatatctctctttctttgattttctgtctctttttctctttgacttttcttttgcctctgtctctttctctctctctgcctctctctctctctctctctctctctctctctctctctcctggtctttccttgcctctgccagccacttatgctgccgttctatcaatcactgtcggggatctaaaaccagctgtaaccaagtgtctatgtatgggaactggtctgggtgctttggcttataggttaccttgtgccatacctttgaaacaagggacctgtccaggcttccttctgatggccaacccacctctaatgctggccagtctatcttccacaaagttttaagttttcctggtgtcatagtactccatagtctcccttaaatttcttgaaatttttcaacatagttcctagtggggtgggcttactttgtgcctgacccatgcttctttgagacaaaacaccatgctcacaccacacgcacaccacaaaacaaagaacaggtaaaaagggcacacacacacttttgcagtttacaccaaaccaaaatcaaaaccaaaatcagagtatcaagaaatccaagccaggtcaaaaccaaaaccaaagtatcaagcaatccaaatcaagtcaaaaacaaaaaccaaagtgccggtacaggcacaccgtgggtgatcaggccacgcttcca

SEQ ID NO: 1349 - DNA, 1201 bp, Homo sapiens
ctatctttccagaaagtggtttcctaaattctggttttcctcctggaatcctgctatttccttctcgcatactctagagaaatcgaagtgttttcaaaggtgctctgaagcttacgctccactagtttcacagtaaatcgccccttgcgagggcgctttttttttttttttaatgtgttctctgaatcgctttccccctttaacactgcatgacaagactaaagccagaatcccaagactgcagcgctaccccttcacaagccgtcgggctgtcccgggcggggccggcccattttcactttctccactagaggcagcagcgcaccgtgaccctggcttactacggtaagaaagcggagaccttttgcttcgaggcggttggtggccagtagtcttgatcgacaagctcaggcctctgaactaagcagccgctgtttatgcacgtacagccaatggaaaggcaggagtgcggccaacggccaatgaggactggtcttaagcggaccacagggcggggtttccctcgagaggcgaacgccgggtaaaagatcgggagcggaagtgggcgagtcagagcacatccggtgttagaagcgctggtaggccttggagaggcgggttaggaaggtacgtctgaacctagtactgggcgaactgggagtgagaaatggaaagggagttagcagttactgtctgagcaagagtggcagtagcttccttctgcggacagatggcaccctgaaggaacgaggccctgctcggagaccagactcgggaaaacagggtgtggagggaagctagggaactagtgctgcgcgtgcgcaacagtgctgaagcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcgggtcctttggtcgggctgaccctgggtgagcggcccggagccaagactcgaggtagggcctggcgggcgggtgatgtcacactcctctgtgacacgcgaggctcctcagttacttagccaac

SEQ ID NO: 1350 - DNA, 1163 bp, Homo sapiens
cacacccagctaatttttgtatttttagtagagacagggtttcaccatgttggccaggctggtctcgaactcctgacctcaggtgatccgcccacctcagcctctcagaagtgctgggattataggcctcagtgagccactatgcccagccaagggaattctttagcatcttgaaacaatgacataaaattgctttatgtgccaatgtctaggttcctttaactagattgttaattgagaatttcttttataaacttactgccttttaaagtggcaaatcacctgaaagaatagaaatcagatgatagtaacaaaatagtttgagggagaagaagatgcattcaattcctctgtcgtctttaagatggttgactatgattgcaaatatattgtaggacacataaaaataaaaatggttgtgttagggctgtagaattttaggcaagttttcatctttctgaacttacatgttgcttttttttttttttataagctgttcgtgtgattctgtatgacttaatgactctaacctttctttattctgcagagtggagactgctgcacggactctggaaccatgaacatatttgatcgaaagatcaactttgatgcgcttttaaaattttctcatatgtaagtgttttgaccttgactggttttgtactgcatttcttttcatatctctttgtcccttttctgcatttataacttttgtgtgtataagctaacaaattaacttggccagaatccagaggacctgatgaaaatgtccaaattctacacgttgctgtgtggttattggaaaggcatttattctagtttgggtactgattattcataattttgggcatttggtcttcctcagcatttaaggttctgttaacctattttcaaaatattattttttattgtaatatgctttcctaaaagtatttcaaactatttgtaacagaacttttacatattcccaggaagggaaagagagaaatgattcttcttagcttaaatatgagattgatctgggactgattgctcttattcacattcttttcttagaaccccgtcaacgcagcagcacctgaagaaggtctatgcaagttttgccctttgtatgtttgtggcggctgcaggggcctatgtccatatggtcactcatttcattc

SEQ ID NO: 1351 - DNA, 1255 bp, Homo sapiens
tggagcacttctcgcgcctaatggttggttggtggtcttggcctctagtttcactctttgaggatagagtgccatctgcagccttcactgttgggatctgagctgtagtggctgtgaatagcctagagtggtcaggcagcccacctcggcactcctggggtgggggtggggacagctgcttaacctttattcttggtcggtctgtcggcaactttgggaaccaccagtaggatgtggttaagattcagttcttgctgagctaaggaagcatttctcatttctttttaattgtctggctcacttctagtccctaactaaatgctcactcaagagttttagcttgaatgtcaaatgtcaaaaaattaattgggtgatttttctccatttctaggataagaagaaagagaagaaatgaagtgaccatccagcctttcccaattagacttcctctccttccacccctcatttcctttttgcacacattacaggtggtgtgttctgtgataatgaaaagcatcagaaaagcttttgtactttgtggtttcctctattttgaattttttgatcaaaaaactgattagcagaatatagtttggagtttggcttcatcttcctggggttcccctcactcccttttttgtcaaccccatctgtagcctcttcctctactcaggcagtcgacccgccacgatgagaagtgggaccagcagagggcgccaacttcaggagtccgctttcccaccaggcttcattcacccagtggacctgaactgtttggtagagccacccggcccttccttcctcattgttgtttggtatgcgcacagttcctgtgggactgggccgtgagttttccattggaaagaagttcagtggtcccattgttaactcagcctcaaatctcaactgtcaggccctacaaagaaaatggagagcctcttctggtggatgctttgctccctctgagctgcccatgctggtctggcaaacacacctttctgctttgccttcacaaaagtaatgtgttccctttcccaccccttgcctgaccctcagggagtcagcctgcttccatccatgggtgggaagacttcagcacaaaggaaagactaattcttgtcaggcatttttgaaaaggctgattatgtgtatcaaggtacagcatcgtagggttcccctaaacttgccctgtttttgtttttttagtttgttatccccttactgagcggcctctactaggtggctgtgattaaat

SEQ ID NO: 1352 - DNA, 1097 bp, Homo sapiens
tcctaatagtccttcagtgcattttagtctgtctccaactggacaccagtaggtagtgtcaagccagagattcggggcagtagataaatgttcattttactgatgcactttagtttttggtctgttacctgttttccagaaatttgtggccttttaggcgggagttaggcgaccaaaccagtgagagccccaatccctgcagttttgtggcttcaagtgtgggtggacagtcctaatggggatctccagctccttcctgtgggctgccacagacagctacccccagaagggtcaatgttgggagtggttgtggctctgagctgctctacagagcttcagtgtgagaggatcgagccattgaaagctcattaccagtaggacataatttttggctctccctattcacaaccagtgcacagtttgacacagtggcctcaggttcacagtgcaccatgtcactgtgctatcctacgaaatcatttgtttctaagttgtgtttattcctggagtgacatgccaccccgaatggctcactttcactgaggatgctgtcctctgatttagctgctgcctccagcctctggcttgagaacttactaaaggcacttccttcctgttaaacccctgttaactctccataaatttggtgattctctgctaggcctaagattttgagttaacatctcttgaagccaaactccaccttctgtgctttttgcttgggataatggagtttttctttagaaacagtgccaagaatgacaagatattaaaaaaaaaaaagaaagaaaaaaaaaaaaacacctacttttaaagaaaatacctaacagatttttaatatagttatctctaccactttcttttctagtttcttgattttcagctcaggctgcattctaactcatactgtgaagacaaaggtgtttttgattcagaaatatatgaaatctgcatagtcttaatttgtaaaaaataaagaaaattccttaacctttcctggtgtttgtgttaaattcaagggtacagctggtcatggagcttgtgatactgccagggtttgctactgggggctgggagtgggacacgattgagttcgt

SEQ ID NO: 1353 - DNA, 1204 bp, Homo sapiens
agggctggagacctcggagtctctcagtgactcactctacgactcgctgtcctcttgtgggagtcagggctgaggggctgcgccacgccacggccccgctggagctggggaccacagactggaccggctctcttcatgcccagcccccggagacggggacccctccctgaagggaccaaggaggcaggtggataagaaggtgaaaagggggtccctggcacaccccaccacccactgcttcggcggatgagatgaccgtgctcagctcagggagagaccccgcccttggtcccttctctcacccagagtaaggctcttcctggaagggactgggggttaaaggccactgtgtcgcagccctccagtccctacttcaggctgagccatcttgtggtgctgggcttcctgcccaccagccgtgccatctctgcccaacccggctgctcctctgccccgaagccctcgcgaggccctcctggaggcccccgtgctggtggagtttgggggccagggggacaagttgccttctctctctgccctggtcctccctgctgtctggatggtgctgccctcctctgccccatgcctttggggtctgttcgtccgtcttttttgttgttgtttttatatattgaagcgcctggcccagcccccagcccccagccccgcactgcggttaatttatgtgttgtttaaaatgcggctgctctgcttcctgcctctgcttctgccgtatccctaataaaatgtggaggccccctccctgcccctgagtcggcttgttgtgtgggaggactcaggcaggccaggtcgggggacactgcatgggtgccaggttgagggaccccaggcccccttgtgacacagccccctcaccagggcaactggctggagtcatcccagaaggtaactgagggttgggagagtagggcctgcttaggcccggaagggtatctgggctcggagagattctcctgggccagggcttgggcacggcgcgaggctgggtggccccttggagagggagctggggaagatggctgtggacatgcactcaggccccacgtgtcccaggctgggggggacatgcagactctgagtagagttgcatctcttctccagaccttggttttcctcctctatagaagattagaaagttaatccagacgagctggtcccatcagccagactttcttctcagcat

SEQ ID NO: 1354 - DNA, 1228 bp, Homo sapiens
aatcccagctacccaggaggctgaggcaggagaatcgcttgaacctgggaggtagaggctgcagtgagccgagattgcgccactgcactcccagcctggctgacagagtgagactccatctcaaaaaaaaaaaaaaaaaaaaagacattattagactgaccaggaccaataagatgattcagataagggagatcagtgagactagaatctctggggaaggcttcatggaaaatttgggatttgaagacgttcccagaaaggggagcacagtaagctcagacaagaagataggaatgggcacagagtatgaactcatccgttgtcacccctcctgtgctgactgtgacgagttagagaggctgagcagaggagcaaggaaaaagggatgccaggaaagatccctgaacaaggcaacgacttgttgattgcagaggtgactgggtgttgtatcagtttgctgaggctgctgtagcaaactaccacaaactgggcagtttcaaacaacaggcttgtctcacagttgtggaggctggaagtccaaaatcagtgtgggcagcactgcttccttccgcgagctgggagggagactctgttctgtgcatctctcagcttctggtacctcaggcattccttggcttgtaggtggtggtctctgtgtgacttcacgttgtcttccttctgtatgtgtctgtctccatgtctaaatttcccctctttataagggaacctaccggtcatattagggggtactctaatgacctcatcttaacttgagcatctgtagagaccctatttccaaataaggtcacattcacaggtactaggggttggttagacttcaacattttggggaaggatacaatttacccaataatgggtgtgaaggaaggaaacaagccttttctcctctctcttcctccaccctgcatctccatttccctcagacaatgactgatgtggtgggtaacccagaggaggagcgccgagctgagttctacttccagccctgggctcaggaggctgtgtgccgatacttctactccaaggtaagtacatggggtgcacgggggaaattgacaaaaggcacggggttttcacccctgatgggggtcagtggtgttagataccaacttctggtttgtctcatcttccactcccttcactattttctccttaggtgcagcagagacgacaagaattagagcaagccctgggaatccggaataca

SEQ ID NO: 1355 - DNA, 1330 bp, Homo sapiens
gacggtgagactctgttattccctgcagccacgccctctcacccctccccgctcccccctccaaaaaataaaggtactgatatttgcagttgcttgactctgaaatactttacttggctccatggttatttctttattgttaccttttatccgttgcatctttttggtgacagccaggaatgacagtcaagttatctttacttataaggaagtatacctatggttttgaaaatacatggtgtgtttagtacatttttgcatgttacttaaaaccacttgtgtacagttcttttccatatatttgaccaatacaggttggtaatttttaattacagaaataattagtgaatactttttctaaaaatgcaaataaagaccttctggaccagcaacccaaatccttgtttccttcttgcttctaaaaagtgactacttctaaaaagtgactactgccaggcatttattattattattaatgttaacagctaaggacaaagtcttttttagagagccttttgcaatttttatattaacctgtgacagcccagtgatgatcactattcctacttagagagaataggactaactttcagaaatccaggcatttttctacctttcatactatctttctttcactttacttctcttttctgtcttttatcacttctttctttcttcattctttctctcttttgcctggatcgagattgttaagtccctctcagtgaagggtaagattatgagatctgagggctgtataaatgtagtaagttgtcccttaagcatattgaaatgtagtgtgaaagttggatgaaggacattttctaaacatatgcaaataccatatctatcatatcagttcattttcaagatgtaacaggtaatataaatttttttttttgagacggagtcgtgctctgtcaccgggctgtagtgtagtggtgcagtctctgcttactgcaacctctgcttcccgagttcaagcaattctctggcctcagccttctgagtagctgggactacaggcatgtgctagctaattgttgtatttttagtagagacggggtttcatcatgttggccaggatggtctcaatctcttgacctcgtgatccacccagcttggcctcccaaagtcctgggattacaggcatgagccaccatacccggcctttttttttttttttttttttaaagacggagttttgctcttgttgtccaggctggagtgcaatggcgggatctcggctcactgcaacgtccgtctcccgggttcaagcgatactcctgccttagccttccaattagctgagattacagacgcatgccac

SEQ ID NO: 1356 - DNA, 1194 bp, Homo sapiens
tttctctacaagcccccaaatcctgatccttcacacagtagaatcaggtagagcactacactgtttgtcataaatggactttgttagtagtcacattgatcatcatagtttaaaacacagacatgggcttgaccttaatatcatatagaaggtggagctaagccaatattaaattgcactggctatgacagttcctcaggaagagttgctaaattataaactggctgcatattgcctgcagtgttatctctgatactgatttgtcagtttaataggagcagccttattccaaggtgtaattttaaatagtgtcagtgaccttttatgggctggatgagcattaatttgtccttgaaatatatcaaaccatctcacagggacagtaaaatatttgcgtggaattaacaatatacaatatgagttctcatgagaaataagtatgtcagctttctattctttaccattttcctacagtaatgaaaagcataatttcagcttcaggttgatctgttccaactccttagggtccgtgtcatcctgtgatgccttcctgagtctgttccaaagtcatggactgaagcctgaggccatctgtccgtgcgccacgtctgctgaagccatgactgtagcaatccgcaggtactgttcaggatgtcagatgctcttgatgtatgttacaacttggatgaaatgtgcagtatttaccaggtgatgaccaacggatgttaactaattttctaagcagtttcaagcatctcatttttcccactcttgctcaaagtgtatgcagtaaactgaaaaatttaattgatatcatttcgtatttgtgaattagctctttttctgtgccattttgctcttcggaatccatagcaccttagattaaaaatagactgttcttgattgtagcttaagtatggatagtatatctatagtatattcaagaccattatgtatgtaagtatcagtgaatgtgtgtgtgtgtatatagatatactttttttttttttttttttttttttttagataggatctctctttgtcacccagtggcatgattatggctcactgcagcctcaacctcctgggctcaaacagtcctcctgcctcaacttcctgagtagctaggactacaggcatgtaccaccacgcctggctaatttttaaatttttttgtagagataggttcttgtt

SEQ ID NO: 1357 - DNA, 1224 bp, Homo sapiens
ttgttacttgttaggaatacttctaacacctaattattatgaatctttgataattggggaaataagtttgaagatgatggctaaaatgaagttttggaattatttatgggatacatttaatcttgccttattatcttttaccataagagataattgaaagttggtacagatgcctactccaattttaaaaagtagctgtattatagtccaagcatttaacatgtatttcacatagccatattgaaacttgaaatagttaggctaccaaatgtgcgagtatattgtttggttgcaatgtttgtggttttggatttatttaggctctatgtctgacctactttttaaaggatttaattaaggtagcttaaatatttaaaacgtaacaattaagaataaaagtaggtattagttgtagagggaatacatataagtagggccctaagataagttaattactaagttcgaataccaaatttgaattttgcagctaaggctaaaaaaggaaaaagatctttttttaaaagaaaaaaaaatcttaacatccacatagatgatacattctacttataggtaattccaaatatgatatagggtttaagagctgtgtttaaaaatttttctcttctctttgtcgtgtacttcatactagttaaactttttcttccataaaagtaggcattagggaagagggacaattcatagacaaagaacgtataaagaaaaacaggctgggcgcggtggctcacacctgcaatcccagcactttgggaagccaaggtgggcagattacgatgtcaggagttcgagaccagcctggccaacatggtgaaaccccgtctctactaaaaataaaaaaattagccaggtgtggcggcgggcgcctgtaatcccagctacttgggaggctgaggcaggagaatcgcttgaaaccagagggcagaggttgcagtgagctgacatcatgccactgcgctccagcctgggcaaacgagtgaaactccgtctcaaaaaaaaaaagaaaaagaaaaactggagtgtggagataacccttggatcataaattaggcagcactaatttttggggctactttaaaaataattttttttgccgggcgcggtggctcacgcctgtaatcccagcactttgggaggcggaggcgggcggatcacaaggtcaggagatcgagaccatcctggctaacacagtgaaaccctgtctctact

SEQ ID NO: 1358 - DNA, 1099 bp, Homo sapiens
cttcatttttttcttgtctttcaggtcaatatccaacacagccaacctaccctgtgcagcctcctgggaatccagtataccctcagaccttgcatcttcctcaggctccaccctataccgatgctccacctgcctactcagaggtgcttccagtttgccagatttgaactagctgggaatactcttagggtggtcctttagtccttagctaaatctgacttcacatatttactcttcacaaatgctaacatgaataatctaaaacactatataatttggcaatttttgtcggagttgaaagtgcattatttgatgattttgtgttatttggcacaggctaaggtgcagaagatgaatttgcgttctgtgagcccaacattagctatagcagaaagtgatccaggagaatattgaaggccagtggaaaggcaacttgtataatcttacaaaaagtataacctgcataaggagaattaagaattagctcattaaagagatctcaaataggaatgtcataaagtaacattttgccttctcttctgcctcttctagctctatcgtccgagctttgtgcacccaggggctgccacagtccccaccatgtcagccgcatttcctggagcctctctgtatcttcccatggcccagtctgtggctgttgggcctttaggttccacaatccccatggcttattatccagtcggtcccatctatccacctggctccacagtgctggtggaaggagggtatgatgcaggtgccagatttggagctggggctactgctggcaacattcctgtgagtatgacctcatcagaagaaactcagcccttgtgtattttaactttctgaaatgacttcatattcattctcttaccatttctggatgatagttgccagtgttggtacaactactgacatccaatactcaggcagaaagtgtttgagggggcagaactgtggcaagtgagtagcatctcactgggggctgagttaaccagattcttttgttttcatgtctgtcgagtcctgcttgctgcttttccagttcattgtggtacactgaactggtctagtaatgctccttattcattccata

SEQ ID NO: 1359 - DNA, 1070 bp, Homo sapiens
catattaacctgaagttgcagtttagacacatgttgttggggtgtctttctggtgcccaaactttcaggcacttttcaaatttaataaggaaccatgtaatggtagcagtacctccctaaagcattttgaggtaggggaggtatccattcataaaatgaatgtgggtgaagccgccctaaggattttcctttaatttctctggagtaatactgtaccatactggtctttgcttttagtaataaaacatcaaattaggtttggagggaactttgatcttcctaagaattaaagttgccaaattattctgattggtctttaatctcctttaagtctttgatatatattacttgttataaatggaacgcattagttgtctgccttttcctttccatcccttgccccacccatcccatctccaaccctagtcttccatttcctcccgccagtctccattgaatcaatggtgcaggacagaaagccagtcagactaatttccttctttcctcgcacttctccccactcgtcatcttttaactagtgtttcacaaggatcctctgaaaccctctctgtgccccaagtacagatgccattacttctgctttcgtatctcctcaggcaaaagtggagggtgccttatgggccctcctcataggttgtctctgcatacacgaacctaacccaaatttgctttggtgccagaaaaactgagctatgtttgaacaaagatgtcgtgcaaactgtactgtgaacaacagttggtttaaaatatgaggggcaaggaggaggatgcatttcaaaagcttgattgatgtgttcagagctaaattaagaggagttttcagatcaaaaactggttaccattttttgtcagagtgtctgatgcggccactcattcggctccccagaattcctagactgggttaatagggtcatattgtgaatgtctcactacaaaatgacttgagtccagtgaaatctcattagggtttaagaatatttcagggatccttaatgttttgatttttgttttctgaaattggattttattttattttatcttataatttc

SEQ ID NO: 1360 - DNA, 1216 bp, Homo sapiens
cccccacacaatgaacagcttgttgagaatttgcattttatgaaaatcatgttgaaagacaaaggggtctctctgtgctgcccagtccttcctccctggccgtttgggaactgtccccacccctgaggccaatctggttctgaaccttctcttccttgccttgggcagctttgggggagggttagcaaaggcacagaacagaaaggccctgggctgtgcaggctccaaagaaaagggctgctctgggactggacctcctcccaggaccaaaaagttagggagggtgagagactactttagtttatcaaggaccctgaagagacaggaaccttcatctctcatccttcctccacaccccccaccaccacccctaaagaactcccagtctcggtcctttagtgagacttgctgacaagtttgacatctaagatgttttgtcccagaaagcacaaaatatatggcaatggagagagagacccaggtatagctgggcacagctggtcacctgcagctgggatccacaactggtccttgaaacggcctgtaccttaggagacctggcacctctgaccccacattctggctgggattgccagcccttcgggacagggtccctgaccccagccctcccaagccactgtctgtagctgagaaattagatggagagacccaactggcagaaggtcctcggagcaccttgataggtgagcccaggggacacctatcctctgaatcccactggggaagagcccctgcctcagctttgggagtctggatggcctgagcctctacagacatgggccctaggggtggagaccattttagaataatgatctccccacctgctgccagtgtggaaaccagcaagggcttagaggttcatggatctggaacccaggaggatggttgtgtccctgcagtcccaggtatgaaggtaaggcctgtagagaaagttgaggagtggtgccagtagtggcacttggcaaatagttccaccagcaccaaaacaggtgtggatgtggagctgggaaggggcagacaggaagtgggtcgctgtgtccagggtaacctctcagtgtctgctcaaggacagtcccgccttacctgctccttctgaccatcttactgcccagggctcaggattccgctggaagaatctcagccagagtcctgaacagcagcggtgagtcaccaacacccagcccctgccatggtc

SEQ ID NO: 1361 - DNA, 1149 bp, Homo sapiens
tgaatctacagtaacagttttcaatcagttttgccccacaggggacttctggcaatgtttgaagacattgtagttgtcacaattggagggagtgctgctgacataagtagaatccaggggttaattctatagggaataggacagtccccatcaacaaagaattatgcagcccaaaatgcatgtcaagattgagaagactgattgatctagatgaacattaaatagatgataaatagattagctgcctaacagcacgttggtcacaaaggggacctaatttgtatatgtttcagggactcctggcccatacagaatttgagatagctaagcattaaaccaataggaaaaaacgggaggaaaagagccacctggggttgaattggagcatgtacttatggggcctgaggtaactgggatgacagtgtgacgtgaaagtgaaaaatagggtaaaatgggggttttctatgtgtgagaaatattgggcaaagtttttatgagataacttacggtttttgttttaatgtatctgtagacagggatgatcgttcttttggccgtgatagaaatcgggattctgacaaaacagatacagactggagggctcgtcctgctacagacagctttgatgactacccacctagaagaggtgatgatagctttggagacagtaagtttgtttttatgaagttagcttcctctgtgctttgggaggctatttagtaataggacaaatgtgttacagatgatcagatcacattaacagatagaaggaggaaagcagattaagaaaaattttggatagtatctgaaagaactgatagatgcaggaaacgaatttgataaattaataattttttttgaaaacttaaccaaacaaagggacagacatttctctttttttggagacaattgtttataaagaaacccaaactgggcatggtggctataatcccaacgctttgggaggtcaaggcaggtggattgcttaaggccaggagtttgagagcagcctgggcgacaaaacaagaccctgtctaccaaaaagaaaaagaaaaagctgacgtggtggtacgcacctgcagtcctagctgttcagcaagctgaggcaagaggactccttgagcccaggaggtctagactgggtgacag

SEQ ID NO: 1362 - DNA, 1235 bp, Homo sapiens
tggatatcccatctaggaatccggtggttcgtaatgggggcattacatccccaggggcatttgggaaatttgtgtcgttatcacattagtggttgtcactgatgggcatttagtgggctgtggccaggggtgttaggcagtatgcagtgttagggacagttttacacaatgaagagttgttccctgtccattacaaaagtgtttactattaaaagctggtattgtatctaaaaggctagagacctactataataagtaattgccctgaaaaactaggcctggtaatgagtggcttgtagaactgtgttgattagtaaagaagggcagtattgtagattatgtaggatactgttcttaaccatattagttgattcttgctgaagtatttagggccaaagtgtgtcttaatgtctgtagctttcaaatagtttgagggaaagataaatttatatgcatatacacatatagatgaagtaagtgatggttcttgaggggtcagcatgggtctaaggtggccttcactgagccaggcataatgtgtattttgtgaatctctcgtacagacacccaagctggcgaagtgaagaaactcaggaacgggaacggtcgaggacaggaagtgagtcatcacaaactgggacctccaccacatctagcagaagtaagtcagaccagggtgggtatcgtgttattgccgttttccataaactatccataaccaaattatgcagagaccctgcaatatttaaattcagtcatgaactctttatttgggttgcatgggccgattggagtttcatatcttctgctccaaagaatctgaggaatgggtaccagagtagacctagatgatctgcttaataatctaccactgaagtgtatacttggttgttaggtttgtctctctcttttttttttttttttttttttggtatattttcattttatgtcttgacatctttgaatgttgtttattcagaacagtcaacggcttggagtttcatgtgagctgtcccaagaccagccttttttgatgttatcatcaccagagcagtgttctcaagcagtgttattactggttgatcaagcacttttagtgttttggaaacctaaatggttcaattgtaatacctcccttcccttaccatgatgtgttttttttgtattttgttttgagacagggtcttactctgtcacacaggctggagtgcagtggcatgatgatggctcactgt

SEQ ID NO: 1363 - DNA, 1265 bp, Homo sapiens
ggtagatttagcctcaagttgttctagtctccaggaggctgccagcccctcctcttatttaattctgagttttgggggccagcctagagggaattccttttttttttttaaccccccaggggggtagttgggagtgagactataggccataaagaatgggactgcattggaccaaaataaatgggaaaatcgtggtttgaaaagaagcttttgggaagtgatgagtcattttgcaccaggtaataggggaaaattgtgtgacctccagcaaacacatgaatggttatttcctggagccggaagcacttgggggtcgtggtaattcccagtgttttctgtgtcctagttttaccctttctaaacactgtcctttttgaaagttttgaatatatccacattctattgaaaccttgaaactaaaaatttagactcttatcatcatcttaagttcttcatgctactcttaacctcccaaaaagcagtatctaagtcacatacatgatgtcttgggcattttctcagccatggagaactctgaaaggaagaatcgctgcttttctcaagcaaatcggtttcttgatgtcttttggttctccttgcctgctcctgatgcttggaccccttttattgatcagagtgctctagaataatggatggtcttggatgatggataaatagggacagggacagttaaattgggagcctttcttacaaccttgatgggatttttccccccaagtttccttctccactgaaatgccacactaatgcttgttggattcatgaggtggccagaccaatgtgttgttttgttgttgtttttttaagcttcccttgagagaataaatggtaatggagagaactatttaacaaggtcctggtttctcttgcaacacagtagctaaacttgcctgcttttatatgcatttttgtagggatcagcttggtagacagtattagcggagaaacaccttgatcttggtttgcaagcccttctcccatcagtcctagattaggccctgttcagccatgcaggggtgttggtttatgcgtgctgcagcagtgggcataatgaatataatttacccagtggacaaaggtgtgtaccaagtgaatttaaataattggtgtggattggccagtagctaagaagtgggcttttaaagagtattgaagattgaaagggtttttctttcttttttaaaaaagaaaaacaaactattgattgtagataatgaaaagctagggtttgccctcttcatgtc

SEQ ID NO: 1364 - DNA, 1356 bp, Homo sapiens
gtccccagacatcctctcaccttcactggtctcacactccccacccagacccagcaaggaggtgcccaagcagtgagctcggtgaggggtggggtggtcaggatccactgtggctgtgagtccctcccatcctgtggcactcgcacctcggaagggaagcagggatgggatccctatgagccagtcccgaggggaaaagtagctcacttgaggagggctgggaaggcatcactagaccctcttggaccctcaccctcctcccgcctgtaacattccagagcctgtcaacctctcccccagccgggccccctctctctccgaagtcttgggtttgtttggagaaacccctccacccacacccccctttctggaaatagctgtggttggaagggaggctgggagcccggccgccgcggaggaggggtaaggcccagggaaggagcgagggagggcggcggctctgggggtgttcccagaagggtctggaggatgggggcagactggagggggccgcagagcggggctggcgagtcgaatcagcctcatctgtgcccgcttacggcctctgtcccacatgtgaagcaggaaaggaaaacgttcgcccgcaccctgccaggccggggcccgagcgccgctgccagctgctgccgggtcccgggcctgcgtgtgtggcacggcgtgcggccccgtgcgccccgggtgctggaaggcgtggcggcctgatcgagtagggccgcggccgcgccccgccccctagtcactgtcccggcctcccgctgctcccagctctccgcggccagccagagcccccggccccagccctgggccgcgccccgcgccccgcgccctctcgacctccggcggccccgcgccccctggcgcccgcccctggcactgcccgcgcggccgtgacgcagagaccgccgcccgcccagcgcggcgcggccactcacctgcggggggcgcccggccgggcgggggcgcggcggggcggggcagcagcagggggagccgccgggccagcccatcccgcccgtgcccgcgccgagcggacgcggaggaggaggcggtggcagtggcgggagcgggcggccgggctcggctgggctccctcccgcccccgccgcgccccgcgcccgcgcccgcgcccgtggcagcccgctcctcctcctcctccctcccggctccaatccccacgttccgccagctccccacccctcggcctcctctcctccccaccttctcccgcgaacccacactcacaaagagccgaggggagagagggtgcgcagacggccagccgggccgcgccagggacatactggagacaggaagtggctgagagggggagagagt

SEQ ID NO: 1365 - DNA, 1128 bp, Homo sapiens
ggatatggcaatgatggcaccaaagtgccatgcacccttgaacatggattccaaactgttccacagattacatgctatgtttagatacattcgtggaaaaaggcattccacagctaaataagtgggaaatgctgagttaatcaaggttagatgtttttatttcctgtaggactctcgtgtccttcagtatgcggatgtgccttgcaaatctccaaaagggagatctagtgtacagtgtttccctaagaatgttttcccacaggattcttttattgaggaatgcagtttgggaaatcctgtcccaaggcacaaggagagttgggattagagagaagtgtagagggttttccccagggagcctttaagtcagcttaagggagtgaatgccttttggaggcagggaaggactcaggtagcttggcctgggaaagaggcaaagagaaagactctccaggaaaacaaaggattcctctgattggttctcctctcctctctcaacaaggtgtgccctgttcctggtgctgaagggcgagctggagctggcccgcaatgacattgatctctgtcagtcggacctgcagcaggttctgttcttgcttgagtcttgcacaggtgagcagccatgtccccatgaccataggcggtgctgaaatgacacacactacagcacatctttctatgtaaaggtttcgttgcctttttttatttttgagacagagtctcactttattacccaggctggagtgcagtggcgtgatcttggctcactgcaacccctgcctcctgcctcctaggttcaggtgattctcctgcttcagcctcccaagtagctgggactacaggcatgcgccaccacacccggataattttttttatttgtagtagagatgaggtttcactatgttggccaggctggtctcgaactcctgacctcaggtgatccacccgcctcggcctcctaaagtgctgggattacaggcatgagccaccgctcccggcctttgttccctttttaatcagatactgacttctggtcccagggcaacattcccttgactttagtccaaccattggtctccctctttcagagagcctgtcccagacttaccctagttctagttttcagtg

SEQ ID NO: 1366 - DNA, 1200 bp, Homo sapiens
ctaaatctggagaaatgaagtcccctcacctgactgccatttcattctatctgaccttccagtctaggttaggagaatagggggtggaggggattaatctgatacaggtatatttaaagcaactctgcatgtgtgccagaagtccatggtacccattaacaggcataatattggcactggtgctagtgagcatcaggtgagatacaatttggaacacaacaggaaaggggtagaagtacagaaggacttgtttagacattggtcctttttgaggataccacactcccttgcccttgcttccatcccccatccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggtttggatgcatctgctcagactacttctcatgaactcaccattccaaacgatgtaagtgtagttaggttgcatgggatgaaaataagaaaatagactgtaaagaaatagatgtcgtttcagcagtgtcctgctaccctttttttttttttttttttaaacagcccaggctgtagtgcagtggtgcgatcttggctcaccgcagcctccgcctcccgggttcaaccaattctcctgcctcaacctcctgagtagctgggattacaggcatgtgccaccatgcctggctaattttgtatttttagtagagatggagtttctccatgttggtcaggctggtctcaaactcccgagctcaggtgatccactcaccttggcctcccaaagtgctgggattacaggtctgagtcaccgcacttggcctacatgtcctgctacttttaagccctagggaaagaaactgggaattttattattttatctttatttttgtttttgtttttcataccccaggaatggaaaatgggaatttttagacacaaaaataagttgattataatatacagaattgtgatgacaaatatgataagagaaaatagactattattgtgtgaggtatgacgagacagcagtaac

SEQ ID NO: 1367 - DNA, 1198 bp, Homo sapiens
attgatagaactccagggctttaaagtaaaggccttgagttgtctcagcattaaacccttgagactactctcagatgactctttctttcctaaactggtattctgtcagcagtttgggaggagccaaagtgagctcagcaataaagaaacattgcttctgtgtattgtgagcactctttagaggggcctgtttccagaaagtacactccttggttagcccaccatggaggtggaactaaaagagaacatagtttgagggacattggataacaagggctgtttcccttggttctgaggtaatagacctccacatgcttgaattgcaaggattaaaggatcatggtactggtaaatttaagaaaccttaaaatgtctcccttggtactccagcactggttatttactcttcacatttcatgaaccaggtagagatgaggtgcagctgagcactggggaaactaactgagttcttgtttctgtgttacaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggg

SEQ ID NO: 1368 - DNA, 1175 bp, Homo sapiens
catgcatcttgctaatggacagaccatgcctgtgttgccagggcctccagtacagatgccgtctgttatatcggtgagctctgtagttggggcagccaaccctaccaacatggtaatccttcccttccacctgaatggtcataaaatacacatgagccccagggaaatgtgggctctgatctatattagctgagcatggcagcctgcctaaactcttcactaacctctgccaatccagcactatggaacactagataaagactcatctggacaattggctcctggtctaggaattgatcttgccagcccactgattagttgctttcacttggcacgtagcacctcccaaattgcccaacaatttcctcaagataacagccccaacccttcccacagaaattgccccaacactgaaggattaaattccctactctggtgctccatggagaaaggtatttcccaggctgtccctgcacgccctatgggcacattgcacacaacaggccctgatgtgccaatctcaaaagcgcttcattttagggaaactgttgccccaccgatggtattatgttcccttctctttttttttttttccttctctcgatccagctggccagacctgtgtccatggtgcccaacattcctggtatccctggcccaccagttaacagtagtggctccatttctccctctggccaccctataccatcagaagccaagatggtgagtacatcccagtctggggcaatgttggcctttctgaaagaagtgggtgataccagcctaggtctttcaagtgagccaagcaaaggaaccttctggggcttgcaaagctaaggactccctgctgtggggtctggaaaagaaaagactccaattcatagctcccatctcctctccccacctttagagcctggtacatagaccatggcagtgaaaagaggcagcacagattgtttggaatggaacacttgccgttttagggtgacagatggagggtgggcgagtgggcaggggagctggccaagaggtgaatagctgcgtaaccagcatttggccaggctccaggagagagctttcatctggacactattgctttaacaacccccagcccccaactgtgcccaggatgatagccagggaacagagtaggcattttagggatccaggtgcac

SEQ ID NO: 1369 - DNA, 1177 bp, Homo sapiens
aaataaggggcaggtagcatcaggaactctcttgttctggctttcccttttataaggagacaaaagccttacatcagaagtgccatcctccacccccaccacggtggatttcattgtcttattggcctgaactgtgtgacaggtttaataccagctgcataggaaaaaggaatatcttgcttttcagcctttatagtgaggcaagcaagagaaaatggttgaaaaatgggggttgggttaagaaaccaataatgtcttcctcaaacctattgccccttccctttcactgccttactctcccttctcctgagcaatccagttatacaaggcattaattgacaacagtcttctcaggactgatagtttatagtttatagctgatatactttggctgtatcctctcctaaatctcaccttgaattgtaataatccccatgtattgtgggagggacctaatgggaagtaattgaatcatgaggggcaggtttttcccatgctgctctcattgatagtgaataaatctcactagatctgatggttttataaaggggagttcccctgcacatgctcttcttgcctactgccatgtaagatgtgactctgcttctcctttgcctcccgccatgattgtgagacctccccagccatgtggaactgtgagtccataaaacctctttcctttataaattacccagtcttgggtatgtcgttattagcagcgagagaacaggctgatacaatagccttattgaaaaaagtcataagagagtactattaaaaagagaagggggccaggcacaggggctcacacctgtaatcccagcactttgggaagctgaggcaggtggatcacttgaggttaggagtttgagaccagcctggccaatatggtgaaaccccatctctactaaaactataaaaattatccgggtgtggtagcacacacctgtaatcccagctactcaggaggccgaagtacgagaatcacttgaacctgggaggcagaggttgcagttagccaatatcatgccactatactccagtctgggtgatgaagtaagactctgccccctgcccccctcccccccgcccccgcccagaaaaagagagtgtgagagaagaaagagcaaagaattatactttctgcttgactatggtgtttaggaatcacatagca

SEQ ID NO: 1370 - DNA, 1253 bp, Homo sapiens
aggggagaccaagccgttaaaatttccccactacttttgtaccattgcagtttggcttttagatgtttactatattggagttctgcttaaagtttgaaaacactgctctagatagacccttccatcctatttgggccctggatattaagtgtctgggccaagaggtcttaatttgtggtaatgagatgggtgaaccattagtgaaggtcatgattatacctgggccatgttacaggattttagattgcctgctcccccttcattcagttcctgtagagcctttggggaatcagggcaagaatttgggcatgatggtgttaccctaaaagcttctttattatgtgagataatcttgaagagggggattctccctgagcccatcttagatatttatccttttctttgtgtgaactagaaattcagtcttttctcttctccttctaccaggaacccttctctgaagcaacagctcttctcctacgccattctgggctttgccctctcggaggccatggggctcttttgtctgatggtagcctttctcatcctctttgccatgtgaaggagccgtctccacctcccatagttctcccgcgtctggttggccccgtgtgttccttttcctatacctccccaggcagcctggggaacgtggttggctcagggtttgacagagaaaagacaaataaatactgtattaataagatgtttcttgagtctcctgtgtatatttcttttccacagttggctgagtgccttcgtgagagtacaaggcccgaagggtagtgatggtgctaaactcaacatggatttggctgagctcactttttcttaattctgtttcaggaaagctttatttgaaatagcataacattttaaattattttcacctggcatggcctgctacttgcctgggaagattggggtcagtagcaacttcaagttctggcttaaaatgttggctaataggctttctgtttccactgtcactctcctggctcaggcccttattgtcatccacctcgtctattgcaagaacctcttaactggccttctgcctccagtctcttccctccagcatttacttctccttaccactgccaggtgaatcctccttaagcataagactggttttatcagttaatggttcaaaaagtcacctcaactttctctgctttatctgtttagtcctatacactacataaagtgactgtcatttttcagatgttttcctgtctttaccatatcttcct

SEQ ID NO: 1371 - DNA, 1212 bp, Homo sapiens
aggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatc

SEQ ID NO: 1372 - DNA, 1173 bp, Homo sapiens
gggatgcctggcttatagggacattacgaggatttaaaatgaaagctgcaggccaggcgtggtggtgcatgcctgtagtcccagctactcacaaggctgaggcaggagaatctcttgaacccgggaggcagaggttgcaacaagccaagatcgcgccactgcactccagcctgggcgatggagcaagactctgtctcaagataaaataaaataaaaagtgttaccacagtgtctggtacatggtacgcactcactacatggtaactagcattattatgattatgatagaggggcagtgggtttgggaaagaaaggaaggagagggacaggcagaaaggagggagaagagtatggcctgtgggaggtggagaagagaagaaacagtatatggaacaccgagcaaggggctggggccaaggacagtggattattggggtcctgggtccattcttcttcccacagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacaggtgagaaaagagcaacagagttattcccagacaagggagtgggagacagcattgcaagaggacccttcccaccttaccctcccctcatctgtggcgccaactaaagacctcgttgaaagttagacaaagtcctgcctccaggagagtctcagtctaacatagacatacacgaacatgtaaggcaggaaaggagaccacccacaggccagtgtaactcaggatttcataagaacttttgcagccttccttctccatgcactgcatcctgccctatgccctagaggaagatcaaagggtggagagaggctactccagggaacattcagagaaaggggagcacaggacctgcttctaggacgagtggggagtgagagcagataggcaaggccccagacctgtactgtccaataccaaaggctcttaactatatatggctcttgagcacttcaaatgcaattaatccaaactgagatgtactataagggtaaaatatactccagattttgaagacttagtattt

SEQ ID NO: 1373 - DNA, 1546 bp, Homo sapiens
tttgaagcagactcagactgtctcaggatcaaagcaaccctcaatggttttgatttatgtcattgcttaccactccccaaccaatcccaggacagctgggtcactgtacccctttgtggtatctgtacctgggcctctccttcctcatagggaccagctgattgaataaatgtgaccaccttatttccaccccccacccccaaaagctacattggaattatttttcctagaaatgtgtataacactcagaattgggcattgatccttaaagcttcatcccattcaccgtattcaacatctgtcatctcttagtgtctgcagtctgaacctaaccttgaccttttttccctctggtttgagaaaactttggacactatttctacttggccaggtgtgggctcaagagccttactctttccatctcagtttaggggcgcagccagctcctcttcccaatagggctctttctgctttccctctccttggccctagatttgtaatccatgaaaaagcacaaggtcctggctccttgcggtcacattctggttctctgtgttttgtggactctgctctcactgttcacccagcactagcagtaccagatggttctgtggagtcctggggaatggagagagcacagtctgactccctgccaagtagccaggagttgacttgcccatggtccgctggctttcccaccacttcctacaggatgggatctaagagactcaagagctgggtttctttcagcactctgtactgtcccaaatagcaaacaaatcactttgtagccagatttctgaatggaaatgagaaattgaattctccatggacttttaggtttatgggggagttttagctgtgtttcttggttttatttcagccaaacatgtctgcttttgattttttttttaaagtataagtggtctatatatatgttcaccttttaaatgtaaatgtttaaaaagtaagcatttatgtgtttccataactgacatctgatgcagacctcattctctccccctcttctaccctcctcttttcccccttttcatactcttgtattggttctaataaatggttgcttttcaaatatggattctgagtggtggtttaaagatctgggtcttatgccccttctttaatttgggccctggagtgtcagctcaatttctgaaagagcaacaagacttggagaacatgggcttcttttctaaggattattggtctctgactttctgcaaataaccacaggttggcgcaagcctgaggaaataagataatgcgtatcctgtttcctactcttatttccttaactggttcagtgtgtacctttcctggtttccatgctcttctctgctcctaatggttcagagaataaatattaggcttcagcaacctagggatccctggaagagtcatctcatggctattagaacttatggaataccacatcaagcaaatgcagtctaaatcaggtttgaaaatatgtgaatttgtaaactttgtattttatctttctgatttgcttcacaaataccaaaga

SEQ ID NO: 1374 - DNA, 1546 bp, Homo sapiens; identical to SEQ ID NO: 1373

SEQ ID NO: 1375 - DNA, 1462 bp, Homo sapiens
agacagggttcaccatcttggccgtgctggtcttgaactcctgaccttgtgatccgcctgcctcggccactcaaagtgctgggattgcaggcgtgagccagcacccggccacagtatctttattacagctcactgcagcctcaatctcctgggctcaaatgatcctcctgcctcagcctcccaagcagctgggactacaggcgcacaccacggtgtctggctaattttattatttaaaaaatgttttgtagagacagtctccctgtgttgcccaggctggtctccaactcgtgagctcaagtgatccacgtgcctcagcctcccaaagtgctgggattacaagcataagccaccgcacccggcccctagtgaacattttactgtatgtgttgataaatcatcttttgagtttctgttgtatgtggggacttcctacactggctgctgtgaagaggtatggaagaaaggagaggctttctgcctagaaattctttgagaacacctgaaaagacagtttaatcatgtcacaacactcttaaggctcaagtcagtgttctggtttccggtagctttaggattggattctaaacgagggctggtggtgagtttggtgtttgtctcgtgtcaccctcacccctcacctcctcagtttaggataagagacataatgatttctaccagaatccaaagtaaatccaaagggggagaaaagacataactgttttttcttctaccttttttttgttaaagagttacatctctcacaggaggaaagaattcaagagtctatatgattagttacagagaatattttcatcccctctccctgaatagaaaagcaggggtcaccatttgtatccttacccttgaggtgtttttgaagatgctgtaactcttgaagttgagctgaggcagaaaggttggaaaaatgcagccctctgggtattgtggggagggatgtgatgtagtaagagggtgttttgtggtgctaggattcccacgccaccaacttgcagctttataagagcgctaccaagaaccaccactggggaaaaggttcttattcattgtttctgttggaatgtgatcttgctttctggattttaggaattcaggttactcagtataaaactctgagaaatcagtgtgacttagtccttcacctcctaagataaagtgaatatttctttacaaaataattcatgtccttaatgttaaagatgtaattttattttcaaaacatctataacatgactttcagaagcagttcatttttccaagattcctcacattatactagataaataataggccctcagttaatacccttcagttattgaattaatctagtttgtggaatgaggtgtatcctgccaacttccctctgctcccaagtacactctgagaggtaaaatgctctgggaaatggaacaagaatcgagtggatgctgactctgtgtgc

SEQ ID NO: 1376 - DNA, 1093 bp, Homo sapiens
attgaattctgtgtgcttatataaattatgtcaaaaattatactgcataattgaggtgacagctgttgctgcagtgacatgacagactggaacaatgaagcttttggtttaagtcagccaggaaaatccttctgaatggtaatgtgattgggcaagagctcataaaccatacctcaagtgggtgggagttttatctctatattccttctctctctgaaggaattaaaggcctagatcaagtgctggataattgacaattgcttgtacttaatctgatcggtatctaaaagaaggaaaggatggtcaggaaacatttatcataaatgtagccaaggatatcaattagggtagacaagaataggacaaaaataggccagagctcctgaggaggtgatatgggtctcttgatttgcagaaaatgacagcctatccaagtggcccagtgtatgcctcccagtagcagtgggcatgtaaactgcagcgaccttatttttaaaaccaaaaacctagtatgtggacaaagaacatgacaatatttggtactgagattggttctgagaaacctggggcatgtggctgctgtggttataggtaatatttaagacattcataaaaatctgatattcttttaccgaaataaccccagtatcatctactacttaccatctgttaatagactttactctgtcttttttgtcttcggtttattgtactgagtgccgccaaaacaacttttgttctcttcctgcctacctgcagctggttctataggaatgtagggagccagaggccagtattgatttcagcccttagcacaaaggaaatcagatgcctgcttccagcatttgttagtgttgagtagatgttcttgccctagaagaattacagcctcaaacagaaacctgtttcatggagctttctcccctcagaagagttaatagttaagagctaagcactcttaaacacctaagtctcaaatgctaaaaatttatttttcttgtgtttagtcctctttcaagacatctttctaagcctttcagtaatcaacattaaaagatctccctttcttcagagttatagcacagctttgccc

SEQ ID NO: 1377 - DNA, 1204 bp, Homo sapiens
ggtggctatggcggttccagcagcagcagtagctatggcagtggcagaagattttaattaggtaagtaagcacctttttgtgtgttgacataattttttaaattgctgatgaacccaataaccctaatgtagctgagcagtgcaacatagttaacattataattgcagtaattgtggatataaagttaatattcagatcagcaaaatttgtgggaaacaaacttgatattggattgtagccttgagtcttaatatgtttagattaacaactttattccatattgttcaacaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaatgaaatgacaactgtatggatttgggactggcagagatttggactttccctacccactccccctgataataatgttgaatgcttctatcacaattcaagttcaaagctctgccagggaatagaaactagctgctggctaatgccgctccataaatccgcagatttgaagtgtctgggaggccttttaaaaataactaatatcagaaagcatttt

SEQ ID NO: 1378 - DNA, 1204 bp, Homo sapiens; identical to SEQ ID NO: 1377

SEQ ID NO: 1379 - DNA, 1501 bp, Homo sapiens
cacattatttgtactgtgaatataaatttttgcccttttatttatcttcctttgacccatttccttaaaataatggctcaaagtaatagacttccccaaatggtggggggatgggtgggttattaatgggaggtatggggggtttagcttgagatgggacttggtcttagagctagttctaaaggttgtttacttttctagggaggagtctgctactagtcttatcagctcttaaaaacagaaactcatctgtccaagttcgtggcagaaaggtaagtttttacaaattagtgctcagcaaaagaatgccctgcgttcccaaagtaaaagaatgacaagctgtaccttaaaccaaaacacttcgtaatctcatccaattgcaaaaagagttattagccaaccaggtattcccagtagtgacagtggatataactgtgtagtcattcacctctgcttatatgaatactttacaacctcttttgccttttgcaggaacgtccttgtgaagacctttatctgagccactgtacttcgttatcactgccatgcagtttacatgagctgttctgcagctcaaattccattttgtgaatgggtttttttttttaataaactgtatttaacttagttctgcttgttttgtcctcctttgtgatatctatggttaataacatgttgaaattcaggttagagaggatatggttgattctaatgtgaatttctatatttagattcatcccattcagcttcatggtttaatgaaaatagaaatgggttctcactacaggagtaattcttggctcactataagtaaactttactattgatccaattgagcatgtcctttttctagctcccctggcaagggaaaatcaagttgtagcactgccattgagctcagtatgtctctattgggacttacgctcaccatctgttgcagaaggacataatggatttcatctttggcaaacaagttgggcttattggccagctgtctcatacttcagtagaattctcaagccaggagtaagaaagtgaactgaatgagaggcaagacttagcctctcaaagatagcctaaaaatgtaaggactattttggaagcaataattgtaccctctagcaaatgcttaggttcttgcgtgtgtgtgtgtgtgtgacgaagtgtccctctgtcacccagactggagtgcagtgacactctgctcactgcaacctctgcctcccaggttcaagcaattctgcctcaacctcccgtgtaggtgggactagaggtgcctggctaattgtatttttagtagagacacagcgtttcaccgtattgcccaggctggtcttgaactcctggccttaggtaataaacgcccaccttggccttccaaagtgctgggattagaggtgtgagccaccgtgcctggccactaaactgtttctgttattttcaaggaaagtttatccagcctcagttttgagcctaacaaaagtggaggtaggattcttgg

SEQ ID NO: 1380 - DNA, 1207 bp, Homo sapiens
ttataccaggtatacctcttctctcttcatcccctcagtgggtttgaatttttttggaattttccaaacaatctgctagggccttagagagcttcttcccatctctttacccttggggattttctattctccattcttctaaggacagggaagacaagtgaggggaaggagatccccagccctcatccttaccctgccctgtcagcaagctttcctcaatgctgctcttatctctgcaggtgctgcagtcagccaaagaacagatcaagtggtcactccttcggtgaagacctcactgttcctggctcttcatcctcttcaaaaaatttgcatgtctgctgtgaattttcatctagttccccaatcgatgctctcagggtcatctcggggatcacagggatccttaaatctccattctgtttgtggttgccccctcaacctcccctacacccttcctattctttttcattcttcttgcagttctgggagtaaagctcccagcatatttagataatagggcaggggaagcaccctctttctttctagactggattatgctcacatgctcccttgccctgacatttttgtaaattctgtgccctttgctgtagctacacttcagattaaagtaggagaaagaatgtgctgagtgttttcctccctttgcctctacctggccctcatcccaacagcccagcaaggggagagagaaagagaattcttttctatagaacgagtgggggcggggatgggtagggatttatccaatctaagccctaaccccacttagtgacctcagtgttttcttccattccttcttactgccctgtcctctgccttggaagaggctttgggaatagttcatagggaagggacaacatggaagaaacagcgatttaaattgtattgaacagggcatataaaatgcattctgtaccctgatctggcatatagcttcaaaactgcagtggcgagtgtccatctcttagttagctaccttaactgtccacccttactacctgtgggatcgttgcctggtttgtcttctctgtgtcctggagcaaagccagttcctaaaactaaaactccattctagtcttgggaagaaaagtttctactcagaactggggaaggagtggaacttatgacttgggcctctaggctgtctctgtcccctcagctccccgacatgcatttactctctgcc

SEQ ID NO: 1381 - DNA, 1154 bp, Homo sapiens
caggtcaattagagagagtatagagaccccagagtcccctgggtctggaaagcgttaggagaggtcaagaaaggagcagtaaggaggctgaaggttacagggcatttgaatccaaatcactgctctgggctagggaatagagccagcagaccaaggtgggaaggattctggaagggggacattttagtctcctaaccccaaagctcagggtggaagaggggagaacaaggaagcagagtgtataattattttttccttttatttttggaatctaacagtacctggcagcagggaggggaaagtacagtggggaaaagcatctgacaaggccagttagaacagaggatgggaaggatggagactcccgggcttggaaggctaggaagcaggcagagactggttgccatttcaagtcactagctaggcccattcattcctcccacaaccctgacccattctcctctggactcactgtgcctcagtttcttcccctcaatggaatgagaaatgacagcacccgccacagccaagagatgaattctgagcacttaccacgggcactttatggacataaaatacctctcgctgtgggacagataaccagggcaccagagtagtggtgaagagatgtgaggcttaagaggagtcacaggcttcagagtacaagttcccctctgcctcccagctggacagtgcctagaagccaaggagttgagaatctcctgatccacaccctatccttacttcaccaccaggcctcttggctccaggcaagagcttagaggatgtcaggagaggtgggggtaagaatcttcagcaaaactgtcactctaagtagagccagcagttacgggtctgataaaaacagtactgaactaaagtaaagcccaagctggtgagcaaaactggatggctcattcttcccaagagcatgactctcccccttggccagttggtggaaggggcaaaggtatgtgaccacccttgagaaggtgatgttggtgagctttaacatcttattcctattcttatagtgagaaagtgaaacaagatctttcagtagaggaatgggcagggctgttaggctcttcagcttgccttcacccatatagcagctatgctaaccccaagcctctctggccctgttcttcatc

SEQ ID NO: 1382 - DNA, 1177 bp, Homo sapiens
cacagtacccaagggagaagccaaacctaagcggcggaagaaagtgaggaggcccttccaacgttgatgccccttctctttcctcaaatcaatgtcagggagtcaaaagggctgtagcacaggatggagtttgatttatccctcctcccccaacacctaggaactgaatctttttctttttattttttgagatggagtcttgctctgttgcccagctggagtgcagtggtgtgatctcagcttactgcaacctctgtctcccgggttcaagcaattctcccatctcagcctcctgagtagctgggattacaggcacacaccaccacacctggcccagctaattcttttttgtatttttagtagagacggggtttcaccatgttgcccaggctggtctcgaactcctgagctcaggtgatccacccgtcttggcctcccaaagtgctggattacaggcataagccactgtgcccggcctgaatcttgtcttttgacaataccaaagaaatagggggtagctagagtaaagaacctagggcctggacctgggctggacagtgtatccctttaggtgtgggaactgggtatttccctggggtctgtatgcctttgtcttgtcatttgcttttagggcagatgacactttttcccacccttttaaagctacaagtctatcttctttcttgacccatttcaggagggagccctctcctttatcctgatataatatttaaaagagaacaagaaagcatgtagccctaatgataggagattatcgcatagagttcagagactggaaactgaattttccctcgactttcactttgtgggtaaatcacccaattttaggctcttttctgcaaggatggccaaaattaatcatttttaaaaagtagattcatgcccactgcccttgggtgagggggaagaatacgggggttcccagaagcccccatgtgatccaagggtttgtattttttttttaagtttgttcatatttgtatgtacatgactatttaaagccaggggattatctttctataaatgtataactggcaacctgtatcttccctctttgttgcccatatagccggagccctttttctcatttgagaatctcttccctactaagtgttaagcttagagtgaagggcacctcctactggaccaaaggaga

SEQ ID NO: 1383 - DNA, 1178 bp, Homo sapiens
tctccctgatggagccacccttcgctaccttctcccgtgatggtgatagaaattgaggggtctaaggtgggaaaaggcaaacaggaaagtatctagtggcttttctccgaagccctttgacaagtgaataaaacccactattccttctggctagagaagaatttgcagcctggctggccgagatgctgaagtgtctgctgtgtatgtaaggtgtatgtgttggaaacggagaatcacagcttttatcatggttttgtcccttcctaatggcctcatctttaggaaaatatgcatagtagtaatagctactcaatgatgatcaaataatatatgtaaaagcaatttataaaatactgtgcaagtgcaaagtgtttctgtttttgtagccctcatatgtgtagtctgtagtctgtagaagcaacagtgtgcctgtgccttggtacacacggtgttttaaaatgtgccattttgcttcttgctctgctgctttccatgttccttacacctcagcccacctattttatggtatctgatgacaacccaggttgctgctacttctccccaacctcacaatttaaagtggtactacctctttccttctgttctctacccagtagctccttcatgaattaccaacttttaatgtgtgttttgaaaatactacttatccagtatacttctctttactcttaatcattttctttaccctgactccgtgaaaatccaggtatcacatcttaccttaccttgtcactaaaagctgttttctgttttccgtgactatgtggaagagaaaaaggaataaactgcttttttgttttcctttactatgtccagatcattgatctaccactgtcactctaatcctcatggaaggtattgccatgcaattatagcagtttctgtaaaactttagtgtcatcatttactgcccacagggacccagacctattgcatcatatttttttctctcctttttttcttgctatcattttcagtgtctccagcaccattggaatattctgatttcatagttcctcagcatgagacggtcgactttcctttgtattttcaaaccagttgcacatcagaatcactacaacctggatctcatctaggacaccgctttttcttcagctgctccccatcactttagcctccttaccagtcacctattt

SEQ ID NO: 1384 - DNA, 1220 bp, Homo sapiens
atcctgtctcaaaaaagaaaaaaagaaagaaagaaagaaaagaaagaaagaaagaaagaaagaaagaaagaaagaaagaaagaaagaaagaaagaaagaaaagaaggcaaaccagtaaaacaagaatttctgtacagtccgcgcctatccatagcaaaatggaggacttctccagggaactgcaactcccaagaagcaatgcgagggaaggtggcggtcactattttttccccgtctgcacctctaggtccaatattggaaataggtgctgacgtttaaataacacagcgtcctcatactaaatctgggggggaactggtaactcgaaaaccaaatactcggtcttccgaaagaactaactcaacctacccttctacaagagggtccgaaaaccactgttacgcccattgggtagccccgcccttggggggggcaaagggcgtgaaagcggaagtgacgacacccggcgctccattaaatagccgtagacggaacttcgcctttctctcggccttagcgccatttttttgggtgagtgttttttggttcctgcgttgggattccgtgtacaatccatagacatctgacctcggcacttagcatcatcacagcaaactaactgtagcctttctctctttccctgtagaaacctctgcgccatgagagccaaggtgagcggttcctggtagtaagcttgggaggtaggagttggcgagtagtagcgaggagacgaaggcaagtccgccatacctcctgaactactgggtttcaagggtgcccaagagctggtgggagagagaaggtagtttgtgagagagctagcggttaagtgctatgggtagagagggtgggcttagaaaagggtggaattctgatcttatgttgggagggtgtccaagttactgatgtagttgttacgaccaatctttcatacttcttggttaagaatctgtccggttctaaagagtgcatttcatatccttgctaagcctactaataagcttcatcccttttttttttttttttttttaattatctgctgcttgtgatcggttgctagtggaggaagaagcgaatgcgcaggtacgttgagactttgccagcccaggaggagggaagttccttggacaaaacttaggagaaacatttggtttggaaatcttaaaagatctttaggagaaaaacgtttgagtgttttctccctggagccaggatttaac

SEQ ID NO: 1385 - DNA, 1205 bp, Homo sapiens
gaagcaaaaaattggattttaattgagtcttgaaggatgagtaggatttaaataggccgagggaagagaatgaggactttccaaatagtgggagcagaatgaacaaaggtggaaggggccatggattgggcagaggactataaaagatggctctggccgaggtgggcggattgcctgagctcaggagtttgagaccagcctggggaacaccatgaaaccctgtctctactaaaaaatacaaaaatttagctgggcgtgacggcatgcgcctgtagtcccagctatttgggaggctgaggtaggagaatgggttgaacccaggaggtcgaagttgcagtgagccaagatggcgccattgcactccagcatgggcgacagagtgagactctgtctcaaaaaaaaaaaaaaaaaaaagatggccctgagtggagcaggaggtttgtgattggtacagagaggaatgaagttggagccatgttatcattttcacagtatgcctccctttcccctaatcccttcactacagtccttcctcctgtgcctgtaggtgaaggatgattccagggccctgactttaggagcactgacgctgcctctggcccgcctgctgactgccccagaactcatcctggaccagtggttccagctcagcagctctggtccaaactccagactctatatgaaactagtcatgagggtatggaaatagaggaggtactgaggtgtgggggaaaggcctgttgattctttggtattaagagtaaggaaagggacccccctaagattaaaagagctaatacatgtagaagtgccaagcaggcacaaaaacatatattgatctgactggtggaaggaatggcttatgagttgagggggtgtggagggaaccctgtagagatgagcccagccagggcagcacctagttcccctgtcacagcccctcctctaccccaccccacatgctttgcctgctggtgacgagctgcacttctttgattcagcatcatactacccttcctagatcctgtacttggattcatcagaaatatgcttccccacggtgcctggttgtcctggtgcttgggacgtggacagtgagaatccccagagaggcagcagtgtggatgccccacctcgaccctgtcacacgactcctgatagccagtttgggactgaggtgagtctatatctggaaaggactaggg

SEQ ID NO: 1386 - DNA, 1216 bp, Homo sapiens
tctagaatgggccctgaggttttacttatgcggccctgggtgctggtgtctgggaactctcaccagcctgtataccagtcttgctttagggtgaccttctggccctggagcatgggtagctggcatagaggggtatgggttgcctgccccattctgctgctatagctgaacagtcctttccccttccctcgctgggcagcttggaggtaccctaacccaaaactctgtcctctcctcccgccagtggctgacagtagctgtaggtgtagtggagaacttttctgcctctgctgtgttcttgctgcttaggtttgggtgggggactaacagctgctgggaggggagctaggggcatggagaactggtcagactcaaggtggctcctctgcaaactgaccccagggttggttgctgtgggcatgttcccgcttatgctacctttgcagtctggtagtcccctggcccttggcgtacccctccacagccctgttccctggctcatcccacctttcctttccacagagctcgtccgcatggtgctgaatggctgaggaccttcccagtctccccagagtccgtgcctttccctgtgtgaattttgtatctagcctaaagtttccctaggctttcttgtctcagcaactttcccatcttgtctctcttggatgatgtttgccgtcagcattcaccaaataaacttgctctctgggccctcggttcggttctttctttcctgaacagggtaaaggggaagaaggtgagatggtgatgatttctgccctgaggcagagtccaaggtcaatcaatggtgcaggggttgaggaaagctgggggaggccctgtactagccatctgggcttcatttaaaaactactggccccattcatccatcttacacaagctacctcttgggagattaggaaagccatagatcccagtaggactaaggctggccatccctgttccattccatatcaggctgtcttctcctacccttccagctccttaaatctggcccccgccctcccaagctcccaataaggccttttgtggggaagcctgtggagtgtttattggagctaaagccaggccattattagcactgcctaagcctgtccgtcacctcagcagggtgaagggccaattataacaaaagtaggtaaggggcttgcctcctctctaataagggaaggagtgaaaccactacttctgaagg

SEQ ID NO: 1387 - DNA, 1175 bp, Homo sapiens
taaaatggctaggtgcagtggctcatgcctgtaatcccagcactttgggaggctgaggcaggaggctcacctgaggtcaggagtttgagaccagcctgaccaacatggagaaaccctgtctctactaaaaatacaaaattagccggccgtggtggcacatgcctgtaatcagagctactgaggaggctgaggcaggagaatctcttgaacccaggaggcggaagttgccatgagccaagatcatgccattgcattccagcctgggcaacaagagggaaactccatctcaaaaaaaaaaattgtatgaaatatccctaagtatagccaaggagataattcatttaaagaaaaccccatcaaggaaaagtaagacatatttgaaaccctttcatctagcacatagcaggcactcagcatgtagagtcaaataatctacttttttccatctttatcatgcaggagaagtcattagctctcttaccattttttcctttagccctttaacaaacatttatttttcttcttcttgtttctctctctctttcttctaagctacctggcctatcgaaactttatgattgacacttaccgactgaacccccaagagtatcttacctctaccgcctgccgccgaaacctagcgggtgatgtctgtgccatcatgaggtgggtcttgtggctgaggggaagggggtacatgaggatgcctgcctatggatgtgttttggcaacagtagagatgccagcaaggaacacagaggagcagacagaaaaaagcacctctagagaaaggtgaagtacaggtttggggaatgaatgacttgagggattagcaatggcattctctgaagtgtagaatataggacaaagaaggagcatgtctgtaattgaaagatactggttcaggccaggtgtggtggctcatgcctataatccaaacattttgggagaccaaggtgggaggattgctggagcccagaagttcgagaccagcctggacaaaatggcaaaaccccatctctagagaaaatgcaaaaaaattagctaggcatggtggcacgtgcctgtggtcttagtgactcaggaggctgaggtgggaggatcccctgagccctggaggtggaggctgcagtgagcggtgatcacaccactgcacttcagtctctcttagggaa

SEQ ID NO: 1388 - DNA, 1126 bp, Homo sapiens
cctgtctcccgccgaaagaagatttcagccaagacactgacagatgaggtgacaaatcctgttctttttttcctggcgcccttagcataagtctcagaacaaatcttcagtggggattgtaggctgacatttgtcctgattctccatcctataggtgaacagcccagattcagatcgacgggacaagaaggggggaaactataagaagaggaagcgctccccctctccttcaccaaccccagaagcaaagaagaaaaatgctaagaaagggtgtgccagcccctagcctgcccccgtgttcaccattctctccacatcatgttgaaggaaggaaagacaaatcccttcctataaccacctggccctgacctgggtgtgccataatactgcaggtgtcctgagagggaagatgaggagatctttagctgctcagttgttagttctggttctggccccactagtacatttaaagagagctttatcaagtgaaaagcctttgccacttcccattactgtgtgattactggtttctgtttgtactcagctctacccttggaattctctgtcacttcccttcccttgaacttcaacttccagggactccttgtccaaggatgactgggttctctttcactctctttccttcccagtccctcaacaccttacactaagtcaaagcgtggccacagagaagaggagcaagaagacctgacaaaggacatggacgagccctcaccagtccccaatgtagaagaggtgacacttcccaaaacaggtacaggccaggctgagctcctgggatccacccccactccccgtcttgactctcctttgccaaaccccaagtgagctgatttctcaggtccacctcccagtctacaggatcttttccttaaatttagctggttattggaattacggtcattaccctggaaaatcctctaactgtatattcatatctgagttgtggactgtgctttgtgcctgatagtagttgtctccaaactctttgattatgtgtttctgacagtaaaatatatttgagcatggccaggcacggtggcttatgactgtaatcccagcattttgggaggccgaggcgggcggatcacctgaggtcaggaat

SEQ ID NO: 1389 - DNA, 2088 bp, Homo sapiens
tgtttccaccactgtctgcccacccgagcaccttcttactccctggacctagaaggggagaagaggctggaggtggggtggatggggccagagtgaacggttctacagctgtatccccagaacctcctccagggtcttggaaggagtcctgagaggtgggattggggccgggctggcagggctgagtttgcgcactgtgtatcttatgcacatgagtgtttttgtctaaatgactccagtgactgctccagcggggaggccccttcctccttccctctcagccatttctcacccacttcccatacccagtgttcatcccctacctccccttcccaccgcaaaggaaaatagccttacagaccctagcccagaaaccctactcctggggcaaaccagtatgggcccccatcccgcctagtttgaaccctaccttttaagaaggagggataaggaacaaagcagccccttcccctctaattgtggtggctccagccttctgcagccttgacccaggttgggcaagggcggaggtgaggaatctttgaggaccaagcccagtggtctgggaatcgggaggtagagagggaagggtctgccttgggggctccctcctcccaacccaacccctagagaagcgaccaaatcccagagatggggtgaagctggggtggggagggtctgctctttgaattacttgaaggtactgactccaaggctgctgttgcccacttaggtgtgagggggacactgtcactgcatttgggagggcagagggtggcgggtaaccagaggatccaccttggccctcacccactcctgctaggccctttccctggggaatctggaagcctgactttgcccccagggaagttggggaccgccttccctcccttctccacctctcactctgggcaccctctccaattgcactaaagtagctgttgtgccagtctgccccccacaaggggggaggtctctgcttccagtcttcttcccccgctgcctccgctcccaccctggacaatctccttgtttcccttgtgttcctggatagctcagctttgtatgtgtgtttggggggtgggggtgggttctggcttgagtgggtttggcaggggtttgggaagggttaggggaggatggaggatgaagtctcctacccccttctccagctccaggccacagaagcctgggaagggagggtgcctactctcgctgctgtgtgtcttgcagatgtgccaaaatgggggtgggtgggaggggagggtgcctggcagagcagcccctggggtggctctctcaaagcaatatagttcccctgcgggggacagcaagacaggggagagggttggggtggggacctgggggttccccatgtacagctatgtatattcaggggtgttctccgtctggtacccgctgtgggcatctatgtgtgtgtgaacctccccttccccatgccctgcatgacctgtgatgctgcagacaccaccatcctgtgtgcaggtgtgtgttggggggcacggaggggcatgttccatgtcctgttgcaccctccaccctgtgacccatgtactcggttgtaggaagtaaagagaactgagcacaattcactggattctagtggaatctttctctaagcaattttcccattcctgcctctccctgccccggaaccacctgtggtgctagtgttgggatcgggggcgtttaacgctggtgggcagcaataaggggcagatgtgcccagatgcctgcatccccagggtgccgagggcagcaggaaaaagtggggacctcggtgcatttgccccacccctcccctccctgggctaaagcacaatgttctccccgcagattaatgaccctgcaccctccaggcccctactcacatcctcccccaaccggcttcgggtcctcccaccacactctggttttctatgctgttttggtgcaagtacaactgtcgtagtcatggctttgggatgggttctgtttattaaaatcctattgctcctactggccctgtgtcccgcctccattcctgtggttggggggaaggaagggcaacccgacccctttccactg

SEQ ID NO: 1390 - DNA, 1164 bp, Homo sapiens
gggagctcgctccagccagaatccctagagtggagcccctccacggacgccccccactcaaacctaggtgctcccccacccccacccccacaccggttccgctccggctccagcccgctctcagaatgccggttctctctgcagccgcccctggtccaggccatctttagccgagatgtggaggaagtgcgttccctactctcgcagaaggagaacatcaatgtgctggtgagttgggagcagggaggatggcgagaccggaatcctggctcccgtgttctggacccctccccaccggtggggcggctccgtgtctcctctgctcagatgaggccgcagttctttccatcctggagtgaaagcctactctgcatttggggatggagagcaggtcaggcttgaagcccagatcacttgggctgggaatgcccaggaacgttgttctcttctcaacctccggagtctgcagcgcccccacccctcctggaaaaaggagccggcttctcagcccattggccctgactccaccctccctaggtgcttgcctttgactcccaataccgggacttaggacgctgcagaaactatgggaagaggttgtggggaagggcctggagctctgagacttgggctggggtccttgatagcccccttaccccgcgcccatactccctgctcttttttgccttcccaggaccaagagaggcgaactccattgcatgctgctgcctacgtaggcgatgtccccatcctccagttgctactgatgtcaggtgaaagtggggagctggaaggtgtggcacatagggagcgaagggaggggaggagtcttttttgatattcaaggattgctctccccggcttggtccaggcgaggctccagctccattcagatttcctggcctgattactggcttccttcatacctcctccccaccttccatcaaaataggaaattatatccccacaggtgctaatgtcaatgctaaggacacactgtggctgacccctcttcatcgtgctgctgcctcccgaaacgaggtatgcacccccaccttctattaccctttcaaaaaggataagttgcttaaaggtgggggttaagggttaaggagcctcagtcctcagccctacaagctgttctaccccaggtagtgaggagat

SEQ ID NO: 1391 - DNA, 1135 bp, Homo sapiens
ttccatgggtcaaagccggttgcagagaatctgtagtcactttggagctttagcttctctgccaagccctcaataagccagcaaaccaggactctgccccttctgtttccataggaatcatgttggatagtcagctgtaccaagccccttggccctctcccatgcacacaaacacctcctagcaagacctgttggttagctggacatgctttggcaatttttttatactaccaagtgaccataaaggcatggcatttgttgtgactggcacccaatgtttgattttttttttaaaactatccaattaaaattaaggtctgggagtgttctgtttcccattactttaatactcacctcctcccagactttctacacctgttgcacctcaggcagaggatgttctggacctccccctcttggtccctactagagacctctcaacagatctgtgggcccagtcattgggttttatcagtgcttaatgtgaactaagttttttacttccacagaatacaagccactaccttctgacctccccaccccccaccaacccccatcttttaatatgctgtggggcatagaactccggaatgaccagcatgatattttcagagtcttgtccccggggtattagcacctctttttgaacagggaattgattcaagattggacatggtctcctctgattatcaggtactggggctgagggcattaaaaatagtaagcctccctcctcgtcccctgcctcaagaaattgcctccttatttatcaacatctttttcctccctttccctgagagctcacagtacaatgtttcagaagccccatttgcacaggttttcagcaactcagaatgctctacttctttttctttgagaaaggattaagatacactcctgctgtgcccccatctttcctccaaactcctgcctgtgtttgtgtggatacccagtcccagaaccacactgttgagttggacacactgtaaacccctgggtaactgtcaagtcatgatggagacttcaggttgttctgtataaaatgcaaaataaatgtttttattaacaatgcttgagcctattattaaataaggcctggaagaacctttattatgaggtaaggaatctggctagc

SEQ ID NO: 1392 - DNA, 1107 bp, Homo sapiens
gtgagctaagattgcgccattgcactccagcctgggcaacaagagtgaaactctgtctcagaaaaccatatcagagttcaaacttgactttagcatttaacctaatactatgagccttagtttactcatctttaaaatggcagtcattatatactttgtagtagtaagcattgggaataatgttttagtgtacattagatagtattacaaatcacttagtgcctgggtcataatagttattcagtgaaatggttatgattgttattctctactttcaaacatactcaatatataacaacccatcatataactaaccatcaacccaaatagccccaattcatggaggacagacgatatccctgcctaattcttctttgctgataattcctttttttttctccatcttgctcctcttctgtcagttgatttatgaagactctatggatctaatcgcaaagctaccttgtgttgcagcaaagatctaccgaaatctctacagagaaggcagcggtattggggccattgactctaacctggactggtctcacaatttcaccaacatgttaggctatactgatcatcagttcactgagctcacgcgcctgtacctcaccatccacaggtaagctagacccagcaaccacagccactaggtgcctcaattggtgggaaatttttttaaaagctcctttatgttctcatcttctgagaacagatgataggcagcaagaagacagaaacgtggcataaaggatgatccaaggcaagaaaggggtctagtaagcaaggtcaggaggcctaaagaaattactgtaaccatgctaagaacaagatggtgcttctggctgggaaaaggtactagctgctcacattagatggtccttcagctttccaggagctcgctctttggggccattgctattaaagctaggttggagtcatggagcagagcatacaggcatcatcaaccagtaacctctccagctctgtggatgagtgaacaaaagctggtaatgagattaggatgcttttttttttttttttttttagatggagtcttgctctgtcgccaggttggagtgcaatggcgcaatcttggctcactgc

SEQ ID NO: 1393 - DNA, 1182 bp, Homo sapiens
ggggcttatgccaaagatgtaaaattcggtgcagatgcccgagccttaatgcttcaaggtatagaccttttagccgatgctgtagcccttacaatggggccaaagggaagaagaacagtgattatcgagcagagctggggaagtcccaaagtaacaaaagatggtgtgactgttgcaaagtcaattgacttaaaggataaatataaaaacattggagctaaacttgttcaagatgttgccaataacacaaatgaagagactggggatggccctaccactgctactgtactggcacgctctatagccaaggaaggcatcgagaagattagcaaaggtgctaatccagtggaaatcaggagaggtgtgatgttagttgttgatgctgtaattgctgaacttaaaaagcagtctaaacctgtgaccacccctgaagaaattgcacaggttgctacaatttctgcaaacggagacaaagaaattggcaatatctctgatgcaatgaaaaaggttggaagaaagggtgtcatcacagtaaaggatggaaaaacactgaatgatgaattagaaattattgaaggcataaagtttgatcgaggctatatttctccatactttattaatacatcaaaaggtcagaaatgtgaattccaggatgcctatgttctgttgagcgaaaagaaaatttctagtgtccagtccgttgtacctgctcttgaaattgccaatgctcaccgtaagcctttggtcataatcgctgaagacgttgatggagaagctctaagtacactcgtcttgaataggctaaaggttggtcttcaggatgtggcaatcaaggctccagggtttggtgacaatagaaagaaccagcttaaagatatggcaattgctactggtggtgcagtgtttggagaagaggggctgaccctaaatcttgaagatgttcagcctcatgacttaggaaacgttggagaggtcattgtgaccaaagatgatgccacgctcttaaaagaaaaaggtgacaaggctcaaattgaaaaacgtattcaagaaatcattgagcagttagatgtcacaactagtgaatatgaaaaggaaaaactgaatgaacggctggcaaaactttcagatgtagtagctgtgctgaaggttggtgggacaagtgatgttgaagtgaatgaaaag

SEQ ID NO: 1394 - DNA, 1219 bp, Homo sapiens
attggaattatttgggaatgcttttaaaacaatttgtaattatttctttacaaaccaaaacagaacagaaaggtgtggtgctggaacatcgatgaaggagccctacttactgagcttagttatggacttttttgatgcatgtgtgtatgtgttttaaaaagtatgcaggctctaaaaatgttattttgtaaagctctcagctcatgcaccccatctcctcttcacccatattatgccttctttctcttgtccagattcttctttttctcttttctaaacagctgagcctgcctactttgcccttttacagcttttaattttatggatttttaaaaatgaaatttcatgtggaatttggggttggggggcaggctgggcaaggaacaaggcagaacactaagtaggccatggaagtggctgttctttcccccaccctgccacaccctgggagaaaaaactagactttggcttcagaaagcacagatgtgacccaggcttactaaagagacaactccacagccctgggaacacacccttgagccaaacttggttgaagactaggtcttccctggcaagttccggaagaatggacttactgacttttatcaactcttctcactgccaaggccaacagcatctgaggtatagctttttgggagtacctgctttcttgcctcctggaggatattttctgtcctgggcttcatggcccctctcttccctgttacacattgctgtgctcagagcctttgcagctgcgacctagttgaatccacataggctccttccacacggtggaagatctgctgcttcactcacagaccaggagttctcaatcagaggtggttttgtccctcaggcctttggcaacatctagagacagttttgattgccacgcctggaggtgggatgtgtgtgctactggcatctagtggctgctaaacatcctacactgcataggatagtccccactacccccagccaagaattatctgactccaggggtcaatattgccaagactgggaaacactgatatagacagtgttgtccctgcctcctgggttagggtaaattttcaccccaaccctggacaaacagtgccttttgacactcatgcaactgttggggaaggactggactgggatccttgaattctccccagactttgacttttgataactctgcatatagcaagagtgattcttgaaagagctgtgg

SEQ ID NO: 1395 - DNA, 1195 bp, Homo sapiens
cactctgtactgtgtgcggacccgcagtgacggccagtaaagtggacttaactcccaagtgtgtcgcgccggacaccgggccctggacatgctgcttccatgttcagtcccttccctgcttctcgctgtctttcttttcccacctcccaccccccagttttcagattttctctcatccaataatgtaaaactatcgtgtacgggttcctccctccttttctcttctcccaaatcttttcccttcaaaggaaaaaaaaatgttcagaggtccctgtcttctgtccccatcttcctgccgatagctatcccctgtatgatgttggatgctcctcacatgctgagtttccagccttttctgaaactcagtagctggggagagggcagggaggcttcctgggccttccagcctccttccccacctccttcccaaaccctcttgggaactcctcagggacaactactgctgagtttgggtgcaccctaagatggaggccaggtagcaatggggccggcctcagagagagcgctgtgtgtgtgtgtgtgtgtgtgtgtgtgtgtgtgtgtcggcctcagagcgcgctgtgtgtgtgtgtgtgtgtgtcagcctcagagcgcgcgctgtgtgtgtgtgtgtgtgtgcgtgcttgtgaccctgtattgtttgataggatccattcagtttccccaagtacctgttttcattcccatttttcccattgtttaaaaccatcacttttttgtctttgggaaaccacaggaacaatttctctggagacaaggctgtgtctctctcctggtcatttttgttccagcctcttcagactgtgcaatctttcagcaggaactccctctcttctcggtagctttgaatcttaagcttctacgggagagtggtagaactggatcatttcctaatcccatttagttgtgcttttcttcatttacttcataccccaggaccccttccccagcagcagagaccctggagcacaggagagtagggaggaggggttctgggtccatcactgccctacatgtgactatgtccaagttaagcccccaacacgagaggaaagctgctgactcccagctatagccatgggcacttggccccctgcttttcctgctcagcagagcccctcccttcagagattacgggtacttgcactggggaggtggctgctggctggcccaa

SEQ ID NO: 1396 - DNA, 1165 bp, Homo sapiens
gttcctgggtcagctgggaagactttcctttaaaaaaaaaaaaaggacttctgcaatgggagagacatttccattaaagattaaaggaaggccgggtgccatggctcacactgtaatcccagcactttgggaggccgaggcgggcagatcgcttgagcccagcagttcaagaccagcctgggcaacatggcgagacctcatctctacaaaaaatacgaaaattagctgggtgtggtggcatgtacctgtagtcccagctatttgagagactgaggtgggagaattgcttgggcttaggaggtcgaggctgcagtaagcagagatcatgccactgcactccagcttgggtgacagagtgagaccctatctcaaaaaaaaaaaaaaaattacataaaaattaaaggaagaacctcttgtagacatgcaaattgtcatcttctgttatgtttaacagaactctctactcacttttctctctctagcccctgcctgacttctcacgagtccctggtctgacattgcccagtggagccttctcagactgcttgaccattgtggagttcctgcatagctttggcaaggtgctgggctttgatcctgccaaagatgtgcctagcctgggggtcctgcaggagggactcctgtgtcaaggtgacagcttgggtgaggtgcaagacctgctggtcaggctgctgaaggctgcactccatgatcctggctttccctcctactgtcaggtgagtgcaagtccctcccaaagtaaccaggacaagtaaaggagatgtaactacttagtgtttctcttttccttatatttttccatttctttttcttcctgactcctctccttattttatttttctttattttttccttttcttttgtggtcttctttcgtattctgtcttaacccccatagttctcttctgatgtattttcctcttgcacattcacccaacttggttgtgcatctttccctactcacccccattatgctgtcctccacacagtccctaaagatcttgggggagaaggtgtctgagatcccactgacaagagacaatgtgtcagagatcctgcgctgcttccttatggcatatggagtagagccagccctctgtgaccgcctgcgcacccagccttttcaggcccagccaccccagca

SEQ ID NO: 1397 - DNA, 1095 bp, Homo sapiens
tgtcgcccaggctggagtacactggtgcaatcttggctcactgcaacctccacctgccgggttcaagtgattctccagcctcaaccatccaagtagctgggattacaggcacacgccaccacgcctggctaatttttgtatttttagtagccatggggtttcaccatgttggctgggcttgtctcgaactcctgaccttaggtgatccgcctgccttggcctcccaaagtgctgggattacaggtgtaagccaccgtgcctggcccatgtgttcttaattcatactgtatcatatcttgtaaatttgatttgtgagggaaatttaagctttctaagatgacatgaattcatcacattctaactgatggcctgaagtggtgaggaatgttacatgatgcagaaagttgatatccctccgcttcttactctttttttttttctcccccatcatacaggtgaatatgaccatctcccagaacaggccttctatatggtgggacccattgaagaagctgtggcaaaagctgataagctggctgaagagcattcatcgtgaggggtctttgtcctctgtactgtctctctccttgcccctaacccaaaaagcttcatttttctgtgtaggctgcacaagagccttgattgaagatatattctttctgaacagtatttaaggtttccaataaaatgtacacccctcagaatttgtctgattctcttggttctgacaacatagtcaacactgaagggttatgtatttaattttagttttagagacacggtgtctggctgtgttgccaagactggtctctaactcctgggctcgagatctcccacctcagtctcctgagtagctggggctacaggtgtatgtagtctcacatcaccagcactgttttcaacaattagatttttagagtggctataagaagcagtttcagcatgaagtgggccatgtatgtttgaaattggtccttaaaaatagccattctcttttgttgatggacaaccgtacctcttgtgaggggtttcctgtgggtagtgtgatcttagtagggcctcagttttgggccttttgttcaatacaaattgatt

SEQ ID NO: 1398 - DNA, 1202 bp, Homo sapiens
tttcttcgacccagctctgtcccattttgtataaagtcctttgtgtgacggaaaaggtgcgggcaggtgcgttgaccttccggttgaataggggtactgaactctcgaaaaatggggtcttgtgcatgcggatgggaaggctgtgcaggcgctttatcgatcgctgcgcggccttccctcttggacacgcgttccgtacaagcggaaagaggcctgacttcggctgagttttcctctccttgtgtgttaagtcctggcttccgatgacctttaactggcctgaccccagctccttccaatatcttttgtctgttagtcagggactatgcggcgcaaacatctccttcgccaaaagcaggcgccgccaccgggcgcatcgtggcggtcattggcgcagtggtggacgtccagtttgatgagggactaccaccaattctaaatgccctggaagtgcaaggcagggagaccagactggttttggaggtggcccagcatttgggtaagtagagtttgttaggaatagtaaagaccttgtgtagcccaaatatccccaaaaccaagctgtctgccttctatgatgattttatcaaaatgactttcgttcttctgagtttgctgaagccacatttaggtactgagaaggagtcttggtcgatttaggtcttgataccaatttatccttatgtataaccctgcgatgcctgtatctaacaggtgagagcacagtaaggactattgctatggatggtacagaaggcttggttagaggccagaaagtactggattctggtgcaccaatcaaaattcctgttggtcctgagactttgggcagaatcatgaatgtcattggagaacctattgatgaaagaggtcccatcaaaaccaaacagtaagttgctcttattgcatctatgcacaaaggaacttctgttatttgcagttttacacattaaggtgacatgttctcctaaagcagaatttttcttctgatacgttcgattattaaaatcacacagtgcagtttcacctgaagaaattaggatgcagaatttctgattgacaaaagcctactacttgaggtttttttttttgagagggagtttcgctctcgactcactgcaacctccacctcctgggttcaagtgattctcctgtctcagcctcctgagtagctgggattacaggtgcatgccatcatgccc

SEQ ID NO: 1399 - DNA, 1202 bp, Homo sapiens; identical to SEQ ID NO: 1398

SEQ ID NO: 1400 - DNA, 1191 bp, Homo sapiens
aataaataaccaaagcagaaatgtgaataacttgatagcaagacaacctattaattcattgggcaactatgtatttcgatttttggttgcttttcctttaagacagtaaaattggtagattattcacttgtactatatactaatatttttaaaaattctttcagaaatgccagatctggagtaaggaatattgtcatcacctggattttgagaaagaaaaataacttctctgcaagatttcataattgagagaattcctgagttgatagctctaaaggcagatatgctgtatttgcctactttaacccatttttcaacctgtttgttttttaaaaggcttcactaagggttgatatgtaccattgtatggggcaattttaagtcagctaaggcaataaccttatgcatgaacatttcccagactttcatgaagctgttgaggtcctaggcaattaatgcagcagttgcgataaataaaaacatctcacctaagtctccttttcttcataacatagatactgacatgataggaagctctcagcttagggaaagagaataaattttagattatagaacatggattcaaaagtgactggaacaaattggctgacaccttactggtaacctgctattcttctggtgttatccttcaggattgttccactaaaatttatttttcaaaaaatttacttcacattattctatgtaagtgatgacttgtcagtgttccaggtgtatcttagctaaaactagagaatgccctaacttagatggtttttgaagcctatacaattggtattgtttgacccttaagcttttacatctcttagcatggaggacgaagaaagctgtacattgttgcttgagagtctgtacatttagtccagatttgtatttgcactgtcagtatggcaaatgagtgaaaaatgtttaatacactattggattttttatttcctttttttgattcagcttatacccgggctgaaaacctcaatttatgttcatgacagtggggatttttttaaatgtctacattctttctaataaactgttggaagacttcttggctgtccttttaagtgtctggcttactgtaatttttatgtatttaccatttactggaatggagtttatttgaggaagaatttgggattattcctctgtttgaaaaaagaggcttgctgtaat

SEQ ID NO: 1401 - DNA, 1196 bp, Homo sapiens
gttttgattacccaaaaactccattgccatatatctcctgggagacctaactaccccctagttgagaaccactgctctaaacctaaacaactactctttctactgtgagggcaagcagtttaaagctgtacaataagttacctgaatgggtttacagagagttgtgaaactatatgatttatttttcaaagactgctaatctactcacatggatctgtattttctaccctgtagatcgaagatttatcccagcaagcacaactagcagctgctgagaaattcaaagttcaaggtgaagctgtctcaaacattcaagaaaacacacagactccaactgtacaagaggagagtgaagaggaagaggtatactaggaaatctttcataatttaactctcgccgtatagcattgtgttcgtgttggtgagctatattaaaaactagattcaggagactccaaagaactgctgaaattgttcttgcctttaatttactgctttttccctctcatctctcaggtcgatgaaacaggtgtagaagttaaggacattgaattggtcatgtcacaagcaaatgtgtcgagagcaaaggcagtccgagccctgaagaacaacagtaatgatattgtaaatgcgattatggtaagtgttcaagcctttgttccttgactccctctgccctgaccaattatgagtgactttattttgtcttgctaaatatcagccaattaaggaacctcattccagagcctcttctgagttgccgtataggttttagtggcctaaattctcctgatttgcctgtaagagttttagtgacctgaattctcctgatttgcctataagaaccgctaattatcttttctctgttacaggaattaacaatgtaaccatatggaagcaactttttttggtgtctcaaaggagtaactgcagcttggtttgaaatttgtactgtttctatcataaataaagttatggcttcttgttggatgaattcagtcggtgactggtctcttccccgccacccccccacaccaaaaaaaaaaaaaacttaaaaaggttctagtaatttattaattactcctaaggcctccctcatttgataaggtttagtgccacagatttcccacttagaatctcagactttatacctcttttaagaagttactggccaggcgtggtggctcacgcctgta

SEQ ID NO: 1402 - DNA, 1442 bp, Homo sapiens
agtggataaagtagtgaatgctgggtagttcacttcccattggttaagctaacagcccacttttatgtttccagagaaattggatggccacagctagcatggcattctagctccttcttgaaagttgattcaatcatggcatttctgtcactggctggctctccaaagtaagaactgttgttaagtgcaggaatgcttttagactataggctgcaacttccagagagaaatccacaaatctgagcctccttcactccagcttttatttcagtgactttagaataattattgatttaactgttttgggaggaaaatagatttttattgttttgttttttaaatgaatgtcttttaaaaaacataacaaactcatgttccagaaccagcaagtgctccagagtgacacaccccctaggcccctacatatttattaatatggattatccattaaagccccaggagctgttgttttaagctttgatttagttctcatacatatgatagaaagtcctatttgcctttaggaacatgcctgtaggctcttctgcaggtgagatgtactgggctttttattatattcaactttcaattccatcttaaaaaacatttgtattcttctcttcccattcttccttaccctgcctttgccctttcaggaagggtcagttcccttacctgtgaactatgtatgttcagagtagcattattcctgctagctaggagaagtcatcttgtttaggggatttggatgctttttatacgttctccattttcctgtcattgggtcatgttatctttgagttgctatgaaatcaggaaactgtctccttttcctttcccttcctttgtctacatgctctgtccattcctttcagccttttctcaccacccatactcccccaaatctgggtaatttttaagccttgaaactatgtagtttcttgatacacaatttgtagttatgcagcagccacaatttgcattgccaggaaataggctccaggttatcttcatgcctctgggtgctcattcagctgtcaagtttccatgaacttacacttatttatgattgcgtttctgacctgagatgtatgctgcctgttattgcagtagcattagtttcagattcttttgccattgcaaagtaccccttataaaccagcaatgtcatctgtgaggaagcaaattctcaagtgtctgtcatttacttggttctttttctttgtggtcttcacccttataccctggaaaagtctgtaattaccttagccaggaagatagatggtcatggcaagcgcacagcaccagacttactggctcaccaagatgatggaaaaaggcagatgattttttaaaaagccgtaatgactcctttagaccagccatttagcgtggtaattttgaaaggcctagctccattgcagacttccaaagggtcagct

SEQ ID NO: 1403 - DNA, 1170 bp, Homo sapiens
ttataaaatgtcttctgcccttttcggttcaagtgtcacagcattttctgtgttgttattgcatgattttaacaagccttgttttttattcaaaatgggttgtgttcattgtaaaacggagtaagtaaggccgggcacagtggctcacacctgtaatcccagcactttgggagcccaaggcgggtgaatcacttgaggtcaggagttcgagaccagcctggccaacatggtgaaaccccgtttctactaaaaacacaaaaattagccaggcatggtgtcacacgcctgtagtcccagctatttgggaggctgaggcaggagaatcgcttgaacctgggaagcggaggttgcagtgagccgagattgtgccactgcactccagcctggcgacagagcaagacatcatctcaaaaagcaaaacaaaacaatgaaataagtaaacagtatagaaaaacacaaaggagaaagcccaaatcatcccagattccaccacctgtagataaccactgttaccatttgggggaaccacctcccaaatgtttccctatgatttactttcacataaatggagtcgtgctgcacatactgttctgtttcctgcttttgtcacttgacagtatgtaacgagtacataagcagcatttttaatggctaaaatatatttcatttgataaatttcacgtaatttactcaaccgtttctctactgttggatgtttaggttgtttccagttttttgatataatcacaacccatgtttgttgagcatggactgtgtgctcagcactgtcatggacatttcccttgcagtaatttgtttacccctaaaaacatcctggtgggaaaagtggttttattatccccattttacagatgaaaaaactgaggcccaaagttagagcaggatttaaacccatgaagtttgacccagagcctgttttgtaatcatgcctctgctatttgtcacatcatcatgcctgcccatattctggatggtttccttaggatagaatcccggaagtgaaaatgggtcagtgcagccatagtgtacacctaggagggagtggctggggtcaggagagggcgttggctgagagggttaaggaatggaggggccaaggtaatgggaggatcatccacatggaagttgaagtcaccaagaactgaacca

SEQ ID NO: 1404 - DNA, 1099 bp, Homo sapiens
ccatgcttaactttctttagccttctttacatacttagtacttacaaccaagtaggtaaaaagagctggagaaaataagttcactgaactttctaatgaccaaagagtttaacctaatatcagtaccaagtctgagggctgggaatgtgggattttgtaagaaacggtatggtcttagaaaaggaaccactagatttggtttcagaagttccagtctcaccactaactagctttgtgatgttcaacaagttacttaaactcagaagtagacctcacttcctagtctgtaaaatggggttaatcacacataagatgggaattttatctgctttctgccttagctgtcacaagcagtataaaaatgagaatgtagtttaaaaactttaaagtgctctgaaatgtaatatttatcaataataggtaacacttaatggtacttaatatgtaccaggcattgctataaatgctttacatgtcttatatttgtttaacctttccagcaacattaatgagggaaaaaaatacccaacgttagatcatatttccagtaacagagccactattttaacccaggcagtctggctccacgactatgctcttgtctactgtgcttatactgcctctcacatgagtcagaaacttgaaccctgggtttaggggttgggagaatctatataagagataaaagacagccgggcgcagtggctaacgcttgtaatcccagcactttgggagcccggggcaggcggatcacctgaggtcaggagttcaagactgcctggccaacgtggtgaaaccccatctctactaaaaatacaaaaaaaaattagccaggcgtggtggcacatgcttgtaatcccagctactcgggaggctgaagcaggagaatcgcttcccaggaggcagaggttgcagtgagccgagatcatgccattgcactccagcctgggtggcgagtgaaactctgtctcaaaaaaaaaaaaaaagagagataaaagacattcataagggtctgtaagtttcttccctggtcattttcataggactgttgtctacagtggatagagcctttcttcaaggatgatgggacctagtagtc

SEQ ID NO: 1405 - DNA, 1190 bp, Homo sapiens
actatcaaactgagttttccatagttagtgcccctttagttcactatactcttcttgcaactcctggaagggtggccataagcagcacctctgctggcttagacatgtgttatgtggaagacccattgtgggttttatccatgtcattggctcctgccttttagcaatagcaacttctaggagtccttttattttaagaactttcagaaggaactggtacccctctgttccccattattgcttgcatgtgtgggattaccctcagagggtggggaagagaccacagccaatctcagcatcatgtatatggtttcccatccacctctggtctgatgtattaaattagttgccagtgcactgtcttccagatttgcctctgtgttctttgttactgtactggatcttgttctgtctgctcccatcaactcttagttggccagccaactaacaataagtcagtgtccatcctccctttaattcttacccattctttgttattgagagaatagaaatgaattatctcctagcccttctgctaaagtggtgggtgggaggtgctctgaccactatggtctctgcagggggaaccgtgaaggactgagccgcacctcaagcagccgccagagcagcacagacagcgaactcaaatccctggagccacgcccttggagcagcacagactctgatggctctgtccggagcatgcgaccccctgtcaccaaagctagcagcttcagtggaatctctatccttacccgaggtgacagcatcggcagcagtaaaggcggcagtgcgggaaggatctccaggccaggtattacagcttcttttcttccatgtcatacccatcccttcttgcttgtctcctgtgaaacatcactgatatttacttttttttttgagacagagtctcctctgttgcccaggctggaatgcagtggtgtgatctcagctcactgcaacctctgtctcccgggttcaagtgattctcctgcctcagccgcttgaatagctgggattacaggcatgcgccaccacacctgactaatttttgtatttttagtagaggtgaggtctcaccatgttggtcaggctggtctcaaactcctgacctgaggtgatctgcctgcctcagcctcctaaagtgctgggattacaggcgtgagtcaccacgcccagcccatatttac

SEQ ID NO: 1406 - DNA, 1165 bp, Homo sapiens
ctttgagagtccaaggtgggtggatcacctgaggtcaggagttcaagaccagcctgaccaatgtggagaaacctcatctctactaaaaataaaaaattagcccggtgtgttggtgcatgcctgcaatcccacctacttgggaggctgaggcaggagaatcgcttgaacccgggaggcggaggttatagtgagccgagaccgcaccattgcactccagcctgggcaacaagagcgaaactccgtctcaaaattaaacaacaacaacaaaaaaggacaatctatgatatgttgtaaaatcattcggacttttggattactgttattttgtttcagcagcagtgggacagagagaagctatgccatatccttcccttagactatgctcaaagatattatgttatactggcttttctgatgatatttactttttgtttttatagttgttgcattgatgttactcatttaggaaaggtgaaagagaaatccctatgagaagcacaatgttaaatcaagattcattttagttataaatatgacctggatatttggagatatcttgaaattctctgttttgggggtttgggttgtgggggattggcttgttttgtttgggagtatttcttctcattgcctgtcttcttatcttactacagactataggcttggaagaagaatgacaaaacctaagcacaaggcagttatcttgaatgatatttcttaccttttctgttttgcaggacatcagaactgatgtttcttttttgttttcgttctatttttttctgcatcctgtctttcatgaaaatatttttctctcccttgatatcactgcttttttctttttgatatatgaatacacagctactcctgtgttctttacttctttaaacagttaacccttttatgttactgtaggcagaaaaagggtagctgttaatcatttaggcactgaagagggtaaaactttgtttgcctgccctagtttgttgggtgtctctgagtttgtgtgtgtatcttaaaaaaaaaaaaaaaaaaaaaaaaaaaaaagtaatggtatatatttggttcccattcttggagtaatgatgaaatatttttatattttgaaccagaacaaattttggtcttctgttgctgcttctaatcagttctactggcccagaaa

SEQ ID NO: 1407 - DNA, 1194 bp, Homo sapiens
gcattaaagtcgagagaccagcatcaatcacaggatcactgagataaatgaaaaaatatataaaggacttagaataatatccttttcctccagagcagttttctaacattttgaaccagtgaaaccctcatttcaacaaaatcttatttagctctcattacataaaacagattttaaaaaactgttctggctgaagtcaggatgggaattctcgagtcctacctgcttgggctcaccccaagcgtggtctatgtactctaagggtagcttgaaaattggtgctataaacatcccccctctgtggcccacaaattgtgcttccatttcttgtcttctctctcagagaattccttcaggtcctcatccagttaagcaactggacctgacaaagagtaaaacctctctaccactttgtaggtgcagacaaccatgcgtgaaaacctggccacagttgaggggaactttgccagcattgatgaacggatgaagaagctgggaaagtgagcacatttgggagctggagaacaggggttatccctacccctgtgaactctgttaacagcttacatagggtttcccctttactataactctagcatccccatcccatttgacactgggggcaagggttcttcttgcatgtggggtttatacccctcccctgatgaatacagagtggtagctaggggttggttatcatcagaaggtggtctcccctcaggcctgggggataaggacgtgggcccagccacatgccaactcatgtccaatactgctttgcctggtgtggggaaggattgggtcttgtcccccaacacagcttctgtggctgactgtaatactgtacaactgtttctgaccattaaatgctgttgtactctgtgtggcctctgctgtgtttcctggggaggaagcagcactaggatatagatattcattcgtcataacaggcaatctaagccactctatactacaagagatggatttaaattgtaacctgttcttaccaaagaactaaataaaaaatgagtacagagccagagccagagtttcaaaatattctcatctgttaaattaagagtgtctcccatagaaaagcagtggaggccccacagggcaagtacaaaacagaattaaaactcccaagggtcttgtctttacaaaagaaaaggcaggaggcagcccctggacagc

SEQ ID NO: 1408 - DNA, 1151 bp, Homo sapiens
cgagaggtaggtgagcccggcgccccccacacccaccgcgcgccccccgggccccgctcgcacccctcacgcgccccccgctcccccggcgccccctcctccacctcccctccccgcgcgcggctccgggctccccgctccgtgcccggccgatcatctttctagcaccctccagccttggcctccattcgggggttctgagggctgcgatcgggccgacatgcacccccacccggcggtggggatccgggggctttggctactgagggatgtggggagttggttccgggtcgggtcttggaggaggccgtggggggagggcgggagctgcttcagtggatgcccccagggacccttgcccatccgggctgtgcctccctctggcctctgtctggagggagagactggttccttgtccggcctgggttgccacagaggaatcacagacccaccctaaactggggccccgcctcccttttctgtgccagcaggacttggacctaggacacctaggtcctgggtcccccgtgatggggagagaagtgttgcatcgcggatagactgtatgggctgagactctagggttccattttcacttatgaatctcgaggtgcatctggccttgggggacgatgatggaggcatgaagggacagctgctccttcttggatcagtcaataaatggaggtcacactaatggcccttctttctgtttgagctgcatttggaagtgttgtggagacagccccgtagcccaatgcgaccagactcagggaaaacatcaggcccctccagctgagcccttgtgtgagccccgcccctccctaaatgccagacttgggagctgacagacagcactgcctgtgctgggtttaaaaggtgacaatgagaactttgttattgcaggggctgctgccactttgttcacatccttaacagacttcagcagaagggactgagttagctctcaaggaaggctccctggcaataggggctgaattatttggcaatgtggagcaggcgaggagttggggagcataggaaatattccggtccatgtgatctgagggaggtggcaagaagacctccacctgtgtgggcgttttctttcctgacttctcttatgtgtgccctaggctttcttgggggcc

SEQ ID NO: 1409 - DNA, 1179 bp, Homo sapiens
aaatgacagcagaatagtgaaatactgaatgttgtatatgtttaggctcttagaaaagtgtgtccagtaagttgtgggagaataaaattttaggttacaatttgaataagtttaaatgctacattttatgatatggaaactaaattttatttgggaaattaaaagcataacttgttatttcagaaacaccatcatttttgcggccactgttggaccgaactgtaaccaagggagaaacagccgtcctacagtgcattgctggaggaagccctccccctaaactgaactggaccaaagatgatagcccattggtggtaaccgagaggcacttttttgcagcaggcaatcagcttctgattattgtggactcagatgtcagtgatgctgggaaatacacatgtgagatgtctaacacccttggcactgagagaggaaacgtgcgcctcagtgtgatccccactccaacctgcgactcccctcagatgacagccccatcgttagacgatgacggatgggccactgtgggtgtcgtgatcatagccgtggtttgctgtgtggtgggcacgtcactcgtgtgggtggtcatcatataccacacaaggcggaggaatgaagattgcagcattaccaacacaggtgtgtaaacagaagcttggcacaggtcaccggagtcatgtgtatttgtggttctgcaaatacttctagaacgtgtgtcttgcagtctgagttcatctcagaagggtgactcatttgtttcaagctgcagaaatatgattcgctaaaaaactccagccccaaataaagctgatgtttaaagattaatactttttgttaaaatgacatcagggtatcctgtggctgtgagataaaatccaagtcactgactaaaatatttctaactccttcataagatagtgatggagaaccaggaacagccctttaatgataaggtttactctctgcagtagttgtatgtcttgttgtctgtgcgtatgtgcatgtacttaggttggattttattagtggaagaggagctgtgacttgattagtatgtgcaaagtcagatattgattagtaatattaagaagggaatatggcaataatcaagcataattcgaaagcttagatactgtcccatgaaaattcttaggccttcagccttttaaaaaatctgtttaa

SEQ ID NO: 1410 - DNA, 1189 bp, Homo sapiens
ttccaaagcactgggattacaggtgtgagccatctccagtaattctacttttgtcctggacccctctccttacctttgtgtgtgtgtgtttttgttttgtcgtgatctctgctcactgcaagctccgccttccagattcacaccattctcctgcctcagcctcccgagtagctgggactacacgcgcccgccaccacacccggctaattttttttgtatttttagtagagacagggtttcactgtgttagccaggatggtctcgatctcctgacctcgtgatccgcccgcctcggcctcccaaagtgctgggattacaggcatgagccactgcgcctggccagctttgttcttttcttatacattaacccataaattctccattgatgcctcaacaagtcttatattttatccatttaatttaatttaattttttttttgagacaggatctcactctgttgcccaggatggcatgcagtggcatgatcacagctcactgcagcctcaacctctcctgggggctcaggtgatcctcccacctcagcctcccaagtagctgggactacagatgtataacaccacatttagctaattttgggttttttttttggtagggactgggtttcgccatgttgcccaggctggtcttgaactcctgggctcaagcaatctgcccaccttggcttcccaaagtgccaggattacagatgtgagccattgtgcccaaccttatttttttatattccatgataaacttaagaatgtataattatggccaggcacagtggcccacgcctgtaatcccaacactttgggaggtcgaggcgggcagttcacctcaggtcagaagttcgagaccagcctggccaacatgatgaaaccccatctctactaaaaatacaaaaattagctggtgtggtggtggacacctgtaatcccagctactcaggagtctgaggcaggagaatcacttggacctgggaggcagaggttgcagtgaggcgagattgtgccattgcactccagcctggatgatagagtgagactccatctaaaaaaaaaaaaaaaaaaagaatgtataattactctattggtcagtttcctccaatatatagggattgataagactgtcaagtatattttttgtaacaatttgtagattcttatgctgttgctcctatgctattac

SEQ ID NO: 1411 - DNA, 1177 bp, Homo sapiens
gtgcgagtctcgcttgggccggcaggggaggggctgagcaacggccaccgcagcagcctgagcccttgcagcctgattatcacatgacccggcggcagtagccgtggcagcagccgcggcggctccgcgagctcgccgggtgggctcagttcagcgcacgccggagccgagcgcagggggcggggaagggacctgctgcagctgcagccgcctgggcgctcctggagcgcgcggtgactcccccggtcggcccgctccatgcagctccgttgcggaagtgtagcggggggaggcggcggccaccgcggcactaagcacgagaggccggggctcggccccctgcagcactaggctctgggagccgcgcgcggcgcgtcccagtggcccgactcgccgtgcgcccggcgcccaccgcagcctgcatgccccgcgctgcgccttgcccggcccccgccgcctcctgctcgcaccgctgcagccgggcgccggagtaatatgctcactcgagtgaaatctgccgtggccaatttcatgggcggcatcatggctggcagctcaggctccgagcacggcggcggcagctgcggaggctcggacctgcccctgcgtttcccctacgggcggccagagttcctggggctgtctcaggacgaggtggagtgcagcgccgaccacatcgcccgccccatcctcatcctcaaggagactcggcggctgccctgggccactggctacgcagagtgagtgcagcgacaccggcggcgcccctgctctcctcgcggcccttccccgcacggttccagccctcttctctccctgcttctcggcctcagggctctcactagctgccggcgtccaggcctcggcggggagctctttacttacactggccatttccctcttctccccactccctcttcccccagcccaaggacgcggcgtctccagccccggtatgggtggtggaggggtgggtggcagcgctggagcgtgggaaagctaaggtgagacaggtctgtgaatccggggtctctgtcacttggggaaaaaaaacgggcagaaaagctctgaagtttgaaacacataaggaaaatctgctatctgtacccccaccctcccaaaatatagttgacgcccccgcgtgatgaagagtttatgggggtggaggcttggagga

SEQ ID NO: 1412 - DNA, 1223 bp, Homo sapiens
tggcatcctgtgactctatgaatttagaaatctgtcatgcaagaggagttcaggtgtaaattttgttactataaatcacttgctcatctaacaggaattgtttacatgtagctgatggtctaatttttaaatgttcagagtcctaaaattatgaacagattatatgtcaaaaattaatttgtaatatacaaggtatattatggttgaactagtttttgtggtcttaggctggaaattaaacacctagtatatagaagcaataatatttcaagtatacatattcatttatagcattatttctatgggaaaatgcacccagaattctaactaggatcttcaagaacaactctccccaggtcagtgcatggagcagaaagagaagggaaagggatagaatgtcttcatgactttaatcctagtatttgaaaaaaaaaaatcaaaccttgcacctacaaatttctgtcttgatccagaaagtcattagcataaaaaagataatagtggccttctcacctaacgccaccaacatggtgttcaggcgcttcgtggaggttggccgggtggcctatgtctcctttggacctcatgccggaaaattggtcgcgattgtagatgttattgatcagaacagggctttggtcgatggaccttgcactcaagtgaggagacaggccatgcctttcaagtgcatgcagctcactgatttcatcctcaagtttccgcacagtgcccgccaaaagtatgtccaacaagcctggcagaaggcagacatcaatacaaaatgggcagccacacgatgggccaagaagattgaagccagagaaaggaaagccaagatgacagattttgatcgttttaaagttatgaaggcaaagaaaacgaggaacagaataatcaagaatgaagttaagaagcttcaaaaggcagctctcctgaaagcttctcccaaaaaagcacctggtactaagggtactgctgctgctgctgctgctgctgctgctgctaaagttccagcaaaaaagatgacggccgcgagtaaaaaggcttcagcccagaaggttcctgcccagaaagccacaggccagaaagcagcacctgctccaaaagctcagaagggtcaaaaagctccagcccagaaagcacctgctccaaaggcatctggcaagaaagcataagtggcaatcataaaaagtaataaaggttctttttgacctgttggcaaa

SEQ ID NO: 1413 - DNA, 1238 bp, Homo sapiens
gtaatatctttcaaaacattttctttcccaacattaaaacccttttgatgtatagagaaatgtcgtttaaaaatccattagcaaaatcccttatgatgataacaggatacatttttttttccttgctcttttattgtaccttgttaagctggtctcacatgaactttcttagaatcaggcagttcctggttcctatgggacttcctgttttctcaaataaaaatagaaaagcatctcagaaaggaaacctggtcagtgtgaactactttgtaagatcagttagtcttagttagtcttagttgtggcctggattatatagatatatagtctatataaaatataaaagtttacaggtatctgaaagctttgaatattttcgtatgtaatatcaaaataaacaaaatgataaggagaagactctgaataaaaaccctgagaggtgctacatattcagccgtaaacatttttgtatcttaatttagaggtgaatgaaggaggggcataggggttggatggaaagtggtaaatcctttccttattatgtaatattttattgtaaatttggaattgcttaatactgagacttaattcttagttactttgatctgtatttttttttcttgccactttttcagatgttggcaaggattaggaaggtggatttttaaaaaatcattagaagtcagaattctaaatgaattattcagttttaaagcatcttgtagatttctttcagtagttaactgcttcttagtctatattatgaagagaaatcaaattaaggtagaaacaaatgatatagtcattagcagtaataataatggatagtgtgtattgagtacatattaagtgcttgacactgtgtcaaacattttatcttgtttatctcatttaatcctgacaacaactgtataaggtaggtatcattgttatccatactcctttaaagaagaaactacaatttagagtagctaattagatgttagttcaaagagacattactaataagtggtagaggtggagctgggacttgaactcagcttctgtgataccagagcacctgatctcaatgattgtgaggaaaaccactaattcaaagtgagaatgataagtataagtctgaaaaattacttccctaacctttattatcaccagtttgtttacatttggttcacatatttatatccagttttagcaaagtacatgctggcatttcagagagtttgtttgggggattt

SEQ ID NO: 1414 - DNA, 1100 bp, Homo sapiens
caagtagctcagaccacaggtgtgcaccaccatacctggcttatttaaaataaaatgaaatttttgtagagatggggtctcatgttgcctaggcttgcctcaaagttgtaggctcaagcagtcctcctgccttggcctcccaaaatgcagggattgcacgtgtgagctaccacatccattccagttttgtatcctgattgtaataatgattgcacaaatccatatgtgtgataacatttcatagcaaaaatgtgtatatatgtgtatatatatatataagtgagtaaatgaaaagagtggtagactcctgaaaaggtctctcatttagataaagtattgtaccaatgccagctgtgtgatgtactatggttatgtaacttgctctcattggtgagacctgggagaaggatacacagaatttctctgtattgtttttgccatttcttgtgagtctaaaattatttctaaataaaacattttttaaaaaaggttctctctggaagttatgttgaatcaacactgaagggacaaaggggaagcagggagaccaattaggaggctgctgtagtcatccaggtaagagatgatggtggctgggaccaaggtggaattggtgatggaattcctacctgtcccttccaggctgtgcaatgggacaactttaagagccagagtctccagctgtcactaccctgtcaccatccctactatcatctctggaccccatatttcacctgtgctcaccctgacaccacttctgcccttgtgtctcctcacagcaagtgtgggtgctacttcccctgagatgccatgagtttctttttccttattgccaggattgccctgagccatcacaggcccttgatttttactatctaagctgtatttcctctgcccatccattaggaagaagattgctgtctggtttgaactggaatttctcgctatgtcccactggaggtatgtcatagtctgctcttctcactcctctgtctcaggaaacatggtggaattttcttaagaggcttcgaattccttttcctccttataggggaagaatttgcctcagtcatattttctaatggcatctcctcatctgt

SEQ ID NO: 1415 - DNA, 1179 bp, Homo sapiens
agagaagagtttaacttccatctctcttcctcatcctccatcagaaggcagcagtccataaaccctattcttaagtgtggcaagtgcagatgcctttggtgatatctaattatccttgatctctaaatctttattgtctattgttaatattctttcccttcatatcattttgggaaagaacaatatctatagatttaagcccttctgtgtctatgttgttttacattcaacaaatagactttaaagagaaaatgtagtgtttcctaaaatctttctttgattacttgatatctgtggttttctttcctacctccccttcaaacagaagccttgaaatactaaaaacttaacctcaagaatttcattaggcaaagctcacaatattttttttggagatattctttaaaaaataatttatctttcttcaaaatcttcaaattgtaaaagtaggtgaggagtaggacataatttattctactgtgttggttaataaccttgaaagtttacttaaaaggcagtctctttcctgattatacaaaacatttaatgggaggaaaaaagcgctcttgaagtattgccatacacagacttttaaacttacaaaaaaaaaaaaaatactgcagcacgtttacactctgccataaagtactataatgaataattaaaacaactagaattgtcaaaataaataactatggattgcggtgtagtgctctaaatttttttaatgcttttttgcatgttgatttacatagcatagtaataagtcaaggatttcccagtcattaaagtgaattaacaagaaagtattttaatgggtagttttgtcttatttcagaatttgactagttatttaattctatacccttctcttgcatttactctaaaaaaaactgtgtttgtataaataatgtatttaaaaataaacaaatcagaactccatggtctgaaaaacagaatttagcaactaatttgtcacgtatatgtgaagctttccctagtacctcacttccaagcattgaagaaatgaacatttcacgcagaacatgtatctttactgttcaataattcaaaagcgctaacaacaatatgcatttaagggtctttatatttcattcgaaatacaagctcttaaaacaacaacatcagtatttctgtgtctatatccaaatatattaa

SEQ ID NO: 1416 - DNA, 1216 bp, Homo sapiens
gtcaaaaatataatattccacctgaccacaaatataaatctgtctcactcctggttttcagtaagtttatttataacttagattttcaggacctctgtatttttcatttaaaaattgttttgggaataaatgctaagtgtgtgtgtgtgtgtgtgtgtgtgtgtgtgtgtttattatttgtgactatttcttattacatatagggatttgggaatgggtttggtcatattgctgtggtacgtatttaggccttgcctagtactttagggcatgtgtatagtattgatctgcagtgagtacagagtcatgctgcgctaagttattgattgatcatatttttaaaagtcaattgtagatcatctaagataaaatgtatatttgtggcaattgaactaattatgaggggaaaaattcccttttgatttgtatagagtctgcctttgctcagatggaatgggcagatgcctgagtgataaaatttctggaatttcttcctcaaacctttcctttcacaatcatgttttgaggttaaatttgaaatgctttagttaagaaagcgcatgttaagcttatacaaatgtaaacatcattagtttttaaaaggggctctgagaggcactaactcaaaggcagttagtagacattaggaaaaaacaaacaaacaaacccaaacatttcaatggtgtactaagttttaaaactcctgtggaagttctcagatgattttatatcaatgtacattgtgaaactctgaggagggggtatactgctttagtagtcaagtgtttttattgcaagccacaaacaccaattggaattcagtttaaaagagagaatttattataagaattcagagataccttgtggaatgtggcagtgggaatggagctggctcacaggaatggatgggctagaaaaccatcaggatcctgtccacgtccttattggggcttctgccagtgtttctgctcaatttcttccctttctccattgtctgccttctatggactctccttggaagtcccccgcttttagtaacagcataggaagctttaaaagtcattggttagtccttcacaagctgattcagtattggatagtcagacaacagttatagacatcagatagccagtgtagatcatatagatgacttatgtatgtcatcagcttgaatatttgaagttgataagtagtttttaccaatttcagtatattt

SEQ ID NO: 1417 - DNA, 1175 bp, Homo sapiens
cctgtacttgtaccaggtatgaaagaaacataaatctcttttgggacttattgtagcctttttgttaggacttagataagcttaaataattgtttccttttaaaggaatatatgtgacaacttaatatgcacatagagctaactttttaatctaacaatcttgaatacctgaagttagaaatttgtaagtaaaaggttaaaagtctcaccctaaaatatttggctgtaatatttattgtagatggtgaaaatttctacttatagaaataatataatgaagtgggaacattagcagtactataggggttgatttttaatttttctttcttaaaagtctgcacagcaatgattggattttttgttggctttttaggaatcattttctcactgaatgataaatcaagctcatcgaatttgaagatcgatgctttgtcatgtctatacgtaatcctctgtaaccattctcctcaagtcttccatcctcacgttcaggctttggttcctccagtggtggcttgtgttggagacccattttacaaaattacatctgaagcacttcttgttactcaacagcttgtcaaagtaattcgtcctttagatcagccttcctcgtttgatgcaactccttatatcaaagatctatttacctgtaccattaagagattaaaagcagctgacattgatcaggaagtcaaggaaagggctatttcctgtatgggacaaattatttgcaaccttggagacaatttgggttctgacttgcctaatacacttcagattttcttggagagactaaagaatgaaattaccaggttaactacagtaaaggcattgacactgattgctgggtcacctttgaagatagatttgaggcctgttctgggagaaggggttcctatccttgcttcatttcttagaaaaaaccagagagctttgaaactgggtactctttctgcccttgatattctaataaaaaactatagtgacagcttgacagctgccatgattgatgcagttctagatgagctcccacctcttatcagcgaaagtgatatgcatgtttcacaaatggccatcagttttcttaccactttggcaaaagtatatccctcctccctttcaaagataagtggatccattctcaatgaacttattggacttgtgagatcaccctt

SEQ ID NO: 1418 - DNA, 1229 bp, Homo sapiens
ccccgaagactcgctccccgccccgagccccctcgcttgtcgcctgggttccctccgtggtatgggtggaagttagaacggaaaccagaaagttgtcctttgcgaagacctagcttctcccagccccgagctagggcgaggagccttcgggggaaaccactcccaggcgccccgcgggcttgagcctgacagcgaaaaagtttgcctgaaacggggcttgcttgctccatttgttgcgggaagtggcaggaggaaggcagcggagagagccccacttagtctggcagcagccaccgtgtagagaaaaactgttaaaggggcctttcccttcgtcagcaagaggaaatctctttctcttagagggagagaaaatccaggaagtttgtcctcttctctttttcgccatctcgaggtgtctaatcctaaaactatcagcgccatgaattttatttaaaactacgcccagtgaaccgggctctccggatttttcttctgaaaaacactgatgtcttttggagaaaagatcatttttgcaagttaaagcagatggtttccttccccttcgctttcccccctctcccactctctttaatagtttagaaaaacattttggccctgtaacttctgattggtatgaatagaagcagttctgtgttgcagtaaggggaaatcacatttttacggggtagaaagttgacactaaatgaagattgtgattttagtattttaaaattaattccgtctaattggattttggttttgcaggcagcatctcatatatgtcgagtacttaacaatttaaagctctgacttgtaaatttatttttcagctctcttttttcgtaattagaatactgtttggacttgctcaacaagaccttatcttaacaaaaagtaacttatagaaaagggagacattcatttaacttcaagcccatattattcttaaaagctgactcttgaaatagtatttattgagtcatagtggagtcatgggactttttaagggccggaagggactatttagatcatccagtcccaccctgtcattttatggaggaggaaactgaggcctagataagataaccagttagtgggtccactgacctttaggacagtagtctatccgtaagagacaacatggagaaagaaatacaacgtttttatagtgaattatcatcttacaaagaatattcttcccatatcgcacttttaaaaagtgggtacct

SEQ ID NO: 1419 - DNA, 1138 bp, Homo sapiens
gttccatagggtacagggatgggaaggaatgggagcgatggctaatggatatggagtttctttttggggtgatgaaaatgttttaaaattgattatggtggtggttataacactgtgaaatactaaaaaccactgaattatatattttgaatgactgaattctatggtatgttatacaagatgaacaaaaatgtgtactcgtatagttaagaaatatttttagtttttaaaattatttatttttagagacaggatctcactgtgttgcccaggctggagtgcagtagtgtgattataggttactgtagcctcaaactcctgggctcaagcaatcctcgtgcctcaaccttctaagcagctgggattacaggcatgagccactgtgcccagctgttgttttagataaaagcagattaagacctttttacagaagaataacagtaataatattgatctctttttactttgtatcctcaccccttaaacactttttaggtttgcccttgttggtgttggatctgaagcatcttcaaaaaagttaatggatctgttacctaaaagagaacttcatggtcagaatcctgttgtaactccatgcaataaacagttcctgagtcaatttgaaatgcagtccaggaaaagtaagcagtcctcagaggcttttattaaaatatgtacattttaaccagtgcatttgttaggtgttatactagagaagtcatcttaatactagctcactaggaactccatttcacaaagtccatgctttgaattagatttaatcactggttatgactgtgggcctgtgtacgagaaacctactcctgttccatttttctccagatgtaacagacccaatactatacaacaatgtgcaagttctatagccctgccattcttgtcctattatttccatcttagatacagaaagaaactacattctaattcttagattaaaggagagctatgtggatgtgtattatggtgggggagagatcactgataaccagaaaatgttcattgatttttctgcttggcaacaagacctttcaccacttggtaaactgaatatagaaaagatttgtcattatacatttaagtacattatctttaaagagatgagatggatgattatgta

SEQ ID NO: 1420 - DNA, 1232 bp, Homo sapiens
tgtgtttgcctctaaaagcagtgtttctcaagctttagatccttgaacaagcattaagtacaaatttactagtacccttatcccatctttccaaaagattgttctatgcccccttattgtatggtcatcaaagaataaaagatgagaatagaaggtgcttcttgttggtgggggtgtctgcagagtcccaaggcagaacagtcctgatgtggtgcagggcatcacacagaggagggggctgagtggctagctcaggtctgtcttcctcctcacctaaagccagcagtcccatcctatataacccattagtccatgacataacttggtcacctcttaaaagcccaacttccaatactgccacattggggattcagtttcaatgtgagtgttataggggacacacatgcaaaccattgcagagttataacagttttaatacaggattctagttgtgtttgtatttagtataatactttggataaaatcatgctcttcatttttcactattgacttttttcttactctcataggaaacgtgtccctgatcaccacccctgttaagcattcccacgtgctgtcgatctttggaccagtttctagcaaagttgtgtttgaaagatactctattaaagaagactgtggaatctgtttatcggtgcccattatatccttaagtttggatatttagctgaccttcgctttaacataggtctaatttatttgccgtgtcattttccatacaaatcagttgatttaaaaaagttcatttctcatactgtgcattaaaataaaaatttgaacaattacttggttcttatgtcttatatgtgtgtattctgtttgaactctacttaatggaaattaatgattattttcaatatggcattttccagcttaatgattggccatctacatttttgaaataattatcttgattaatataagtccaagtcaaatgtgataaacacgccatatattaatcttttggttttgttgctgggccataagaacactcaatcatggctgggtgcggtggctcatgcctgtaatcctaatattgggaggccaaggcaggtggatcacttgaggtcaggagttcaagaccagcctgggcaacatggtgaaaccccatctctactaaaaatacaaaaattagctgggcatagtggtgggcgcctataatcccagttgcttgggatttaatttacccatttaattttgtttagtgaaaa

SEQ ID NO: 1421 - DNA, 1216 bp, Homo sapiens
ggccattcagtattagtaaccttgccagactaaagaggttttcctgtttcatctggtgttagttgctaccgtcttcatctgggcatttaatatttgataattcagctaattcttttgtagactcactcttgtgcacataaatacaaattcagaaaatatgcagctaattaatatatattgctgtggtataaatgaccaatgtttaaaaatattgtatatatttagcagaataaagctttaggatattcattttgaagtggcattaactgtggatattaatcgtgggtaaggagtgaacagagactggaattgatgccttgaatcctcgtccagataatgaggaaagttattttaccataagtgaattgcctttcataacagtgtttggattataaaataaatcaaaccaaaattatctgatttcttcctttttcatttgctaaagccaagctagtggaactttggagaagaataatttataaaattcgtttactgtagaatacaattttgatatttttctgccagtatagcatctagtactttttctttttttttaagttggcttcagctgttctggaggctgtggaaaacaatactctaagcattgaaccagtgggattacaacctatccggtttgtgaaagcttctgcagttgaatgcggaggaccaaagtaggtttttacgtgcatgaactgtgaaagtgactgagtttttgaaatgttatgggttgcagttatttagtttttctggttttaaatgtagttatatttccctcagatttctcttaagcgtctgtgtagcctagcccaaagacaaattcctgagacagtgtggaatatagtatttcagatttagcattaaaggagagcccttttaattataggttggtgcaaaagtaatcgtgcttgttgccattgaaagtaatggcaacaagcacaattacttttgcaccaacccaatacagtaatatacatatatgatagagatccaggtaaactagagatagaaaccggagttgtttttgtttttgtttttaacctcatattgtgacctattagtggattgtgaaatcagtttagtgggtcataagtagaattttttttattacacgtatatgtgtagccatgtgtcctgggtttctgtataaaatacttctctctgagggtgaccatcaaaaatagtttgggaaggtactgagttagactaagtcttatcg

SEQ ID NO: 1422 - DNA, 1232 bp, Homo sapiens
aaaatgggagaggggagcagaaccaggaaatctcagtaaataagcgatcatattttcaaacactatgtgaaaataacagaagagagaactttatgacgttagagaagtttatctgaacaaagcagtattctaaaacttcaggaagattacattcctaagaggtcttctaggaatgtatttgggagtgtttataccaattttgagccccatcagtagtcctcatattcatctgacatttgataatttcagaattaaaatttttttccatctattgaggttgtgtttgagatatattgagatattcttcatagtcttttaaaaaagattttttgttttgtcttccatatttaatctacctgaaattgatttttgtacatggtgttagaagtacagtttcctttcccctgcacctaaattatcatattagcattgtgtaccaatttattctaacctccttaactattcagtagtgctagctctattgtaaatcaagtttctctttatatgcatggatttcttatgtctctgttaccttgatgtgtttgtctgtgcctataccaatatcatgttttcttaaatactaaagctttgtgttaaatcttcatgtctgtctgtcaacctttttcttcataagagtcttgacttggccttttgctctgtgacaaatttagaatattcatgagaatgctcccctccaacacaaaaagaagtattgagtttgtaagtggaattgcattgactttagttttctttgtggaagaatcgataagtttatgtattctttcatgttttctctcaaagttttatatttttttcataagggacttagaaatctttagtccaatttatgactacttttgttgcttttcttggttgtaaattaaaaaaaaatttttagttataggtgttattgaaatatagttgacttttaaaattgatttttgtatctcaatgttgctaaactttttaatttttataatttatctgtaggctttttggggggttcatataagtaaacacatcctttggaaatgacagttttgaaattgtcaccagttttgaagttgtcatcattaaataatatttgatacaggattttttttatagatatactttatcagggtaaagaaattgttcataatgctaccttatatatttttttcctctgtagcatctttttcttcttaaggttgtttactatgtgcgttttccccttatttggtcagacttac

SEQ ID NO: 1423 - DNA, 1217 bp, Homo sapiens
tgctatttcacaggaatgtttgccaaaaaaaatgaaattgtttatcaattacttgacttttttatctagacaacgccagaaaaatccagatttttggaatatggacaatgcaaaaaaattttagtctatatttatggcattgtctagtcttagcttaagaacacagcatttacttggcttcattatttactgttcactaacagataataaaattaatagcaatttgggggtggtgccatactctgaaacaattaataaaatattttctcttctttgcacattattgtgattttttaaaggcaaagagtgaatgattcctcaattcttagcgtcattgatgtaaagtcaatatttgataaaagaaccaagttatattgtgaatgaaatcagctggttaggtgcaatggatgtgtccactttaataaaagcaataattcaggttgaaaagaacttcattatcttttctcaagataaattttaatggaggcctggtctgagaatacaatgccataagttctgaatcttcaggttcgtgcaacaagtcatttcttaagtgaccttcagctgactacataaaatctgaattggtcttgattagaatctgtccagctgtcagtcttttggcctctgagatacagagggcatatacccatgatgctgtggggttatgtaagagacagtaaagaaataggggggaaaaaaacagaataaaatgtaattacacagagtttcgtttaaaacaaaaattgattgagttctgcttaaagtggcttgttgtttcctgtgccaggaactactgtgcaggcccagcaggaagtgtgctacagagcaggatcaccttacaccctcgttttatggttcatttcacttatttaatgcaatctgagaacctgcaaaaggaacatgttagaaggagggaataggctttttgtcttgttttgttgttgttgttgttttaaatttctttgaatcaaaacatttgtttttacaaggtgcttaaagtcccagagaaacaggacttctagagttgcacagtgaagacatttctctttgtcacacaatttaaagcaagacacaaagttgagttatgtctagagttgagttatgtctgtttcctttgctgtcctactcacataaatttaagcataaagaattacaaccatgcccatgaatggtctaaatcattttgaattccatgtaagttcctcctagggtct

SEQ ID NO: 1424 - DNA, 1136 bp, Homo sapiens
gggttcgttacacttgcaatgctttgttcattttcctgaatgtactttacaggttacttcaacatgaatgggaagaaagcaatgttcagattctgaaacttcaagccaagatgtttacatataatatcccaacatgcctggccacctggaaaatgtaatgcaacaatcatgtacatgtttttatagctattgcttttatttataaggtttgctccagacaggtaaatctgaaatgacatctatatatatatatatatatatatttttttttttttttttcctggacagattgctattcttaatttagatttgtttttagcatttactgaggtttaatgagagtgagtactcattgaatagcctctaaaagcaaaaagcgtagacttttaattttctttgaaggacaacatttaggtgacagtactgttatcaaacaaatctgctacagacattttaagaccacctcttgaaatggtggtgtgtcacctgttgtagtctgatttcttctttcttttaaaggtgttagtgctaggtatttttgactagtaattatgaggtgttttttttttgttgttgttgttgttttttttttctcctgtgaacgttatttatgttcaaaacactggtctgcttttttcttgtaaagttgataaaaattgttgaatttttcttttcactataggttttcctccttggaagtttagcctgttaactttcaggaagttttgtactcagattcccacagtcagtattctgccagtggtggtgtttcattttgttcaaagatatataaatttttcttttcctttttctatatttctttttttttttttttctcttagagccattgctgctgagattgttctaaagggacaaagagaggtaagccatggttgaatctcagatgggtcacttttaaaaagtttttctgtctcttttgttgacttctcaatttaaaagaattaaagcacagaagttaacatttcatgcacactaagaaccaagtggggaaacaaaagtagttaacattttaagagtaccaaatattcggaaactccaaaactcagcataaccattttgtctcagatgttattgtgaattaccattctttaaacagatggaattatgaaggtgtt

SEQ ID NO: 1425 - DNA, 1150 bp, Homo sapiens
tgccagctaattctggacttgcattgaggtaagaaaaacttaacattcttttggtcctctgcctaatggaataggctctttatataagattattcttgaaaacttgataaaaatagtctgttgttccactatgtcctcatgaatatatactgcttaatttcagagttgttaagccaatatttagctattcattcaaaagtcagtgtaaaaattctggtcgcttcagaaaacttcaggttacaaaggggcaaataattccattcaagtaaagttcatctgtgttccctaaacacacaccatctgtccttagcatgtgcattataagcagtaagcttgttttccacggcaagggaatattatttaagatgttttcatattttcacctaggtcagttgctctcaaatattggcaaacattagaatctcctgggatgctcatttaaaatgtagattcctgaccttgagccctcacactacatttttgaagcactgattagggatttcatatattcgatcagaacgagatttctcagcctttctttgtagtttctctgctctgatacagcaaatccactttcatccgcaagaattatgctttttaattcaaaaaggtaccctgcatgctaatgcactggcttccacgtttgcagtcattcccactgcatcagttgtatcttaatgttttatggatcataagatgcctaaaatatttatgaaatgttcccttatgttttaaaggatttacatttcatttagcatgtatgtggggaaaatcgtataaaagtttaaaaactaaagttgagacaaacataatggtagtattttacagttttcttagcaagcctgccaatctgtagaagctcattacagaaatgttaattatgaaacacctttgataaaacgtgaaatagaaaatgtcatattttgacatgattttctattgtgataggcattttagaatataggtagtttacttgtttattttgttggtaaatccctacatctgtgttttgatacttatttcctctggtcatccctgttctttttttccaggagaataaagaactttaatagttactatacatgcattttagttcaagaaacattcaagactgatcatactctaagaaagaaaaataccaggaaattgc

SEQ ID NO: 1426 - DNA, 1138 bp, Homo sapiens
gtggatggaaacattacatgtaatgcagatatagtgaacactggaaagatttattaaagaattatatttgtgtatactttataaattagtccctcattagatttttttttcttaagcataagactgaacttaaatgtgttaattttagtagaatcaggcactgctcgcagaaggaacacagattgtagagattaacataaattgttcttgttctaatatatatattttttcatttctgtcgtgcttggaaaactagtaaatattatgtctaagataaaatggaatggcccctggatttacttcttataagaagcagtagtatgtaataaagctattagcatgagcaattaagaggctataaagagattatagttacaaaagaaatactgccatatttttaagttaataacttaaaccttctcaaatgggttaaaagttgaatgaattgacaccctgatgttatgatgttggaattttaacttaaactgggaggcattctgtgagccttcactttaccttctttaattattgtccttgctaaactcaacacagacttttctgttatgtgtttttgaggaagttggggtgggaagagtcagggagataagctaaaattgtcttcttttatggggtaattgtactctgtagtctcttggtttcctgtgaagttagtatttatgtgggggtgggggaaggtagcaagaatcatgggtatcacggtactttgtttttgacctcctggctctttcagacagagtgaagaaagcttttccattcttactgttgtagaagtagataggaaataagcttttctcattacagtgaaatatgttttaaaaactagagtagctgggcacagaggcatgcatttgtagggccagctacttgggagagtgaggcaggaggatcacttgaggccaggatttcaaatccagcctaggtaacactgagacctccatctcgtaaaaggcacaaaaactagttagagatgaaattgagctttattttaaaaaaacgttctaaagcctgataattggagagctatacttcagcttttcatcctactttaatgaaacagctagataggaacctctgctccagaattgccagataattattggtgggtcataactattct

SEQ ID NO: 1427 - DNA, 1159 bp, Homo sapiens
ctctttcctgtgcctttatcagggtaaatgacaaagtaaaatagtaaatacccatctatgaataacatagtctagttctggttcatttacttggagatagaacaaaactggaacatgttgaagaaatccttagtgtctaataagggattttgaagtctcaggttagctctgtaaaataatctatggaccatttaatttccaatttaaggagttgcaaagcattgtccacagtaactggctttaacttgaaaccaaacgcgatcagtggaataaggcaagtttgcctttaggcttgctcaactgcattttggaaacagatttgggtgatgtgagaaagatgtactcaaaagaaaatttaagtggatagaagcttaaaaaaacccaaagggtcaaaatatgcaaatgactatattctaatgactttagtaaagggataagagaattctagaagacataaaatagatatgacaatggatgcaactctaattaaaagtctgaggaaggacttgcacacctccagtgagtcagagcagccacctctccggtggttccatggtgtaatggtaagcaccctggactctgaatccagcaaccagagttccagtctcagcgtggacctttacctgaagtccaaataaaatctcttgctttggaagcccaaaaaggcaaactttggggtggaaagggagtgcctctgacaatacaaattatgtacgactataattttttaaagttgtattgtttctcacagactatagaaatctcgaaatgtgagatgctaaaaagaaataatttgtaatcagtactttcaaataaattaaatataactttattaaatagtatcattagagtaataaagcataataaaatgaatctgagggaggctaatgagaacaaattctgccatttttattaggcaataccttcaagtcaagttgaaagataacttttttttggcttcaaaaatattaaaagcatataagtttgctattagtaatttgttagtaattatttattaataaatatcttatgaatattatttgcaatattattagtgtatctttaaaatacttttaaagtgacatttttctcattgaaatccattgcaagtaaaatatgtatttagttaacaaaatcattaagtttaatttttatatag

SEQ ID NO: 1428 - DNA, 1178 bp, Homo sapiens
tcctgccttgaagagggaaaggagcttaaggtgaaagaagggcaggagaaggtcagagagagagagagagagattccattttctaaggcctgaagtgcccaactgtcataataaaagattgtaacaagaacaaggaagggcaatgggaattatgaactggtcctatggatgaaaacatatatatataatatatatatatgtatatatatgtgtgtgtttgtgtgtgtgtgcttgcgtgtgtatgtgtttataaaatcacacacaagtaatagctgatataggactagaacgcagaaaacatattcccgtctagtaatttttctgtatcataacaatacttccctttttgattaatttgctaaattgttatgattagatctaggaacaaaaactacagtaattatataagacttctaacatagagggaacatattatgaaaatatgagcatgcttcctccttttctcatatattttaatattttatattttttctgtaatatcactgtaaactgctcatgcaatgataagcatatacaaacagctcgagaagaagaacttaagaatcactaacctaggtctaattttgaaacaagaatgtttgtgggaaggcatagtcagccattctccctgatttgagattaaaaaaattgatatgtaccctaaaaagcctaatttatatagagttactattagtgatttccttcagcttttttaaatgtaattattttccattgtgtactgtatctttgaaagaaagagtatatatatttatatctcttaagtatatataaatataaatatgtatttcttgttgttgacaattatgttaaattactcaattcttgaaaattatttcttttaagctttaagaagtatctttcaattctagtaatccatgaattggatgagcaaattggtcttctcctgtacatattactcatgattttaaaggtcaagctcatcttcagtttaactacacagacacttaaagtctgcataatgtgcagtacattatgatagacaaagatgtatggggttgttgagaattgagggaaggcaggcatctttagattttgtttttctagttaaagttttatttgaaaaaaataggagggagtggaagatgatgttttttgagtacctattatttgctaagcaccttgttaggtattttatc

SEQ ID NO: 1429 - DNA, 1177 bp, Homo sapiens
aaaacttaagaatcaccatttgaccttttataaggtctgatgaaggtaaaggttagaggataaaagcttttatttaacagattccttctcagacaaattatggcaagcactggagcataaattccttcgtggtattccttcgtggtctcctagatactgctggtagttcaataaatacccttggaggccaaatcaggactgttttacaaaatgtgctgggcatattagtggtacataagatgattttagctagttcacagatgtacatttgtttcaatagttgaatattgaacatttaaaaatatatataaaaaaaaataactagaacatcacactcttgatttcatcgacataactgccaagaaaagtgagggtagcatatttacagtaattcaccacaaagcccactcacaggtatgaagaccagggatgctcaccagtacccagaggaccagatgattgatgggttctaccacgagcatctaatagcgactgctgcagaactggtgtggaaaaggtttctattttataaaagaaagtatccagaaggctaaaggcagttgtggaatttatttcttcccagtgctctgattgtcaaaatttgaataaagctcagtgaaaggaggacagtaattaatgacttgatagccaaacatcgtaatgatgatttagtgatatactagactggatgaaagagaggtcactgtcttttcactatggattcatcataaacagtatcattcttctcaggaagaaacttatttttagaactatattttaataaatttctcacattctaatatttaatttttattttttaaattttattacctgctaggtatgatgtgtaaaatgattttccatttatagtaatggtatagtttcctttttataaaaggtttataaagtttatgtaaaaagtcaacttaaaaataccaagttaattcagtcagttcaaaaagttttgaataattaaacttggaaagtcactgcaataaagccaaagcaagttaatggtcataattataagacttagctttttaaaataaaactctcaactgtgtctacccttttaattttttttctttcttccccctaactttacagttaaccgacagcgagaccaagtcaaacgtacgtacatcaatcttaaattgtttcattaagagctatgtga

SEQ ID NO: 1430 - DNA, 1250 bp, Homo sapiens
ggatacatgtaattttaaattattttaatgtgcaagatggaaaataatgactcagaagttccaaaatatggaaaagaatgtaggtaaaataatttagtctgaagtaggatttaaggaaatagtcttaatatagttgaatccagtaattggttcaattatgccatttatgccatttttatgtatacttgtactaatatataaagtattttatgatttgttttatcttaatctgaagaaatttctaactgctttaggcaagtgtttttatattttatactgtgatcacctttcaattattcaattataagaatactctgaagttaactgccttaaacatatattctttgttaaacatatattctttgttttacttggtaaaatctaaagtattacatgtgttgtgcttttaatttgtctagcttctactgaaactaaaattgatgtggccagcatcaaggaaaaggttaagaaagcaaagaataagaaactgggagctcttacagctgaagaaattgcacttaagatggaggcagatgaaaagaaaaagaagaaaaaaaagtaacatacccaaaactccttgactagaactatctccttttgtaaaggattttgagatatcaggcattagttgccttatttgtgagaaattttctgagggctttttttttttttggtggtggtggttgttcatagaagagtgttctttataaattatattattattgtattttttgaaaaatttatacgagaaagtggtatataagtctttgtatacattacgaccattgtgattatccattaaatccagtgtctgatgctattggttagtaatgatgtcccagcatttgatgttccctctctaatgataacaagtaaatatttaggtttatcccttttgaaagtttggttttacttttaacagtccatgaacagaaaattaaggcctctaaaatcagatcccctagttactcctctgttctgaatctggggaagtagtaaaccaaaaagacagggaaaaccagatatttagagtcgaagcagcatgcaaaaaataataatgtttttaactaatgaaggctactggagttactaagaatcacctaaaaatgtgctactgtaccttgctcattttgcagatttagaagctgaaacatgggttaggttacttactaaaagtccacctgtggcaacctgcaaataatgcttatttatactaaagatgagtttatctgatagagttaggaaatttc

SEQ ID NO: 1431 - DNA, 1100 bp, Homo sapiens
tgaaggccatgtgtatgagtatggatcaggtgattgggccacccaagaacttagatgagagaactgaattaggctgctggcagaacagaaaggacggagacagctgatggacggtgcttggatccacaattgtgtttgtactacagttaaaaaaaagcgctaagcactcattataaagcacttgctttaagctgttacacagattggtcactaggaggcatcagttcatcaactactaaggcgaaaaggaaggcagctctggacacccacctaagaagtctggatagttctgtgttaatacttaacgttttcaactcaaggacttttggaaactagaatctagaatatttcttctgaatagtacttcaaagatgaaataaggctaagaagtctaaactgcactctgtgagactatttgtttatttatttaattatttattttgagacagattctcgctctgttgcccaggctggagtgcagtggcgtgatcttggctcactgtaaccttcacctccctggctcaagcaattctcctgcctcagcctcccgagtagctgggattacaggcgctgtgggttttttttttttttgtatttttagtagagacggggtttcaccatgttggccagacttgtgtcgagctcctgacctcaggcaatccgcctgcctcagcctcccaaagtgttgggattacaggcgtgagccaccgcgcccagccttggttatcttttataccctgatgagggtaacgtgacatgttcataatttactgggctttaactttttcttgaaagatgtttgacctttggtctatccaaatctttaataatgatcattgtcatgagtttctactgtatattgcaaattggtttacagatcagaattttgtaatcattatgaattaaacacttaataactttccaagttctgttacatgtctttaagccagtattgattaatggacttttagtcaagtgtttgactatgtaactgccaagtaagaaacttaccaactcagttccattactgtgtttctcatgcttctaaatactcttactagaaaacagtaggatactagtttatataaacacctctcatg

SEQ ID NO: 1432 - DNA, 1174 bp, Homo sapiens
tttcctgctcttaataaaattacattgaattgatttttagaggtaatgaaaacttcctttctgagaagttagtgttaaggtcttggaatgtgaacacattgtttgtagtgctatccattcctctcctgagattttaacttactactggaaatccttaaccaattataatagctttttttctttattttcaaaatgatttcctttgctttgattagacactatgtgctttttttttttaaccatagttcatcgaaatgcagctttttctgaacttcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtgtttatgccatttttccagttccaaaatgattccattccattctagaaatttgaagtatgtaacctgaaatccttaataaaatttggatttaattttataaaatgtactggtgatattttgggtgtttttttttaaatgaatgtatatactttttttttgaagagtggagagtagtgatgtctagagggagctattttgtgctgaggccactatgttctgtaaatatataattttaagagcaacctcacaatccctgctaagtggagtttattatttgaagactaaaatggaattccatagttcctgataggttatattctgggttattattctgagttatctacaaacatttttgagatttgtctttacactctgattgtagtttccagcagcccatgcacactgccaagtaagtctcattttttcctgttagaaatggtgaaatatcatataatcacttataaagaaaactgatatgaaaaaattttagagttgtttgctttatggtcactcaagtagggtaagtgttccacaaattccacaagttgatagtttaacatggatgtctgaaagccacatatataatttcttaggattcttaaattagtaaatctagcttactgaagcagtattagcatcactattttagattgcaaaaataccttaattgtgtggaactggcttgtagagtggtacttaagaaaaatgggattctacctctatt

SEQ ID NO: 1433 - DNA, 1103 bp, Homo sapiens
ggcctgctagcttattttctttttgttaaaaacttggaaaagttattaaggaaatttaaaaatgacaaatcatttgttaacatggtgtgagaaaaatcatggaaagtaaaaagtaaagttgagcatttcttcccttcatcatataatttaaactgaagagtctgtcttttttttttttttttttcggttgcccaggctagagtacactggtgtgatcacagctcatttcagcctcaagctgctgggctccagcaatcttcccacctcagcctctcaagtagctgagactacaggcgtgtgccaccctgcccagttaattgtttattttttgtacaaacgcagggggcgtctcactatgttgcttaggttgctcttgaacttctgggctcaagtgatcctcctactttggcctcctgaagtgttgggactacagttgtgagccatcacacccagcctctaagagtcttacatgtgccaaattaagtaacacagttattcctaaattttctgcttttgttttcctttaaaaataggatgatgatgctgaagctatccttgctgcagacttcgaaattggtcactttttacgtgagcgtataatcccaagatcagtgttatattttactggagaagctattgaagatgatgatgatgatgtaagcgaatttgaatcctgcaaagaaataattggttgagggtatagtggtcagaattggtaatagattagtttagtttttaagaagcaggacataatataattcaaaattaggctaattactgatgttctgtatatagcttttctgggttttaagtatgtctccttaggatttttggattcatttatcttagcttttaattttctgctaataagattgttctgagtttatgaaacttttttatgtttggttagtgctatagatctattatgcccttgccttgacttcacagagctaggactttctttagtgcacaagaaaacatttactgggaggcatagaatttctattcaaggtagtattgaatgatggttaggttaagattaggttgcatatagatgttttgaatatgtttattgctcaacggcaattgttagagtaggcttt

SEQ ID NO: 1434 - DNA, 9129 bp, Homo sapiens
cagaaatactgtactcaatgcaagaagatagattcatcttcatgtctgccaacaattggcaccatccagcttcatagtgtttttgtttttatttttaaatcagtctaagaggtgtggactcattttgtcttatttgtattttatgatttctaatgagtttttagcttttctacataatgcttgaacctttttcgttgcccattggtaccctttttccactttcttgttgggattgcaacttttttttaatgctttgcaaaagtctttgtattccaaatgttattcccttgtcagtttttagacattctaaataatgtgtcatttctacaaatttatccatggagtcctctggtaaacagttaagttttattttagtaaaatattttgccctagggcttgtacttttgaaactttttaagaagtccctcctggtttctgctacatttcgtattgaatagtttcaccttttacatttaggtcttaaatccctttagagtctacctttgtattagttgtacgtaggcttccagttccttttttttctgcctcattttttgagccaggtttgtttgtttgtttgtttatttatttatttatttatttatttatttatttatttattttgggtcctcctccagtgacatgagctagttttttttttttttttaaacactattcactaatcaatccattgttcccccatttaggtgtaccacctaccttcattgcatatcaagttgtaaacacccgtgtttgtctttgagcagcactcttatgttttattggtctttgtctcttgtcattgtcatacttaattactatgactttatagttgtcttaatatttggcagggcaggttgcatcctttcatacttctcccccaatcatccacatttttgacagttaagtttaccagggttgtcaacaagcaaaaaaaccttaaaacgttgataggaattatattgcatttgtagatttacagaattatatcttttaatattgtctcatccacatacttctaattattcaggtcacattctgtgtctttagtttcaaagttatcctcatagagtctattggttaagttaatttctgtatattttgtgtggctgttgtgaatagcatcttttttgtattttctgtttggctgttcttgatttacagaggattgctgttttttttttttttaagttgctcttgtatccagtaactttgctaaatttattgtagtaatgtgttctgttttgccccccagtcacaagattttatctgcaaataatggcagttttagctctgttcttccacattacattataccacatacttttctttacaacattaccaggactttcactactgtgttaaacattagtattctttgtcttatttctattcatactgggaatgaatataaaatctccattaaattcagtgcctatttactgttttttaatctgacctttggtttttttttttaactgtatcaattaagatgctctattgaacttttcccttcagtatattaagtaaatagtaaatacatgttttggaaatacttattttggatatcaaactagccttgcattcctgtagtaaattgaatcatgatgtgttattgttacattgttgagtaattgaattttacagttcttacttgttagtgaaatgagcttgtgttgtgtgcatgcatgtatgtatgtgcataaagaaagtttcaggaagtggtaatatttaactggtttttggagtcaagatttcaattgcctaaggaatggagcagcttttaaaatttttcgtttcctgaaacaacttgcataagatagcaattagcagttcttagggtagaactcttctaaaaatttactttgggactttggagttggggaagtagaggtccaggggagttttggagaatttttttttttttaaacatactaatttattcaagttctctcatcagttttggagtttcatattttaaacatgtacatatttaggtttaaaattgattagtacatagtttacaatagttttaaaaatctggttttcatattctgtattttgcatcttaattctgctggttgtcttgatcttattaagtttttagaatattaattttgcttttggttttccttttccatactgtcttttgttactgctgctgttatctcttttttaggattgctctatgttattctttccagttttttaaattgaatgcttaattcatttgatttttattttttaatttgtgttttttatggccttaatactcttacttttgtaaatgttgagtgtgaagatctgtatgctgaaattaatagctcaagcttattgtattgttcagcttctctttatttctgcttattggttgtctgtttgacctgacagttttttctgtcatttgtagattgaaatattttggagccatattaggtgtatgatatttgtgatgaacatttcttgttctcttgtttcattttactgatatgtgtcttcctttgtgttttataatgttttttgggggggtcataatttttatttgtctgatattacaataataacccccagcttttatgacaaggccttactctgtgatccactctggagtacagtggcacactcatggctcactgtgatcctcccacctcagcctcccaagtagctgggagccacaggtacatatcatcatgcctggctgttatttttgtagagatgggggtctccctatgttgcccagactggtctcgaactgttgggcccaccttggtcttccaaagcgctgggaatacaggcataagccatcacccccagcctctttttttttttttttttttttaaacttttaacctagtatgtcttttttttccatcttttcatctgtgtgtcttcctctagtatcagtgtttgctgcttttattttttggatacagtgtctcgctttgtcatccaggctggagtgccatggcacaatgacggctcactgcagcctcatccttcggctcaagtgattctcctgcctcagcctcccaagtagctgggactataggcatgcacaaccatgcctggctaatttttgtatttttgtagagatggggttttgccatgttgcctgggctagtctcgaactcccgagttaaagtgattcacctgcctgggctccccagagtgctgggattacaggcatgagccaccacactcggcctcaatgtttgcttctttattattagttgcatttcttagaagttgtattgtttttggatttattgctgccatctttctctattttttaatttattttactttgggtctttcttccttcttttctgcttcccattggatagatcaagtcgccttctggttccaaagttaatggcattgatttttgttactatggtagtggcttataacctaatatctaagtttatttacccctgttgatttcttaaatttaccaatatttatattgttcataaatgtgctttctctggccctctatttttcccttcaaggaaagaaatttaccaagatatttgaccacacccataccttaaatagaatctgctggatttttaaaaaattttcctcaaaagttgcttttagtaatatatagtgagtatctgtggcaaacctgaagcctggtatacctgatataatttttgtcctgcttttatatctgaataatagtttggttatgaaatagtaaattcagagttcttaaaaactacaatttatttttttctttatttcagtgtttcttttaatgcctgttgttagtctgattcctttttctttgtaggttattctttctcactggacacctttagaattttcttttgtctgtgatattcataaatctcattaacatgtctaggaagcagagtaaggatttttatattgctttaatgctgagaaatgtatcattctcatatgtgaagagatcgtaccccttctctgtcagctattgctacttttgtcgtccatatctcagagcttttctattttccatctgtctttcatgctgccttctggtagaacttttcaacatcatggactttatcttcagtcgaatctatcctgtttctcttatttgttgcctattttagttattgtatttttcatacttaacattcccagtctgttgtagatttcttggtcttgttgcatgtcaatcttcctcatctctaagtatatttacattcttgtttaaattctctaattatgctgcttcagatgataatcatttcattcactctttcatagaaattgtacccttgaagtttctagttattctctgagctccagcacattaggcaataccagttaccctaataatgaatatttggggagaaatgaaggtctgtgacaaggagaagggcgcagggtgagcctaagtagtagagcactagttgccttacactgaaagtttgctgccagtccaggcaatttttatggtgtgctttgtagggtgggggactagtctcctttggttgtcaattcatcattcctagattggatcaaatacatgtttgaaggctttgaaccgtgcagctttcatcaaccctcgcattgggctcttgtgaagggtgaagatgacagacaacgattgttgcaaggcaggagcagaacttaaaaagctttcttgcggaactgctatcttccagtttgtccgcactgctacctgctgtggccattccctccctaagttgttggttaccctgtacagttaaacacaacctccagtcttacctgaaattgcttatggtgtgtgtgtgcctcagtagttacttcattcttgttctaaagtttctgggattagctttttgggggagcaagaaaagccagaagcccatgccagttcaccaccttggcagaatagtgcttttcacttaaaattaacagaaatagaaagttgatatcttcaagtgtttgttttttatttctaataatcttaagtaaactggtggctaagtaagtgaattatttgatttacaaaagtttgtggcaggaaagtttaacctggattttgtatctgttgcacagattccctgaagttatttaaattttaagtgtgaacatttattgttagagaggtttaatcattctttaggagactcataacctagtgtgtataaccttttaaaaatcagtgccccctgttcacattagcagacatggaatcaacctaaatgcccatcagtgacagatctgatacagaaaatgtatacaccacgtaatacttgcagccatacaaagaacgagatcatgtcttttgtgggaacgtggacggagctagaggctattatccttaacaaactaacacatgaacagagaaccaaatatcgtacattcttacttaccagtaggagctaaatgatgagaactcatgaacacaaagaaggaaacaacagacactggggttacttgagggtggagtgtgggaggagggagaggagcagaaaattaagtattgggtactgggcttaatacttgggtgataaaataatctgtatagcaaaccttcacatacacccctaaacctaaaataaaattttaacaaaatagtgcttcacagttcattgtatggtgtatgaactttatctcatcaaagctgttatttatttttgagacagggtctcattctgtcagccaggctggagtgcagtggtggtgcaatcttgctcaattcagcctcgacatcccaggctcaggtgatgctctcatcttagccttccaagtggctgggaccacaggcatgcaccaccacacccagctaatttttgtattttttgtaaggacagggttttgtcatgttgcccaggctggtcttgagtttttgggctaaaggaatccacctgcctcggcttcccaaggtgctgggactacagttgtgagccatagcacctggccctaaagctgttattttaaaaatacatgtctcctctttatagtatgttacacttgtatttaataatgtaattactaattcctaattaaatatggagactaaaaaaataatggtgtgtggaatcttgtcctttttcctgatatgtctatgctcccctcctttttcctaataacttgtatgggtgagatatatgtaaaagaaaaatccaagtaatcattgttctcagaattaagatggtctgtccatgacttcagcaatgacaagtccaacacttaacttgggtaaagatttagggttgacaatatgatttacattttgtttatcaatttacccagttacatttctacttttgaaatatagccagtggatcaatgtatttatatctatttgatttttatttactttgaatctaccttttgcttcagataaaaaacctgtcattcactaactccaatgcttcagtttcagtatgacaaaagaagtgtgacttccattttactctgatgctatataactgatttctaacctttcagcctgcctagggtagttaaaagacgagtgaatgctctcaaaaacctgcaagttaaatgtgcacagatagaagccaaattctatgaggaagttcacgatcttgaaaggaagtatgctgttctctatcagcctctatttgataaggtaatgctttctcctactttgtttaatttaacattctagaagacgaattctagaaacataagcagacttggaagaggttaatctttagaactctcattgaaattgttattagaggcagcacttggaggaactatcaataatagcagttaaagttgtggtatgcatttgttaaatttgtaagacttcttagtgagaaaccactggttttagcttggatgccagtgtttttatacagccttttttttttaaatcattttagcgatttgaaattattaatgcaatttatgaacctacggaagaagaatgtgaatggaaaccagatgaagaagatgagatttcggttagtaccaactttattttggtatgtttttaagatgataaaatcttaggacttgtcagaaatgttagcatttaatgatggagtacaatattatataaccagttgtattttttcattttttaattttacgtctttattacacgtttttctattactttatttttaaaaaacagtcattcaagattgtaatttgcatggcaataagcagcggtttcatgggttctaagtttcttaagtgtccacagcagtttaaaacaccacaagtcttatttccaatttgcagcacctgacttaaagttcgaattcatctgatggagcattaaaactgtcattttctcttgtgaaaagacataattgctatttccaggactgtatattgaacatggttgtacattatttttaattggttagtagaattttactcatgtaatttatatccagaataagaacctctagcatctctgaatggccttcctctcagaacgatgatgattaaatgtctaaaatgtatctggggtgcccccacttgacattaccaaacatgtttccaaataatcttagaaaatatgattctttaaacatatgcataccacatctttaaacataaacataccacacagtgcaccatcacttccttaaccattttccaattgttcacttataacatttgcaattttttattataaatcatattgtgatgaatactttcatccataagttttattgcaaggcttattgtttcttctaatgtcttctaatttcaaagaagtggcttactggttcaaacagtgcacatacgtggttttaaggcttttagtatactttaccaaataatctccagaatagctccaacaactcctaccaacagtatgttattgtgcccatagggtggacttgataacagcaaagcaaattcaaccacagatatattagattctcacccatctcaaaactatcacatcagagaagcaaggagacatattattggtgaggaagccaaattcaaattcttttaaaaaatcactcagctttagatcagtaaaataatcaacaaaaatggtcaccgcaaagtctaccgggtttttcaaaaaataaaaagagagaaagagaaaggccaggcgcagtggctcatgcctgtaatcccagcactttgggaggcctaggtgggccaatcactaggtcaggagttcgagaccagcctggccaacatggtgaaatcccatctctactaaaaatacaaaatattagctgggtgtggaggcgggtgcctctaatcccacctactcgggaggctcaggcaggagaatcacttgaactcgggaagtcgaggttgcagtgagccgagatcgcaccactgcgctccagcccaggcgacagtgtgagactccgtctcaaaaaaaaaaaaaaaaagtaccaaataaccaaaattttttatttgactaaattctgttcatgtatgagcatgacagtctctcctgtttatttgactttggcaataaaaaaataagcagccttgtacagaacagggaaaatgccaagaacgaaggcagtctacagttttactgtagaatacatatatatatatatatatatatatatatatgtaggcctctctccctttggccatatctactgtcagttcaggccattaactacagacaaattttcaaattcacttcttctccaagatcttcgatgctgtcatcatctacttctgtctgtttttcctgaatgacctcaattatgtcatctgtaaagtctccttgaatgataatttcatcctcctctgttactgaggcaccacaggagaatttttgagcaaaaaatctttgtgtgatttaagatcaatttcaaaagttacaaggccacaacccttgtcacatatttctttgctctgggaattttggctatagtaaccttttgtggtaccgtctttgtttttttgttttatttgaccccttccacctctcttctgttttttcttctcctcttcttcccctgctgttccttgaccttgacagattccagcttcttgtttgggtgaattttccacagtaagttttgcatattcatttggaaaattcttctctaatcattgtctacatttagcaacatcaggcatatattcacagtactctattggtaatgaacagactccacaataaaggactcaaagtaggtaatcagcatctaacttggctctgtt

SEQ ID NO: 1435 - DNA, 1149 bp, Homo sapiens
ttttaatgaaagtgtaagcacttccagtgtgtacttgtttacatatgaagttagaaaacggaattaccttttgaatttcctatttcatgtctttgaaagagatactaattttgaaaatgaattttaagtttttctgtaactttttttggtaattggtacatttgaaccttggtgtgatactatgatattatagcaaagaacagtctgaacttgatcaagatttggatgatgttgaagaagtagaagaagaggaaactggtgaagaaacaaaactcaaaggtattactttaaattacttcaggagccagtgattgctggcacatgtctactagagggtagttataagtaccagtctatttttttggacccttgctcattgtcccatttatctactggtccatacttctagtgtgtgtgtgtgtgtgtgtgtgtgtgtgtgtgtgtgtgtgtgtaaggggcgggtaggtatagatacagcaactcaattagaagtcattgtttgcatcctgcactgttggagtgacttggtgtacttgtgtcaaacagctgcccatgagttttgtctgaatttagaaatgttacaggttgtgatgtggtgcttataacagtatgtttagtgtttaatatatggagaacatgtagtgtgtgtctttttaaagatccactccttcaagcagaagagccatttattaaatgtaggtaatattcacaatttattttagcagatatttttaaaaggagtggtggtgggggattgtactacttagggtatgtcttgtagatctgcgccaagaatattaaggtaccagatgactcagcttttcatttttaagccggatggaagttaattgtgaaaagacttcagaacttgtattaatagcttcagcttttgtttagtaacattttcttaacagatacagaactgtatcctcagtgaccaatattgatatttaaaaatctgtattggttatcctggctgtgtgtacatcatctagtaattgaattattatcagaagtaaattgacctcaaaaaaagtaattgggaaaattaagtttatggcactttgtgtaataactgtattgatgatgaagagaaggttagtactgtaatttgttttgtataagtctagtgcatatttggattgagta

SEQ ID NO: 1436 - DNA, 1166 bp, Homo sapiens
gaacacttagtatgagtaaaacagatctgttggttttcattacctcatctattttaagcttacaataagcattgacctctgaaatgactttagtattccagacatattttctaactttgtgtttcctaaattggacattaaagtttatgtttgaggaaaaaactcagaatcagatctcaaaatgttaaactgtttctgtactcctataatgtgtaagtggcaagaagcaggaaaatcagtaacttaccaaataatgaaaaattaatgctagagagcattatatagtaaaatttcatttttttcctttattcagagttagtataaaatagctaaagctagggaaatagtataaaatagctaaaactgggaattgaaaataagagaggcaaattttgaaggaaagaccagaacaatcaagtctatttagcttaccctatttgaatacttctgcctttaaaatagattgatatagttttcattttgtaaatacattgaataagttgcatgtaaatttttcaaataaaaattgcagtatgagaataccaagttttattcttacgtgtctgtaaaggggagataatagtagcactgtctccaagttcttgagaaaataaacacctgaggacatacctgacatgtaaaaagtgctaaataagtgcaccttatcatttctgatgacttctaaaatctaagtttatagccaaattgattttaaatatggattcacaatttttttttgtttttattgtctgtttttgtgttgggttttgttttgttttgttttgttttattttgagatggagtcttgcactgtccaccaggctagagtgcaatggcatgatcttggctcactgcaacctctgccttccaggttcacatgattctcctgcctcagcctcccgagtagctgggattataggtgcacaccaccatacctggttaatttcttaaatttttagtagagacggggtttcactatgttggccagactggtcttgaactcctgacctggtgatccgcccgcctcggtcttccaaagtgctgggattacaggcgtgagccactgtgcctggcctgtggttttttttgagacatcgtctcactgtgtcacacccagactggagtgcagtggcacaatcatggctcactgctgcctcaacctccca

SEQ ID NO: 1437 - DNA, 1199 bp, Homo sapiens
tataataattgcataaaattgttatactattaatgctaattataatagtatgtacatgcctggcaagggtgtaagtgcttgataattgataactatcagatgtggaagagatgaaggaggaatgaatgttcactctcacctgagattccaatggctcttcccacttcggctctcccaccccatcctaaccatttatccaggccatacctgggcgtctaactctgggatgagctaacacgtgctcagcaagtgcgctttcgtatctgcctgaggagtattatctcattcttgatttggcatggctgtctttgggaaagtaaagggtcaggagttggtagaatgtgctaacttcgttacgtttcttttttattataggggaaaagcctttgccagtaagagagtggtgcctccatcaagcagcttggaccctgttgctcctttccctgtcctctctgttgacccagaatattgtgttaatcctttagcccacccagtattttctgttgctcagacggacctgcaggcattctccatgcagaacggtctgaatggacaagtggatgtctcacttgcttctgcagcctctgctgtggagagcctgaagccagcactccttgctggccagcctctagtgtatgtgccctctgcctcactgttcatgctgtatggaagtctgcaggagggaccagcgtcagggtcagggtcagagagggatgacagaagctcagaagccccagccacagtagagctgtcatctgcaccctcagctcagaagcgcctctgtgaggagaggaaacctcaggaggaggatgagccagccactaaaaggcaaagtagggaatatgaagacggcccgctgtcgcttgtcatgcccaaggtaagggagtgcaggtggatgtgtctggtgacatcctgttagccctgagcttcttcctaatgaagatacactgatattaataagcaatggagtctggaatatggagctgtttcatgtcacttgcataattaagcactggagtggctctgccaaaaatcttgccttaaaatagtgcataagaaaggtgatttttataaaactcacactttctataaaatgctaaaaagtataaagaagagttacccagaatcccaccacatagaggcatcactattaacatgtttatatatttccatccagtcttttttacatccttttttta

SEQ ID NO: 1438 - DNA, 1152 bp, Homo sapiens
tatctagaagtcctgttctcaaatgccaactctgccagttattaactgagaaagtcacttaacctttctgatcctctccttcctcatttgtaaaatggtgatgatgtctacttttcagtgtgaggattagaggataatgctgtgtattataggatatataatatgtgtatatgagcgtgtctctggcattgataaatgccagctaaaaaattattggttagcacataaggaaaactgctgaaaatactaaaaactgtatagattatttccttcttattgacttaaggttcagacaccaattcttgaacaagaatattccataatacgctgattagaagttaaatggtagtagtagaaaacttgatggctataaatttgcattcttatttagaatcaatgctcccttccctattattctatttaattttagagaaatggcaatttttaaataccctaacttcacgaatcttctgaagaacagtcaatgtatcaaaacagataatcaaatgaagacaggctaattccagcctgagtagttaaaatgtggcatatttataactcataaatcctaaattatcttaagcccatctatttttttttgctgattgcctaaactgaactagttttccatgattaattttagggcttatgatataaaaagagagatgttctaaaaatcatgaactcattgcatttctatatttgcatcttatctttccatcaaagaattggcaaaaagatttcattttggacaactccattactcaataaatcatcagataaatggataaacaaaatgtgatatatacatacaatggaatattattcagccttaggaagaaaattttgacacatgctacaataaggataaaccttgacaatatacaaaataacctagttacaaaaggaaaaatactgtttaattccacttatatgacgtagttagaatagtcagtttcatcaagactgaaggtaaaatagtgatggccaggggctgcagggagggggaatggggagttgctgtttaatatgtacggagtttcactttgggaagatgaaaaaattctgagggtggctgatgctgatgatcaaacaacagtgtgaatgtacttaataccactgagctgtatactttcaaatggttaaaatggt

SEQ ID NO: 1439 - DNA, 1109 bp, Homo sapiens
ccctagtcaagcttccctttccattctattcttcaaatacttactatgcttacttctaaaccattaatattccaagctgtgtcctcactctcagcatacaattcctttctcattttatagagatacctccacacaatttctcatagaatagatataatggataaatatttaggtaatatgagattatatgaggaatatataattcctcacataatattcctcatataacagataattcctctctcatacatttcccttcagaaaatagaggcaaacaaacaacaatctccgtgatagctggcacttttcttccacttctaactgccctatacaaagtgcaaaacgattctcacttcataaggattccaaccacccttccatgccaatagaagaggtatgtctgtttgtatctcactcctttccactgccaacttcctatgtcctaaaaaccattcagagtcctgcatctccctctctcctcctgatcaaattctgtaacatatctacatcatcacttagaactgcctttttgacccattgaagtctggtttccacattatccccctacatctgcacattcttttctcgcaggtcatctaaagtcttatcgttcaaatttcctaagtttattttaatttctctccctttagtagtatctgtcacagttgactaatctctccttccagaaaatttctcctctcacttctcctgtgacatcattctctactgttcttctagctttgtgctcactcttcctcagtcttctttgaaacttcctgaatacacacagttcttttctcagcccttttactatctatacatttctgggccatgtctcttttatgtggtttgacattcaactttgctgataagcccccaatttctctctcctgaactccatatcattttctcccttctctcgtcagcacatccctcgtactttttgggacaaatgataatattacatctcctctgtactgccctgctgtgaaccaggaacttgggagtgctctgaggtttgtttttacttcaccacagacatctaatcaaggtgattctacagcctaaatagctctcaaaccatcagctcctttctatactcataatct

SEQ ID NO: 1440 - DNA, 1165 bp, Homo sapiens
tagaaatataaatgaaatttgtacttgttgaaattgcagtaatgaacaaattaggattattttattttctctactgctgtacatgtttgaaatacagaaaaaaattagaatcttttttttttttttggtgatacattcaagttaataaaactgattctcgttgaggggtatggatgtgatctaatacacacaataaacttgatgataagtaccttggagaggataaaacagggagataggctatagagagtagaggctgcaaagtggtggtagcactttagggctggcaaggaaagcctctatatggagcaaggtatttagttgagatccaaactttggaaggagccagttaggtaaaaatcaggggaaggagctggggtaaaaatgttctaggtaggagaatcggaagagattgtggggagaaagaaaacaaaacaaaagttctaggtggagggaacagacattacagaggttttgaggcaggaaacttcaagtattcaacttaaagcaaaagttgggtaggtgagaagagataaagaccaggtcatggtagagtttggagtttaagtgcagttgggagctgcttgttggttgaagcagaggaagtacttgatctaatttttgtttcagaaagatcagtttaggttgtaggtaaagaatgggctctgtgtacgggaaggagagggcagaccactacagcaatacaggagagagtgaccaggtgggaggtaggggccatggagagacgggattgcgtatggaatatgttttagaggtagagctgacagcactttctgtgagaagcagagcaatcaaaatgataattaggttttcctttagagcaattgggtggatgctgatgccattaactaacaatacttttcactgctattcgtgcagtaaaatgatgtcatgcagaagtatagctttttaatatttttatttttagagatagggtcttgctatgttgcccacgctggctttgagctcctgggctcaagtgatcctcttgcctcagcctcccaagtaactaggactacaggtgcacaactgtgcctggctgtgtcctttttgtagaaattatgattgagcctctttataaataatcttaacattttgagtatatgctaggcattgttctaagttcattacatgtataagctta

SEQ ID NO: 1441 - DNA, 1177 bp, Homo sapiens
ttttttttttttttttttttgagacacagtctcactctgttgcccaggctggagtgcagtggcgtgatcttgaatcactgcaacctctgcctcccaggttcaagtgattctcctgcctcgacctcccgagtagctgggattacaggcacatgccaccacctctggctaatttttgtatttttggtagagacaggtttcaccatgttggccatgctggtctcgaacttctgacctaaggtgatccgcctgcctcggcctcccaaagttctgggattacaggcatgagccatggcgcctggcctctcagataatttttattagtggtactctgcagattcctgtggcatcagtggattgattaccactgtggtgcttctaccttgtagtttatagactgttcctaagcaatggtcaatattctatgccaccatattctgagtattgtgcatttcccaccgttgtcagaaattcaccaactgagcaggacccctgatgccagtctttattctgcattcacaggactgcagaattctagccatggtgcaacttctatttttgactgtccttttgcaggacaagcatatgaaaattctggaccaggattctggactggtgtgggaactggaggaatattgggtatttgtttggcagcagtatatcagcagcactctttttagacatgtggcacccgccccccatcttatcctccattgtactctagcacatggaataatcatcctactgcttagaggaggcccaggtcaaactctgacccgagaacaacaactgcctcagggtatggtggtatcagaagatgataaagtagaaaactgaaggaaaatattggttgcaaaatttctgatttttcttcactttatatttaaagaaagtgcatcctgttaacaattgtggaaagggaatagtaaacagttgtgttctttgagagttaatatataaccaaatacttgtatattgtaagttagtgtagcatgcatatgtgtatctcagtttttgaaagtgttgattactgtggaaggctgaaaatgtattgttttatttctaaaacctgtgaagccataagaaacattaagaatgaaagtgttgtaccaatagaaagcagataccaaaaagttctatcttaggtggttttagttgatgagtcattacctcattgaga

SEQ ID NO: 1442 - DNA, 1167 bp, Homo sapiens
tctatccttgtcttttatcttcaaagagattttccactgtacaaatctctaaaattgagaagttagaccagatggtttttgagagcccgtctgggttctacaagtataatgcacatacttgtagcacttggtgcttttgtttcttagggtaaaagctgaacacattacaatgttcttcaaggccctatgtaatctgtcatgacccctttcatctagcttcagtttctacctctccactcatccttaacacttcagccacatcccacttctcacacattctagaacattctaaggctagttctgtcttgatttaaaactcctcttccctcagataactgaatgactgggactcagtttcctcagttctcttctgaaatttcacattatcacagaggacttccttggccacttgatgtaaaagagtaatcaatccctctacctatatctttctctgtcttcctctagccacaaagccatgtcactacctgacatattaaaaatgtttaatatttatatttattatttgtcacccttctgtagtggatgatgttagttttatgcccagatctctctaatgaccactcaggaatgttcctgtctcccttggaagcattaccctcaggccaaataggaggtgcctctccagtgagggacaggagtacaaaagtccagcccccttgcctcagagtacagctaactgtggtacagtttctacttcagattttctccatgggatcaatttgacggtagtctgaagctaagtccatattcttgtttaggtttttttttatgttttgccttgtccttcttccccattcccctcctcctgagagcactttgccattgcatcacatatacaagaatccacatctcagattctccttacatggagcttgtcctaagacacaatcctgaaaggtaagcttcttgaggttaatttgtttctttcattcactattgttttcctagcacccaggacagtgcctggcatatattggtgctcaattaagtaattttgaatgactatattagttttgaaggccctaactattttaggaagagcagcacactggtttatttgagctctcattatgcttctgggtgaagatagtcatataaacaaataacaaaggaaaataagtacacccagcacctttaccctcttca

SEQ ID NO: 1443 - DNA, 1207 bp, Homo sapiens
agaagttgtttgttgagctcatttggggttccatttgtaagaccatctgtaacttgatggcctcgatcctagaggaaacagatttgacaaggaggttaaaaatatagggcccgaaggtgagtaatagcaagatggctgccacgggacctagaaaggggagaagccaggttgcccaactccagaggttggtataagagtttgaaaggtgttgtttgatttcagaagccttttcctgtaaatgctgggtggcacctcatactatccctgactggttagtgtaaaaacaatacttttcccctaagaaagtgcagagtcctcctttctcagcagtgaggaggtctagtccttggcggttttggacagtcactgctgccaaagagtctatttgggattgtaaagagaagaccttcaattatcaattatagttttaaatttaccctggtttttaaagcaatggggtatactgttttttctttactatttctatctttttctctctttgactccttctttgtctctctctttctctctctgtctctgactccctctttgtctcttcctccctctctctctctgactttctgtctctttctctctttcctttctgctggcctttccctgcctctgccagccgcttatgctgctgttctcctctctccttcttctttttgatggcttcagctgtgtaagactgccacctccttgggtttttgcactgcatgcaataactccatgatttccttgtggtatttgatgggggttcccccagaggttaggaactccctttctttccatattgcaacatgggcatgtaggattaaatgaacacacttactatctgtagcaaagtctcccaattacaactgaggaggtgggagaaatacctggttacaggctgtcccaggattcctcaggtggtaacagaccttgaggacagtcatccaggacaggagattagcactgagaaggccatgtcagtgtccaggaggaagtcaatttcctggccctcaattgttaaaagtacccgaggctcagtgagggtgatgacgtgagctggtgcctgccccaggcaccctcagtcctgttgttggatcatctggttggggcctcctggcccggagaatctttgccctctggggcagtgtgccttccaatgattgccttggcatagtggacatggacaagggggcggcttgtttctcgttgg

SEQ ID NO: 1444 - DNA, 1546 bp, Homo sapiens
gttgtcaggtgatttgtatgtatgagaagcaccgggcactgatattccctgtaaaatttattaatttatttctagtaggaggctagtccttgcatcacctgggccttgcttcttaaaaatgcagattctcaggcccagcctcgatctggaatattcatttttagccagtatgtcacatgattttcagggcagttgtttggcagactgctacattaaggcttaaaccagttgaagaactttattcttcaaagatacttgcatttcaacaaggaaggaagcttttaaggaagagaaaaacaaccctcattgtggttttagtaagcattaaggggaggacatgaattcagcttatatgtgcctggaatcccatcacaaagctacatagtaacaaagcttctgagaaaggcagtatcttatcaatgtcatattttttctttctttctgtgttttacatttgattttttttaacgttttgttttttagccgtgctatcaagactaatcaggaccttctcccagaaactccatggacgcacattttctacaatgatttttgggggactcttctaacccacagtggcagccacaagtcctaccggccactctgcactctttcttttcgcctgaaccatgccattggagggttgaatccctggagctaccatcttgtcaatgtcctgttgcatgcagcagtcactggtctcttcacaagcttctccaagatcctccttggtgatggatactggacattcatggctggcttgatgtttgcttctcaccccattcacacggaggcagtggcaggaatcgtgggacgagccgatgtcggggccagtctcttctttctcctctccttgctctgctacattaaacactgttctacaagaggctactcagccagaacctggggctggttcctggggtcaggactgtgcgcaggatgcagcatgttgtggaaggaacaaggagtgactgttctcgcagtttcagcagtttatgatgtctttgtctttcacaggctgaaaataaaacagatattacctaccatttacaaagtaagtgattgttggctcttgagcattggattactgagtaatctacttgcttactcctttgccaccatttaaaaagcaaatttattcctctgcaagcggaatttaaaataagttcctttttgatcttcagtaagtggaagtgtccttttgacctttgtactaagcagggttttagtcactgattgttttatttctctggtttcttactttcatgatttcaagggtggtagaagaataattttgccttgtaaagaatatgcacctttattatttattgagttcttatttctatatttctgcacaaattgtctataatctgataaattgtctataacgtgtatttgtaaaaaataacacggctgataatagagctagatgctagactttacaggggaaatcctctgccatttgttaatattacttttcctgagttgactttggaaaacaatccttccctttagtgcactgggaagtcaaattcttaaacaatga

SEQ ID NO: 1445 - DNA, 1206 bp, Homo sapiens
gactgtggcatgtggatacattttaatgtttaatagtggagaggattatcaaatacaagtatacttaaggcccatgaaattctcaaaatagccctgtaatcaacactattgctttgtcatgaaacaatacattttttttaacttttaattcttctgttttcagaagactattacaaaggctaattacaatgagagcaaaaaaactaaaatataaggccagattatcaggtttttttgtgtgtgaatataaagaaagtcagtacatccataaatggttctttagattaaaggaggatgtttttaactggttttaatcaaatgatttatatcgttgtttaaaaagcattatttgtcatgttagttatatatatatgtacatgtaactcctcccatattcttacttgaatatcacttcattaaatccctacttaaatgcttcattaaatgacttctatactgtcatctctgtgcgtggcttccagggatagatttataattacatagattactcttacaaggaaagaataataacagagaagttggttcacaattggatggtgacatccaatttttaaaatgaggacatttgaaaaaagtagaaggactattttttttagcttttaagatgattgtagattcacctgtagttataaaaaataatacagagacattttagttgaatgtcataattcaacattcatgttagcatccctaaagtacttgttttgtgatgaactcaagaaagctgacacctacaaagggaaatcaggattcaattgactattggtatatttataaaataaactgaaaccaatctgcaagagccttcaatgcaaagataatttttaaaagacacctcaatttgtgtgacaaggttaggtactgttacagagataaggactttttgttcctcatgaataaaacactatgctttcagccacaataaacaatttgcaagaatgggaaagcacaaatacagacaggcaaattcatcttgataataacagatacttttatcaacaaggcattttgctacatattaaatccatgtctgaaattcaaggtctaccaatagaaacccattataagtgtattacaaaataaagtccttgttaaagacatcacttatgattttttcttagttgccttagtgctagaaaccagtggaaagtttttgttatatactggcagtgaggaaatctttag

SEQ ID NO: 1446 - DNA, 1128 bp, Homo sapiens
taacttattaccactcatcatcatatactagcaggaatggcaatagtagtagtagtagcagcagcaatagtagaagtagtcataataacaataataataaatgatgataaagatgtttctgacaagaattagggtaagaacagtaattgaagccaattatttattacaaatgtattttgctttgggtactgtgataactactttttatactttatcccatttaattataaaaaccactcttgagaagtaatttttattttcagaaccattttacagatttaaaataaacaggtttgaggaattagtttaacttatccaaagtttcgtggctattaagttctagtatttggagtcaaatgcaagtctgtctaaatctagagcccatgttctttaactgcaacactataatgtctcaccccgtcctagtcccaccaattagtcaactcttttagggcagaagtctgtctaattcatctttgcttcctgttactttatatttaattaaaaattttagtgactttttaacttgtaaattgtagctgattttacatttatcttcctgaaggaaactctgtatcattttgtcttttgaatttgtgaatatacttgttaacacatctaaatatctttaagtctttggcaatgttattgtattatatgactaaataacttcgaattgttcaattgtgtatgtcttccactatgtcagagccacattcccgtcacattataaatgaaggagtggattcttaaataagacctaaccatatttatatgattcctaacataatatcatttggtagaaagaaaaccaactgtggtcatccagagaagctcaaaaactcttgtactcaggttctcttactaccacgttttgtttctgtttcttcttagtctgtgtcttagcatcacttaaagaactattcatccttttcttatcacagaatcttggggttgttcttctcatgtcatgtagtgtaaatttatatagaaaatgtaatacaatttatttagtacatacatttattattttaatgagaatgcctcaggaaaagactagtatttgggcaatatttgaagaaagaatttaacaggcactgatggggagaaagctagctgtaggtaatg

SEQ ID NO: 1447 - DNA, 1101 bp, Homo sapiens
gtagaaaaacgttacttaattagttgttttggagatgctttaaaattaagggaaggttgttacttacatattttcatgtttagtatttctatgaaatttgatagtgttgtttcttctaaatagcactaatattaggatattgactataaaatgctatcatgaaactatttttttgttacaccgtgctattttacaattaagtaaaaaactaacaaactcactattcttttaaaaggcttttttagaaaaatatattaaaaagtactcactatataaaatcagtaaatatattagaaatgtaaaccagggttagaacaacaaaatccactttgtagttgtgattacaaagaatatattcatatcaaggttctaaggtaaaaaataaataattttctacccataacttactgtagtacttgaatttattacaaatatatatccacagtaaaaaactcttagtatttatgtttatgttaatatatatttatgtattttcccttctccttcctctctactgcttttaattccttggaaaaaaatgagtattaaatgaattaggtttcagtttggaataaataagacaaaaataaaacttttctctaaaattccaaagtcatgggataattaagtgttaacatttatttggttagaaaaacatgaaggggcaaacgttcaaagtgaagtgcagtaaatccgctgtacttccattcatgctaatgggaggtagttggctaagttccctggacagagttccctggacagtgctttgaacacacccctaatatttaaaaaaaaagtttcagagaacgttaaaacatgaaatgtttttagattctccactccttttaaacacaacaaagaaaaaaaaataaaggcagtcaatctttttctctttctttttaaaaaacacacatacaagaagggtatgggaattatttgtttctggttgtaaagcccttgaatattaaacagaggcctacgaaaacaccgtaaaattatatggtgccaggtattgtcattgcagtatctatgaaatagttcaaaataagagtagttatcctatttaggaagaaaattaatatttttttacttccaaaattg

SEQ ID NO: 1448 - DNA, 1146 bp, Homo sapiens
tgccattgaattacttaatttaaaatactcaccttaatcctcttgaagagtaaaaatttttctgtttttttctctttgttttaataagctgcggattttatattcgtaatttattgagttgggcctctaaaattccagttttgtacttaactgacttatagattagtctcctaatgctctgctagtcaatggaccaaaataaaagaaataatttattacatattcttcctaaatctagtaccaccatacatgtataattctaaactgtaatatctcaataaagtaccttaattaaattttatgttcatcataacaatgaagtttctagcatatgtaatagtcttataaataagcatgcaaataactgctgtcaattagaattagtcagtttaaccttattaagtatcaaatggctattgtacatatgatgtgaaaaataaagtgaattttttttggctaataactaatctaaaattcagatgaagcattttaaagggaaaaagatactttaatgatttattataatttaatcattgcagaaactaaaagagaaagaatctgctttaaggttagcagaacaaaatatactgtcaagagacaaagtaatcaatgaactgaggcttcgattgcctgccactgcagaaagagaaaagctcatagctgagctaggcagaaaagagatggaaccaaaatctcaccacacattgaaaattgctcatcaaaccattgcaaacatgcaagcaaggttaaatcaaaaagaagaagtattaaagaagtatcaacgtcttctagaaaaagccagagaggtattttattatattatgagttatgctgttatccattagtttttttaagcaaatgctaaatattattttaccctaaagtggtatttcttttcttgctttcaaatgattctatttaagaattgttacttgcatgtgattggattacacctctgtcagtaaaactggaagtttgtgtacatgtatctttctattatacactgactaaaccacgagtagctatcatggtgaaatcatatgattttgaaaaatattttaattgagtttataggtgaggattgaggcaatagggtggaatgaaatatatcacaccggtaatcagtagaaatcagatttgttagaa

SEQ ID NO: 1449 - DNA, 1242 bp, Homo sapiens
aaaaaaaaagaatagtatcacttgaaggtagaccataataacttaaagatatatactataaaccctaaagtcacaactaaaaaatataatgaagtagggagtcatacataataagacagcaaatgagataaaatgagaaaaaaataacattataggtatagcaagtgtgaactttcacagtcaagaattaggttttccaaaaatatggtactcttgtctgctacttagctcatgggcccatcttaccttttcaaggaaccttagccacatgtaacttaaaatgcatactcttttaagcaaattcagtccatccaagtctttttcattccttcttccctgatgtgtccctgaattaatccttgttcctggggatattgttctgatgttattgagagcaagttcctgaaccagacccttgtgtctgatgttaactctatgttaactctgttattacttatctgccacaggctggttgcttaacctttttattttttggtgctttttcacctgtaaaaaagggggtaatagcagctactttgaaggattactgtgaagagtcaatagataacatatgtagatggtccgaaggtagtgagttatctcaattgattattcagtcaattacagatcaaactccttgtcctactctttccccattttcactactgcacttgatgtcttaacttaaaaaaataacatgtgaaagcacttagtacaatgctctttgcttgtcaagccctaaatgagtgacatttttattcttatctgtatatagtattctctgctctgctgcagccacataactgttgattttgcctttcgtcttcatgagatgccaccagctcagtcagtaactgcacacttcctttgtaggtttcagaaatatttttgcagtatttacaggctgggatgttccaggattcagtggcacagacttccagtccagcttcctggacacttcactccaccactgcttctctatcgctctgtcagaaacatccactcttcccaggccaaactctacaaagcaggatggaaattctaaccatgtttttctgggccaccaggacctgactttctaactttcaaactaatattttcgattggagctttttatttttattttttatttattttatttattttttttgagacggagtcttgctctgtcacccagcctggagtgcagtggcacaatctcatctcactgcaatctctgcctcctgggactacaggcaccca

SEQ ID NO: 1450 - DNA, 1132 bp, Homo sapiens
ttaggcacgttccaatttaattccaaaaatactctgtaattctacatctaaaaaaaccgattccctaattcgaatttattggtaccaaagctctctttggctatagacaattaagagttgaccttttaagttaatgtatatgcttaaaaacagttttaggaaaatatttggtagacaaagagtttcaactttaaatgttcactatgtcatttagtgtccaactttacggataggttgactatctaaataggcatttttagtcattaaaaaaaatctagtcaccaggaggatccctatgactcaaaataacttgtttgtaaaagaaaatttgtttacttacccattagtaagttcctgcatattcattataagatggcaaatcaaacttttctaggatgaagacagcttatttttaagttgtatagtcttagttggtttagggtctcaattttaattaataaaatacttggtttttatttgcttgtccttttgaattcctgttttaataattttaaaatgagcacaaagaacgttgaagttcagattaatctcttctgaatgatgtttttttcctctgtgatgagttgtttctgacttttttccttttgtatttgtaatgttgattaagatgtaaaataaaaagtgtgcctgattatttttgcaaatagattgtgattattttagcctatgggaacatactcctatgtatacatttataatggcaatggaagtaagttcagcttgcagttcttttacttatttgaaaattcagacagtggatatttaaaaagtcaaaattcccatattattttacaacgtgtcattaatcagcaagtattctgaaggggtgttagtaccattattttattaactactcatgagcaaactagaaatgatctgggatctctggggcccacttggaccactataaaaggaagcaatgggcacctggacatattagcaccaatttcactaccctgggtggaaaacaaaaatgtctgtcctctaaaccacatatcctcatatttccccggtccataaatgaaattcccttccaccagtggcctgtctcttcctctttagtgattcctaaatccctatacccctgtctctccttggccagacacactgc

SEQ ID NO: 1451 - DNA, 1132 bp, Homo sapiens; identical to SEQ ID NO: 1450

SEQ ID NO: 1452 - DNA, 1145 bp, Homo sapiens
catctgcccttaataccattgtgataattatgtaaagtggtatttctgaaggcactatgaaggaattgaagcttctcactgcatttaagagaacagtattttaatgaatgtacttttaagccataaaaattggtagatttaattttgaatgatttagtataaaagttaagtgaaaacaggaaaaggaaattaaaattaagttccactctgtattaggaaccaactataaacttcatacatcttatatcacttaattttggggtcataagtgctcctattttacagatgctgaagccaaggaccaaagcagttgggtaattgtcaaatttcacgtagctagtaactggcaggactgagattagaatccatgtcattctcaccccaggctcctttctaccttacttttctatatccttctttaaaatgttgatattagacaattgctttgtaattttattttagaatatcgcagtctgttttacattataaattaaacgttcttagagaaacgagatactagctactaaatgtttttctcttatagccaccagagaaagagggtggattacctcgtcacgttggtaataaaactgaatgtgccttgttgggacttcttttggatttaaaacgggattatcaggatgttagaaatgaaataccagaagaagcactgtacaaagtctacaccttcaattctgttaggaagtccatgagtactgtcctgaaaaattcagatggaagttatcgaatattcagcaagggtgcatctgagataattctgaaaaagtaagagtaaaatgcttggatgaataaattgctgactatagttgctttatggagtatctactgtgttgttattgttgttgtctttttgtgaacatcaggcatttgataggacctcagagttttttagcatattttatggtatccagatatttgcccctgctattctgccattttcacactctagcttctcttatttcttagcattttgttatagggaaaataagctcattacattcaatctggtatgtttaatgaagtatactttgatgtttatttttagaagtcgatttacttgttatttaatatgcagaatcttgaaaagcctcctgggaagaaaatcaagtttatgtctttctttc

SEQ ID NO: 1453 - DNA, 1172 bp, Homo sapiens
cactttattaataagacttttatacagaattactcttaatgataaatcttccaaaaaaaaaaaagatttgccatcattgaggatattttctttaaaaagtatcccagagtataaaggaaatttcaaaaaaggagagcaaatgttttaagcaatggcagcattattagaatgatttaagttaattcttggtagaaaaataaacatttattaggctatatatgttctggtatttattttgaaatatctgttattgctttatagtcataccacatagtaagcagcatataggacagagtttagagtatcttagctattcagtaaaagcttaccacaaagaatcctagcatacagaaagttcataactggggtttctgcacattttatgcctaaactatagaaaagtaaagcaattgataggaatttattcaaaagttgaattctaggtttgtgttaggattagtaggaattcaattcagaccattacaatttctgtatttacagtatcctacaatgacatttaatatttagaaaacatttgctaaacttttgatattcagaaaatatttgctaaacttctgtatacatgactttgtgtgtactatgtgtatgaggaaggataggagatgaaggtgaggatacaaaaggtatctcccttactagtttctaatatgtatgtttaaaatagacaaatggaagtctacaaatatatagcaagttaacaaatagataaggagtaagaagccgtattaaatatgggccagatgtggaataaggcagccccagagctgcaaattgggaatttagtgtttttaaattccctctcagaggcatgatggttgttagtgcatttgtctggggccagaaaggcaggccagatggaaacgccattttacagttcatttccaatgttttgtgagtgtggtaggttgggagacagagtgagtttatactcagctgctggaagacccaatttccttctgaatcaaagaaagtttaaattttatttcgtgtttacctgcattgtaaaattacatttctttggaaactgttaatttatgacactaggaaatcaggaccagattgccagtgaataattttttttagtatgagtgtcctaagtattgtataggacatacatgggattaaaaaattatttgttgattatctgaaat

SEQ ID NO: 1454 - DNA, 1217 bp, Homo sapiens
tacctttctacaataaccaggaatcttctgcttgtttgagccactcttgtcttattaccagatcactctgatcactacctctattacacatttattatctcactatagtcctttgaaccccatgtatatgactggttttccagtgtcgagtttccattcttactcaaaaactttggctggaaacattagagtcccagttctgctccggtccacctgcgtaaacttagactagcattgtttgaaataacactagattagataatttataatcgtatatctattgctaaaattttaaatttcaaaattatttaaaatcttaattgtgattttattgttgattaaaattaaaatatctgctccacttttttgggtgaggggatttctgtaaatacaacatgagctcatacgtttgagtgatttttgttaactgtatataaaaccaaagaaatatattgtgatttctggacctggtttcagttacattatctctatgttataatgtaaagttgcaagaaacaccaacctacagagagttgcattattcagatgtttctttaaagttttcctgagcttcatacccttgaattttctgtgcactaagatgtgaaatccctgagctttgtgacatttctgtgatcaagaaaaagaaaataacaagaaatcctatctaaggaaggaggcagaaacatcaaagcagataagtaaaggagaaacatccatatcccaaacatgtcgaccgatggtttttattgtcacaaaatagtgatatcaagcacattctttcagagcaaagtctaaagacagctacacaaaaatgaaagctgagtgggaaaacttaattggagatttgattgtgtccaatccctaacttttaatcttatttttcattgaactctgcacatacaacatacatatcaacaaatatatacacatacagatatataaccccgggtttgcttaactacagaatatgaagtaaataagaaccaggcaaccacttcacacttgccactagacacattatttgagtaagttgtgatggacactacgttgttcttatatgttaatcgggtcaaggccatctgatcttgattctaagagtacttagcagaaaaaagttatgtaagaggatcagtttgtttattttagccacataatggcaaacgtaagactaattttcttatttaattgataacagctaatcagtatttttggta

SEQ ID NO: 1455 - DNA, 1199 bp, Homo sapiens
gaaataccacctacggatgtgatgaggactaaatgagataagacagagcacttaaaaccacgcctgtctgggcatactgtaagcctcagtgactacagccatgattgtaatcagtgactgtatttccttactcttaaagcagagacaggagcaagctggtggaatcgccctcaatattaactcacattttttacctgataccatttccaatcttctgtgaaatcctatccagaccctgtactgactcccctggcaatttcaacaagaaatattctacctttcactgccaatttgttttggtagaggctgatctgcagtctgaacataaatgaaagggaatccacccgcaataataaagagtgagcctggcccatcatgatcagagactggcccctaacatgttgacacaacggctgaactatttgaacactggaatgaacaagttgcaacaactcctgcaagtctcaggaactaatgtacggacaacgacgcgcatttcactgacagagtcctgataatatattgcaggaaaacccacgggccagccgataacactcagcgttaatttgtttacccaaaaattagaggaaggagaagttggtgatttgcaaaaaaagaagttttggtaacaagcgtaacgttggtgtgtaattttcctaattgaattgccaaatttctacccaccactgatcttaatttataataatgcttccatctgtctcacctccagcataggaaatgggaagagggtggtctctgccttaacatggtaagaagaatatctgcaggtagtaggtaatctttaaattacatgtgtgatactgggaattgcatataagcaaataaggaagctcattacttttccagatttcaattaactgtatatttgtaaaaatgctttcagttagcaacattttgaatggtaaagggattgaaatttacctaaaagaaaaccttttataatggtttagcaaatttcaagattatctagggcagtctgcatggccctcagatcatagtgaattagtaatttcttgtgcagaaattgtcaaaaaacaggaggaagtcaggtgcctatctagaaacataaaaattgggaataacacaaaaaggaaaccttgacttcctactaggtatattaggcatttaatttaaaacttcatttactttttaaaaattaacacaatacatgttcacaa

SEQ ID NO: 1456 - DNA, 1196 bp, Homo sapiens
aaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgattttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgatcatggctttaaaaaaaaaacaaaaacacacacacatgaactcagatttgcaaaccaggtttctgaaactttgggtaaggtgtatgcttttaactttgaaatgtataaacacccagcggaaacgtatacctttcagtgcatagtgcattgtgtgcttaccctgggttgtttaaacttgtgttcaaatattccccctccaagtgaaagcctgtcgggaattccacagtaacacctttactgttctcccattgatgatcatatacgttacctcttcctagcggtacatttgtatgatccttactactggaattaccgggttaaaaggaaatgcttaccactaagatgtcagtattctcctcatggatattttcagtctcaatgttgccagtctaatagtatagtatgtggttgctttactgctgttctccccacccccgtggagttgtgtcattattttaatgaatgtgagctcttgacttactctagaattctaatacagatactttctgcactagtatcacttttattattgcagttccatttaaaagcataactggctaagtcaccgccccacccgccgcattacatttcctaaaacatactgctgccaaagaccaactgtagaatcc

SEQ ID NO: 1457 - DNA, 1196 bp, Homo sapiens; identical to SEQ ID NO: 1456

SEQ ID NO: 1458 - DNA, 1966 bp, Homo sapiens
tcaagtgtgcatcacttctcctgttctgccaagacttcctcctctttgtttgcatttaatggacacagtcttagaaacattacagaataaaaaagcccagacatcttcagtcctttggtgattaaatgcacattagcaaatctatgtcttgtcctgattcactgtcataaagcatgagcagaggctagaagtatcatctggattgttgtgaaacgtttaaaagcagtggcccctccctgcttttattcatttcccccatcctggtttaagtataaagcactgtgaatgaaggtagttgtcaggttagctgcaggggtgtgggtgtttttattttattttattttattttatttttgaggggggaggtagtttaattttatgggctcctttcccccttttttggtgatctaattgcattggttaaaagcagctaaccaggtctttagaatatgctctagccaagtctaactttatttagacgctgtagatggacaagcttgattgttggaaccaaaatgggaacattaaacaaacatcacagccctcactaataacattgctgtcaagtgtagattccccccttcaaaaaaagcttgtgaccattttgtatggcttgtctggaaacttctgtaaatcttatgttttagtaaaatattttttgttattctactttgcctttgtacagtttattttactgtgtttatttcattttcccaatttgacaatcgtattttaaaattgaaactgatggaacattctttcttggtcttcaccatctgacaaattgaatggcaagaggtggattttgccagtttcttttcactgatgcagatttgtgttaagatagtactgaatggagtatttataaactggccctgagcatgcataaagcatcagtatctgacctttttttaaccttctaggaatttgaaataaatgtgtttgtgttgtctgattagatgatcattggtgtcttgccacaatgtttaaaaattactgtacaggaaagtcacagcaaagatagcagttgtgactgacatgtaggactttcacagttgtgccacatttttgcctaaaatttgggttatgacatttttcttggttcttatctgaaaatttcatctgtaacctttcatgtgtgttaagaaacactgatctgatcatttgggatttgctgaggcatttgtgagtcttccttataaacctgatgagcagatctcaactatctagcttgtgtgtcatcagaaaggtttatccctttgagagtatcaagtcctcagttaatgattcttgctttcatccctccagtatttgctgtgggagctcgttttattctttaatttggaattcagtaatttttcttctttattgacgaattcctcccctcacaaaactgttctttcccacctctctccatatctaattcctgattcttgttatttttaagtcataaatgtagccagtcataaatacataaatgttaaccttcgggttgcaaccttgtctcttgcagtttaaggtaatggatattgtagcccatttgaattttcttcactcttattctcgtaattctggagtttcttcagattgtggtgtattttattgtgctcctatgtaagatgaagaattaactattaaaattacattttcaacatacaaaagcttttgatgactggtaactggtatccttccaaataaatgcattgcttggtaacaaatgttagcttaattcagaatgaaatagttaacaaccctaatattgtaaaatttgaaaactgatagcagctgtcatttataacaattcttgggctgtttaaagggtacatttgactatagctaaggaaattgaatctcactttaaaaatgaaccacacaaaacttcaagaaacgaaatagaaatcaacatttactgcccgtaatattgctcatggttatagctagtatcacatagtgatttacaaaccat

SEQ ID NO: 1459 - DNA, 1138 bp, Homo sapiens
taaatgttatgatgtttcagttggcttctaggaaataattaaattagtgatattttaatcaggttttactatctgctaggccccttccatcaattcttattaaattctcaaaataatcctttgaaaagggagtataattacattttacagtgactcgaaccttacccaaacaagtgggagagccaggagccaaactatcaggctccaaagcttttttttagtgcatcacaatgacaaaggggtggttttctttcacccaagaatgtgctttcctggaaatttttctagatagaatattatgtaatttgttttgaaggttttttttcctgactgtcttaaagattatgctagctttagaacacatgcaaacagctgcagctctgtgattaaaatgttaaggtcactagaatagtgttaggaaaatgttaatagataattctgctgcctctattagcttatgtatgatccttaatagcattgcttccccttcagtttctatttaggaggtgaagaatcttttaataaggtagaaagttgctttatttaaatttgtactgtagaatgtttgtgatacagtatttgtaaaattgatatgaaaaataatttctcaaagtctattgtttgatctagttattttaataaaggaactctagaagtttcaagtggccagtgaagtgtgaggaatagagagtaaaggaaataattaataatggtgaccctctgttaagtggtttactttttccattaatataaatttcatttggaaagattaaaaaaacaagtttgattgaacttgataaatcagaaatatttaccagctttgtcgatggtgtattcttgaaaaatgtttggttttctttcaggttgacttatatccaaaattctacaaattcttagctatgttataaatgtagaaagaagtgaaaaatcaaaatatgattatgaagattttcttctcttccgagtacaaagctctgctaaataaggatttacccaagatgcccacatccacatacttatgtgtcagtgctttggagaattaactttgactttattctactggaagtatagattaacactgtgctttctgggattttgcttttcatgggttgctgatttttaattttgctaaataagc

SEQ ID NO: 1460 - DNA, 1099 bp, Homo sapiens
gtccacacaccttggcctcccaaagtgctgggtgggattataggtgtgagcctccatgcctggcctaaactgcatactcctaacatcagtatatagaaatattttctctttagttctattaaaattttaaaaaatctttatcaatttagtaggcaaagactggaaaatgttttaatttgatcagccactttaatgtatgtctcatttcaaagcatataaagtatacaagtttcaggtcctagcttaaacctataagaggccttattatgggcttatttcctttgcagccctttaccataatgtgtttcttctacctcccctgcacaacattgtttatatgccccctaaaatgtaacttctttagattctgttgttacgtgcaacactgtatatctctccatagcacttaatcagagtttgtaattaggcatctttttgtgtgattatttggtaaatgtccatatcccctactagcctataagctccatgacttctaggtaccctgtctgactacgtgtatcactgtttctaccgcctaacattgcctagcacattcattgcttcacaggcatctgaatatggttttataaaatacattgctctagtgcacaggattttaagctaaggatttcatgaatgggatttggggtaggggcatctatgaaattcctgaaattgtgtagaattttgagaatatgtgttttcctggggatagagtatgtagtttctcagcaactcattacagtctgtcacatcatgccctaattctacttgcctgtagctaaacacctaataacattagaactgaaatgatagtgatatgcaagatagcacgtgtggtttccacatattctaagaggcatcttcaattagattccaaaaatttttaagaaaaaaagatataatgtgccatcattttggatggttctgggcacttcaggtaaacccttactcaaagaatactttttcagtttcaatgtgtatttttaaaatttccagaagatgagttgaatatcagcccacaaacactggtagtaagcaaactattttatttgctaaaggcataaataaatgtctcctttgcttttaggcaaaggga

SEQ ID NO: 1461 - DNA, 1197 bp, Homo sapiens
ggctgaggcaggagaatcccttgaacccaggaggcagaggttgcagtgggccaagatcacaccactgcactccagtctgggtgataaaacgagattccgtctcaaaaaaaaaaaaaaaactgccaaaacgctttttgcaaagtggttgtaccattttatattctcaccaccatgaatgaaagttccaattgctatattcttgccctcatttgataatatttttagttttagccattctaatggatatatagtaataatttgatggttttaatttgcatttctctgatgatcaataacattaagttttgattcaggtacttgttgggcactcatatctttggtgaaatatctgttcaaatcatttgctcttttttttttcttagcacttaaaaaagactttttgccaggcacagtggcacatgcctgtagacctagctactcaggaggctaagacaggaggatcacttgagtccagaagttctgggttgtagtgagctatgtcaatcaggtgtttgcactaagttcagcataaatgtagtgacctcctgggtcactgggacccagagttgcctaaggagcgtcagaagtggagcaggtcaaaactcctgtgctgatcagtagtgggatcacacctgtgaatagccactgcactgcagcctgggcaacatagtgagatcctcatctcctgaaaaaaaaaaaaaactttagtttttaaaagtagttttaggttctgagcaaaattgagaggagggtacagaaataacttatatatcctcagtgctcccctcccccatgcctccctcatcaccatcccccagcagagtggcacattggttacaattgataaacctacactgacacatcattatcacccaaagcctattgtttccattagggttcactcttggtgctgtacaatctatgggtttgaacaaaggtacaatgacatgtatccatctttatagtcatgcagagtctacactgtcctaaaaacccttggctctgcctcttcgtcgtgtcctccccactgacccccggctaccactggtcttttcactgtctccgtaagtttttcctttttcagaacgccatatagttggaatcataaagtatatatagccttttcacattggtttctttcactggataatatgcatttgtttcctctatgtcttttcacagtttgatagctcattt

SEQ ID NO: 1462 - DNA, 1176 bp, Homo sapiens
tctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgtaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagatggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggccactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataaataatacaaaacaataacccttct

SEQ ID NO: 1463 - DNA, 1209 bp, Homo sapiens
catatctgcttcactgggcaccccaagcccagtaacactgtggttcttgtagactcatagaagtactgccttgatggccatgggacaagatctgggagaagtatctggagaaccaggcagagactcttgttctcttcccgtacttaaccaaacaaacagtctctccttgttcagagccacctaaagctggggtgtagcgacacaagaacctctgtggctaccaccactatgactgctgtggatcacacctgaagccagcacagcactggatttcaccaaaggcctgatgtaaccactactgcctatgtaaccactacgtggctattgcccatgttcactcaaagccctagggctcttcgatcacttgatgccaaaaccagccaggcctgtgaccttcccttcagggtggcaaagtcccccagacaccaggtgggtccagaggtgctgtacaggagtcagggaatacagtcaaaaaccttagaagtctatctggtattctgttgtactgcagctgagctggcactcaaaccacaaggtgcagatcagtgcacaagatgcagtccttcctcctcttcctttccccttccaaaggcagaggaggctcactctgtagccactgccactccaggccataaggagtactgccagactaccacctatgttttcttaaggctcaagggctcttaagtcagcttatggtgaatgctgcctggcctgggattcactctttagggccatgtgctcccctctggcccaggacaggtccagaaatgccatccaagagtcaagtcctggagttgagggctccaagagcctgcttggtgctctatccccctgtggctgtgctagtacctaagttgcaagacagagttccctttgcttttccctctgcttttctcaagcagaaggagttttgtcccacagccaccacaactggtaatgtcctgagtctcacctgaagccagccagtctcagaggcccacccaaggcccccaacatattacccgagtgttgctactggttattcagggcccaagggctcttcagttagtaggtgatgaatgctgccaggactgggtcctttccttcaagtaaggaaagtacaggagtaagtatgggaagagaacaagagtctctgcctggtaatccagataattctcccagattttgtccaagaccattaaggcaatacctctacgagtctgcaag

SEQ ID NO: 1464 - DNA, 1177 bp, Homo sapiens
acaggcgtgagccagcacgcccagccgtacaattcttaatatttcttttatgctcccttacagatttgttagtgccaaaatactttttttattttttagtgccaaaatacttaaaatatttcaggtaaaaggaaattcttagctcacctccatcaaaatatttacttgagtcaagagtaggaataggactgcaagagctctccttttatgtatccaagtcatccagttctcttagagattggagcagctctatgttagaccaagggtctaaaggaaaaacagtttgtttatttaaattgaacatgaagagtttctgtacttgtcagaagccctttgggagaacaagaagcaaaaatttctcctgaaaactcatatctgaaaacagattttaggaagcctatgatcagggtttctctcaaccatgtttgttttttaaacagggtcccctcttgtcacccaagctgggggtacggtggtggcacagtaatggcttgctgcagcctcgtcctctcaggctccagggatcctctcacctcagcctcccaagaagctagggctgcaggcacgtgacactgtgcctggctaatttttcctatttttgtagagaccgagtttcattgtgttacccagctggtctcgaactcctgggctcaagtgaccctcccacctcagccttccagattgctggggttatgtgcatgagcctccctacctagctgggatctgatttttttttttttttttttttttgagacggagtcttgctctgttaccccgtctggagtgcagtgtcccgatctcggctcactgcagcctccgcctcctgggttcacgccattctcctgcctcagcctcccaagtagctgggattacaggcgcccgccaccacgcccggctaattttttgtatttttagtagagacagggtttcaccatgttagccaggatggtctcaatcgcctgacctcatgatccgcctgcctcagcctcccagagtgctgggattacaggcgtgagccactgcgcccggccgggatctgattttatataacctataagattatttgtcctgtttatgcaagatttgttatatatttgtcacttgatgctttaaggcgctctaaatacttaggctcggaaatcaaatttcatctaccacttactagctatataacatt

SEQ ID NO: 1465 - DNA, 1167 bp, Homo sapiens
gctggcacggctacagctgtcaccagattttaccttcactgctggccttgctgcagaagtggctgctagatctctctcctttaccaccatgcaggaacagacttttggtggtgaggaggaagaacaaataatagaagaaaataaaaatgagatagaagaaaagtaagaaccaagattcatatgaagtgatattagattgttccttttacaaaagtgtttagcttcaagactggaaagggaatatgagtgtaagtttactatatataaagctaagatgtggatttacaggaagaaccctggtttgaataactgatctgaaattagtagttacctgtaaatggcagatcttttaggaaaataagagaaaggtaagggctcttttgaataaactgctgttttatttgtggcacaactgatcaatcttggaaattctttaagtatttttaataagaaatgaattatcatttcttgccagaatttgctaccttaaggtgattgggaaaattctgttgcaagaacattaacatttagtatgactcctttttactgtattcttgcagttaataactgcagctattatgttaataacaagttgtttgtattttatttttgtttataccagtcttaaagatccaggttctgaataaaaaaattaattgatacaattgatgtgtgctggggtttggaactaaaagtagtttcaacagtgcgtgggttatgacatttcttatgtttctttgttcatgtgtgtatttagtagttaattttaagatgtcctagtgatctttaaaagaaaaatattgtaccattttttagaattacactttcacctttctttttgcaattgaaagtgatgatgtcaaagtgggatttctgtactccaaggccccacccccaatttagcaagcagaaaaacgttccttgtatcactttaccttggataattgggtgccattaacacaaacaggtcacaatcctgctgttttctagccctgtccaccataatgagattcaggaaacatcctgtcagcctcctggaaagcatccttgtctccttagtatttcatttacaaactacctcttaacagagactgcttttcaaattggccaatcttacctgttttgtgttgtgattgcattttcaaagagtaattattttcagcatat

SEQ ID NO: 1466 - DNA, 1199 bp, Homo sapiens
cacagctctgcctggcccattggcttatggcaatgatcaagcataccttcaggttatgacatcactgctagaccaagccacccaatctcatcaatttttccaccaaaattagagaaacttacctaaacaattttaacttactcagaggctggctaaacaaattatcctacaatgtgcccagattgccagctcacagggatgtcccctccttcaacaggtgttaaccctagaggatcagaagctaatcatttgtggcaaacagatgttacacacatctctgaatttaggaaactaagataggtgcatgtatccattgatactgagaggtgaagccagctggacttcctgggtcgagtggggacttagagaacttttctgtcttacaagaggattgtaaaatgcaccaatcagcactctgtagctaggattgtaaaacgcaccaatcagtgctctgtagctagcaagaggattgtaaaatataccaatcagtgctctgtaaaatgcaccaatcagcactttttaaaacgtaccaatcagcactctgtaaaatgcaccaatcagcaggagtctaaaagtagctaatcacggggaggattgaagaaagggcactctgatgggacagaaacagaacatgggaggggacaaataagggaataaagctggctaccccagccagcagtggtaatccacttggattcccttccatggtgtggaagctttgttcttttgttctacgcgataaaccttgctgctgcttactctttgggtctgtgccacctttaagagctgtaacactcaccgtgaaggtccgcagcttcattcttgaagtcagtgagaccaccaacccaccagcaggaatcaactcctgacacaataccaacactcatttaattagtgcacatgctttgcctggagagtctactcgatatgtcactaaacatcttcttttaacttttgcatttatggggcaacccacaaaaattaagactgataatggtccagcttaccagctcacaatttcaacaattttgtcacatgtggaatatccagcattccacaggcatcccatataacccccaaggacaggcaatagtagaatgagcacatttcacccttaaaaatatgctcaaaaaaatggaaaaaaggaaatataggtaagtacactgcgacactactggcataagctttatttaacctta

SEQ ID NO: 1467 - DNA, 1231 bp, Homo sapiens
attatacattctggcttttgattgttgaaagagcaacaataaaagtttttggacttcaactactaggacacagctaaggtctgggcttttcttaatgagggaaatcagttcgtaactcttttgccaacagttaattttggattttctcctcttaggcttccaagaacaaaacacttgttaaatgtcatcaatgaaaactttggaacccttgccttctgccgcagatggctggatcgcttgggagaaagtaaatacttgatggctctgaagaatctgtgtgacttgggcattgtagatccatatccaccattatgtgacattaaaggatcatatacagcgcaatttgaacataccatcctgttgcgtccaacatgtaaagaagttgtcagcagaggagatgactattaaacttagtccaaagccacctcaacacctttattttctgagctttgttggaaaacatgataccagaattaatttgccacatgttgtctgttttaacagtggacccatgtaatacttttatccatgtttaaaaaagaaggaatttggacaaaggcaaaccgtctaatgtaattaaccaacgaaaaagctttccggacttttaaatgctaactgtttttccccttcctgtctaggaaaatgctataaagctcaaattagttaggaatgacttatacgttttgttttgaatacctaagagatactttttggatatttatattgccatattcttacttgaatgctttgaatgactacatccagttctgcacctataccctctggtgttgctttttaaccttcctggaatccattttctaaaaaataaagacattttcagatctgagagctacatctcaatgtctgtggttataattctggacaggataaatagctaaacttaatgtaggcaaatgcagagacatttatctgaaatgtagacctctacactgagacttttctggcatagtggctaaaacaagatctacacatgcataaaaagggacaatcaccttttcttcataaatatacagctttaggaatatttcaccattctttgtaggacatagtagtccttgtctttttttctcctgacattggaaagatgtgctaattgaaacttgacttagtaggaacattgtgccaactcaaaaccttgatttagtaaaaatctcaatgtttagatcctttgtccagtggtggtgtttatcagggaatgtattcagcttgc

SEQ ID NO: 1468 - DNA, 1178 bp, Homo sapiens
acaagtttccctgacagaccaccaaataaacaatggtcttttaaaaacaaatcaactttggtaccatctactcagctggcatttaccttccttacctgctaccaacctcattcttagaattaaagaaaaaaggcgaattctaaagccccttctactcactttcctccactaaggccatagcttacatctgctgctcttttttccatactccttttttctcaactcctttctttcatatttgccagaaatttaaggtcgtttgggttcctctcatttaaaaagttcaactgaagtgtgttgctacaccttaatcaaaagtttatggctgagttatttagcgtttctttacccacttcctctgctcaatccttcatctcctcataaccattgaaatgaatgctatgaatatctcaatgcttagcatggtgccaggcatttaggtgttgaaaaaaatgttaagcgaatattagttattaggtaagagcattgtctgtaaaactctgaaaagtcttaaaagtgattcctaaaatttcacaagctcataaattctttagtctgcaattatgattcctgaaatattcttcgattcatgaaagactggactaggaaattctaaaaatcgacataaagcataaaaagccactctgaggtttatgaaatttacaatgttttgtcttcttttaattcattcgtacttttctctcaggatacaaagggcaaaactgtttgtgtagtaactcagaattgagtagttacacatccattaggtttcagaatcgttaaaattttatctggtttaggaaactgcttaccttggaagggcaaattgccatttctctccatctggggatcagggaagcaagggaagcccccctaaacatcacttccacgctcctatattatgctaaggaacttctggttgattcattaggcatttcagcagtgtttttggccggtactaggaactgtggagaggtatagaaagggagcaagtgcacagtcccggcccccaaagaggttacgatgcaaatagaagcaggctcagaactcggaacaaaagcagtgactgcataataatgcactgctgggggtgggggatggggatctgcacgcccggtttgtgacttcaggaaagcagtttccaggaggtgagagtttaagccaaacctgaaagaggt

SEQ ID NO: 1469 - DNA, 1183 bp, Homo sapiens
atttattgaatacttactatgtgccagccactgtcctgggatacatacgtgaccgcctacatgaagtttttggtctggactgggaagatagtaaatcactaaaccactacaaatataatgtcagatggtgataagtactaagaacagaaaccaggcagagccattataaggaccttgcatcttgttctgaggagaatgggaggtcttcaggtgggggtggtttaagcaagggagtgacacgatccaatctctgtttatagagaaccactctggctactggctagaccatgagctgcagaggccaaatgtctgctgaattattaccctctcccccacagttatatttcactgaggacaggtctgtaccagtagaccttggacatgtgacacagtcgattctttccttttcatacttttggtatgaaattgatctctaaggtgatacttttatatccaaaaagagagagttatatttttaggcaaggtaaatcagatatcacctctctgcctacagtgtcccagtggcttccgctacagtcagcataactctactgtgacttccacagggctccattcatgtctatctcacacctgctctctgtccgcctctccagccactctctctttgttcactggtctccagtcacactgacttcgttgttcttccttgagcaagccaagcttgactctgcctcaaagcctttaagcttgctcttccctcgcccagaatgctcttcctggcaagatctttgtatggctgcctttatctcaagggtcaggtctctgctggtcactcaatgtatacttctgtgtacaaacaggcagcacatctgctccttagaataacagggcggctctgtcccaggtgtgctcaaggtctaaaaacttcttgttatcttatcgttcacagatgacataaggcataaatcaaacagggactacattaggcaaacaattcagggtttgcgcacagtcctataaacgcatggtattttctttctccttacaggttattttcaaagctttgtcaccaccatacgatacagagaacccttacagtgccaaagttcaggagcagctgaagatcaccaaccttcgcgtgcagctgctgaaacgacagtcttgtccctgtcagagaaatgacctgaacgaagagcctcaacattttacacactatgcaatc

SEQ ID NO: 1470 - DNA, 1174 bp, Homo sapiens
taaaggggtgttggttgcattttctttgaaatggcttctggaagacctttatttccaggatcaaccgtggaagatgaactgcacttaattttccgactgctaggtaacagaagaaatcttttcccagtgattttgcacccataattgactagctggataagactgtatctctaaaatacatattttaaaattagatactgagactaacataaacagctgttagttagaataattagaatggacactatgaagatagatccttctaggtaacttcatctgctaagttttatctttgcaataaagattttatggaaaaacagaacataattagtatggaaaattggatgtcaccatattattaaggaatattgctaacttttttggtatcaactggatagaaaaaggaccaggcatcctttttacagtatcattgcaaagtccaaacaaaaagtccatgtacgtttatttctgtcatttcaattgcagttgaaatagttaagtcatctggtaaatgtaaattattctctaagacactttgttatatatatgtgtatataatttttatatataaattttatatatatttataaatatatttaatttttttttttaattcaggaactccatctcaggaaacttggccaggtatttcttcaaatgaggagttcaagaactacaactttccaaaatataaaccacagcctctaattaaccacgcacccaggtatttttttttcttatgtgaaaggggggaaaacacatgattcttttcaatcttttgaaggattagccacagtaaggattcaggaaaaaatacataatacacataacccttacgtattttaggatcttatttaattttgaactgtatatgttttagaattctagagtttatgtagttacttttcccagaaagaagacattgattaatgccttattccgtaccacagagattatgatgaaattcctgttttgctttctacagaattattctgtatttacttaacaaaaacctaagaaagggttatgtaagtaaaatcttgactctataacacaaggtaacctatcagtattttgaccagtgttaatgatgtaattcatatttgaagaatataaactctgtccaattccttagcaaaatgtaacatctaaatgtcagccattcatttaagtt

SEQ ID NO: 1471 - DNA, 1245 bp, Homo sapiens
aggctgaggcgggagaatcacttgagccttggaggtggaggttgtagtgagcccagatcgcaacactgcactccagcctaggggacagagcgagacttcctctcaaaaaaaaaagacttatgaattgtttgaagaggcacgagaccgtggcaaccctaactgtccccgacatctggcagccatatgctatccttgaacttgaacttcagagtgaaagtataaatttgtaaggggaaggctcagccgcaagtcacataccagtggtcagttaaaaaaaaaaaactcaggacggcaacctaaatcatttagaacgcgtcaagagcctcggaaaaactattttcacacacttctctagcactaacatgggaagcgcgtttccttcacatattccacaccttttattcttcccaccaacatcaagaatacaaagcgcccagagaggacaataagcctaagcagcggctccaagagaccggactttcgtacttcccgggggcaggcggaaggttacggagcgctggaaggatcttactgctccttgaagggctgtctgagaaaatacacagcctaacgactcctcgttagtatagtggttagtatccccgcctgtcacgcgggagaccggggttcaattccccgacggggaggtgtgtagctgcacttttttggcgacagttattattttctgtatcattcaatgacaggacactgctgttaaacataatatgctaaaccagctcccttaagtgcacaaccctgtcttcaaaatggtgacttttaaccttaatgcccaccatgaagtgaaagcctcccctgagagaaaatgccttacattgtttgcaggaagggaggaaagggaaaaagaaaacgctctgaaggcctctgcccttgcctccagccgccatcttgcgaaggcctgcgccggcttagtggcgccccgccagattacaactcgaggtcgcgaactcagcgcgcggaacctgttgggggaggggagagagggcggagtctcgcgactaacggggcgggggcagggcgggtaagaacggaaatcatttggtaaagaaaaggaagggccaatttcctttgatcctggagacccgactaaacgggaagccccgttctcccgcttccgctggttacgtcccagccttggttagaggactagcagtcaggaaagtttggacgctgaaggaatcggtctcctggtccgacagatactgggtggaggggcagagagtaaat

SEQ ID NO: 1472 - DNA, 1356 bp, Homo sapiens
cggcgcgttcgtaggcgatcgaccccagagacgaaagctgcttctcaagctgggggagggagaggaaacggcgcacaaaagcagtacgacctgtcccttatcggcgtctaaggggaagggtggagaaaacgaaaacagaagcgggccgggagcctcggctcccgccccagcgccttttaaactgcgtttctacctcctctcgctcagcgcggcggctaatggaacccgcgcgagccgtctcgccaatcaccgccgcgcttcctcccgtcgcccgccaatggcggcgcgcgttcttggggcgtgggcgaagcaggctgctcgcctcctgcctgtagtgtgtgggctggggttggtgcgagcttccagcttggccgcagttggttcgtagttcggctctggggtcttttgtgtccgggtctggcttggctttgtgtccgcgagtttttgttccgctccgcagcgctcttcccgggcaggagccgtgaggctcggaggcggcagcgcggtccccggccaggagcaagcgcgccggcgtgagcggcggcggcaaaggctgtggggagggggcttcgcagatccccgagatgccggagttcctggaagacccctcggtcctgacaaaagacaagttgaagagtgagttggtcgccaacaatgtgacgctgccggccggggagcagcgcaaagacgtgtacgtccagctctacctgcagcacctcacggctcgcaaccggccgccgctccccgccggcaccaacagcaaggggcccccggacttctccagtgacgaagagcgcgagcccaccccggtcctcggctctggggccgccgccgcgggccggagccgagcagccgtcggcagggtaaggacgcggggccggggctacaaaggcgggcgtttggcggttgccgcgcgcgctcgccgccgtttgcagcccctccctcccgggcgccccctcgggcctcccaggtgcggggctgtccctgcgccccctcgcgtcgccccttccccgcggggctgcaggcgccggagcggagaggccagaagttggggccgcggggttcgcgttctttgacgtgtgggtctgggaggtgtggagttgcgttggcggcggttgttttgcacgcagtcgacgccgcttccctggaccaccagccgcctgcagcgggcgtttagacggggacttccgtgccctttcgaaagctctggaggggtggccccaaaatgctataggttaagttcgagcgttttcccgctttattaactgaaatgactcgcagcagagtctcagagcgctccctggagggcaactgatgacactctaatttctaaccaaaatttgaaatgaggaaatt

SEQ ID NO: 1473 - DNA, 1343 bp, Homo sapiens
ttatttattcatgtctgcaacatcaatcatagtagtctagatcaatgcaactcaaagcaccagtctacaaactgttacttatccacaggcaagataagcatgcacaagaatttaaatctagagatactttttaggtcaatgacaggatttgattttttagcaaaattttattaatagctaaagcaatgtattgatttacactctgatgcaagtaatttatctcttcattgactggtagcaaccaattcatggaccagtaccatggaccacactttgagaaacacttctttggataataatagatatcctgggatagtgcatgttcaccatctattttgtcagataatggggccttttaaaaaataatactttgctttcatgatatattgtattttgtggaaagttaagtttagcaatatagactctaaaagcaaattaaatttttttaagccataagaaattatactatatcccagtatctgtatgtctgtataaagcagtgtattatcatgttttcatttctgtgattgtaagttaagagtcttaactgcagaggtattgtggaaagtagtagccttaagcataataaaatatggtctcttgggtactccctctggccattaccacattcttagattatatgtgtccatctttgcagctttctgagagtaattttatttgttgtcttctgaaatgtacatgtatacatgtacctactgagtgctatgtgatttttaaaaatgtattactgtagaatgcttctgcaaattcaataaagttgttaaatttgaacagtgttgtgtggtctccagaaacatgttgttctgtgtgctttattcttggagttgcaacaagttaaatatttgtatatgaacaccccttttccatttcatcattgaaactcactttgacatttcagtggtataattgaaaatattctgattatggtatggtttttcttctgtttgaggaccatgtttttattgactgttggaatctaaatttataagaggaattaatctgtaaccagataccttattcgtttaaccgatttctattccactactaatggttttttttactttgtgctttctagttcttagattctgagttaacaaagcataaaatagattttatattgctgggggttgtaccaaacatagatacattgacagatccattgatagaagtgttgggagatggacttgaaatcttagtcctaaataaagactgaactgtttaaactaacttgataaaaatcactgttcgtttttgggaacctgcaagtattaaatagattctgtactaactagtattaacactggaaagttagcaagacacat

SEQ ID NO: 1474 - DNA, 1249 bp, Homo sapiens
gtggaagcgctgaggccctgtgtcccttcgtgacctccgtgtgcccgagggaagagaggccgtgactagctctttctccgccgtgagctcgcttggtcagcaaactaagtactgggtaaactctcctcccgaaactactgaccacccacagttctactaactatattacctgtcctttgatttgcccttagttttcttaaaaatagtcctttcctaagttttatatttgtcgacgccaggtcagtcatttttgcacttaattgtatatgagataactagatgtcctgttttcgtgcgactggaggaggcagcttgcagccctacataggcaatagaaaggagataattggtgggcgtccctttggtgtgattatctcttgggattcttggtggttgggcccagctttaacttagttgtgtgtgttttaaatcctagtgaagtatgtacatacagagaaacctgaaaaccgaattgtaggagtcctaagaatgttatctaccttgtgcctgtaaaatcgaaagatttttttctttaaatcattcatgtgcttctgttgtctttagtatggatagagtccttatttacactatctgtcgttcagtttaaaagttaaagctaacattatttgtgtattaaatgtatttgactgcaggaatttgtgcgtatccgtttttatgttacaggagttcttaagtggggatagtattggttagtggctgggataaactttgaagttgtttgcaagccttttacatgtcgagtgatctttctgagtttcgtttgtactctgaagtgtgctcttaccagtggttaataatttgaagtttgactttaattgtaaaagccgttaatgtagaaaacttttaaaaaaattaatatggcagaatacgagctattaatagtatcagatacagaaccctcataatttttaaatgatctgaatttggcagtgaatttttttttaagccacttaattgtggccaaagctattcagctgtgataatagtatctcacagggaaacattttctttcattccagtggccttagtcatctctgaagaaatacttacttgatttttttttttccaatcaaacagagcagtatagctgtgactatggatctggcagattctttatcctttgtggacttggaggaattattagctgtggcacaacacatacagcattggttcctctagatctggttaaatgcagaatgcaggtttgttttgcatgctggactagagc

SEQ ID NO: 1475 - DNA, 1343 bp, Homo sapiens
ggagtgcaatggcactatctcagctcactgcaacctccgcctcccaggttcaagtgattgtcctgcctcagcctgctgaatagctgggattacaggcatgcaccaccacgcctggctaattttgtatttttagtagagactccatgttggtcaggctggtctcgaactcctgacctcaggtgatccacccgcctcggcctcccaaagtgctgggattacaggcgtgagacaccgcgtctggctgtgaacttcattttttagtattaagcctaccagactttttaaaaagactattataacatttaatgtctatttacctgtatgtagaacataaacttgagaggtaaagataagttaatacatggtttgagccctggactgagttttttttttttccctagagtaaggaccatttgtcggtctacaaatgacttgatgtttggcctaaacatttactattaacttttagggagggcttgttagtatccttgtgatctattcacagttaagaatttccatgaccacaacatgcttccttagatccacctttgtggatgaatcttgaactgagttccacttgtaaacttcttgtttcttgtggttccagtagtcaaagaaacatccagcaacttttttggttgtatagtcaaaggtgcttgagtcattggcatgtaagagaaatatacctgcatgttagtctaacgttctgatagaaatgacatgcatttatgctgccatttgttactatcaggactcgactcgtgtgcggacatttctgttaataatgacagtctctgatagatgagtgtatgcaactgtgtaaaacaagtctcttgatttcctagattctacaagggggttgctcctctctggatgagacagataccatacaccatgatgaagttcgcctgctttgaacgtactgttgaagcactgtacaagtttgtggttcctaagccccgcagtgaatgttcaaagccagagcagctggttgtaacatttgtagcaggttacataggtacgaattacttagaacacacttgtctgaaattatgaacaaataatcatttccattattggcgttttttgagagggaaaaatactccaaaggttataaagcagtgtttttgtttttttggtttccctgaggcatagtctcgctctgttgcccaggctggagtgcagtggcatgataatagctcactgcaacctcctcctcctgggttcaagtgattcttctgccgcagcctcccaagtagctgggacgggcatgcaccgccatgcccggctgatttttgtttttgttttttgtttttttttgagatggagttttacccttgttg

SEQ ID NO: 1476 - DNA, 1343 bp, Homo sapiens; identical to SEQ ID NO: 1475

SEQ ID NO: 1477 - DNA, 1150 bp, Homo sapiens
tagaaaaatgtgatacagaaaacactgctggccaccagggaagcttcagattttctcttcagtgagagtcctaatatcagtacaaatatcagttctggccccccaggtggcagctcaggttcaagaagactagattcatattgggtgggtgcaggaatggccctggcttaaaagcctcctgccccataagagacgatatctcctgcaacaactccatagacttatcctccatggtccctacaagggacctaattacacgagtcattactcagggaagtccaaagtatcacatccccatcatgtatttatagttcatgtataggccctcctagtccagatgcaatttaccaaccaggcatcatttttactgtaagcagtgtgttacctagcaacagagttgacctcctgtttccagataaggtgtcaaagtagcctaaaggaagaggcaaaatctgagcatgaatctttcagatatgtgggattttaattgataaggaaaggaaaatgcatttcagatctatggccataccaacctgaacgtgcccgatctcgtctgatctcggaagctaagcaagttcgggtctggttagtacttggatgggaaaaggcatttcaggaggccccaggaaccatataaaaacaaatttggttcaggcaacaaattgctggaagtatgagggaaatagacatttaaaatccaatgggatttgtacaacaatgcaaatgtacttcatgccactgaaatatacacctaaaaatggcgatgatggtaagttttatgttatgtgtatttcataacatattcatgcaattcaaaaaataattttaaaaagaggaagaaaattcaaggtgattaaaacaattgagaagtgtgtagtcagagataaagcagaaaaagtaggttgggtcagtgtgtgtcaggctgaggaatttgaaatttattctgtaggcactggggaatggacatgactggactactttaggccagttaattctagaggcagtgtacaagtgggattagaaggagggaaagttgaagttgggtcatctgtttgcaaaaagactgtggggcagattggaggcaggtggcagatgaactgtaatagatacacctggatatttgagattgtcctaggttttgtactctcct

SEQ ID NO: 1478 - DNA, 1206 bp, Homo sapiens
attgttttttctaattctgtgaaaaatgatgttagtactttgagaagaattgtgttgaatttgtagattgctttgggcagtatggtcattttcacagtatagattcttccagtccacgagtatgggatatatttccatttgcttatgtcatctatgattttccacagtgttttgtagttctccatgtggagatctttcaactccttggttaggtatattcctacatttttttttttttttttttttttttttttgtagtagcagtagttattgtaaaagggattgagttcctgatttgattatcagcgtggtttttgttggtttgtagcagtgctactaatttgtgtacgttgattttgtaacctaaaccttactgaatttatttattagatctaagagccttttggaggcaaaacttggcatttttagtacagggtatatcaacattatgtatttgatgtttcctacattttatattaatggccgaacttttgtatttgtcttgaatatttacaaaatgattgctcagaattttaggattaaacaggttgttaagctcttcatttaaattatgatattaagatttgttttaaggattgttaaaaaaaaaaagatacttaaaagaacctgaaattggccaggcatggtggtgcgtgcctgtaatcccagcaccttgagaggccgagttgggtggatcatttgaggccaggagttagagaccagtctagccaccatatcaaaacactgtctctactaaaaatacaaaaattagccgggcgtggtggcacttgattgtaatctcagctactgggaggctgaggcacgagaattgcttgaacccaggaggtggaggttgcagtgagccgatatcgtgccactgcactccagtctgggcaacagaaagagactctgtctcaaaaaaaaaaaaaaaaaagaaaaaaagaacttacaatttctattcaaaagatgtctgaggagatatagctagtaataatttcttaaataaaatgggtacatctggtttcaaaagtatgagtgagttgcttagtttattttgtagtttaagaaaagtgattttatataatttggtgtgtctgtcctatattaatataacacctgtattgattactgtttacattattttcttcttaatgattgatcttaaattaaaaatttttcatttgtagatcccatggacaaaactga

SEQ ID NO: 1479 - DNA, 1185 bp, Homo sapiens
ttgtgaggattaaatgggattgttagcatggtggctggtgaagcactcaataaaggttcaaaccgtggtagtaataacggtaaaacaatagcaatattacgtaatccctctgggcctctgttagccagctgtaaattcaatctctttccctgtcccttcacgcttactaagttcttttaaaaacaaatgagactgactgggcgcggtggctcatacttggaatcccgcactttgggaggcctaggcgggcgaatcatgaggtcaggagtttgagactagcctggccaacacagtgaaaccctatctctactaaaaatacaaaaattagctgggtgtggtggtgggcacctgtaaattccagctactcaggaggctgaggcaggagaatcgcttgaacctgggaggccgaggttgcagtgagctgagatcatgacactgcatttccacctaggtgacggagctggactccatctcaaaacaaacaaacaaacaacaacaaaaaaaaaaacaaatgagaccatgggcttggaaatgccttgaaaaaatgtcaagtgtgattcagagtgaggaagtattactgtggaatagttactgtagctattgttaccggtcggccaactgctcctctgcctgctatatcctgacttaaccttggtctgtatttgccgtacaacaaggagttaaccaaagagagagacgccctcaggctggagttatacaagaacaggtagcatgggggaaggtgggatgggaggtctgggggcccttagcatgggtgatgtgctgggaggttggggggtacaggtaagcatggtgaggtggtcatacaggtttgcatatgtgcacagttaagctgtagtgctggtgactcatggtgtagccttgggcaactcatgccttctcttgggcctgccatctgtgactttggattcctagggttccttccaatgccgcggttctgtgttggttaggcaagggtgcagggttgatcactaaagcagtcctttctgttcttagttcattcctttctctactgcttctggccataaccgaagcaatgaggacctgaagcaggagaaatcagaattggaagagaagcttcaagtcctggtgactgagaaggctggcatgcagcttattttagaagagccgcaaaagaaattacaaatgatggcactcctgctt

SEQ ID NO: 1480 - DNA, 1263 bp, Homo sapiens
ctcagcctcccaaagtgctgggattacaggcgtgagccaccgcgcctggccagtctgaggaaattcttatctttgttcttatatgtaatttacttgttttctgtggctgcttttaagatttttcttttaatcactgattttcagctatttggtatatctatgtatgggtttctttgtgtttatcctgtgtgtggtttatttaatttcttggagctttgtatagcagcagtccccaacctttttggcaccagggaccggattcgtggaagacagtttttccacagatgggggatgggaggcttggtttcagggtgaaactcttctacctcagatcatcaggcattagttagattctcataaggagcacacaacctaggtcccttgcatgtgcagttcacagtagggttcaggctcctttgagaatctattgctgccacctatctgagaggaggcggagcttaggcagtaatgcttgctcgcctaccgctcacctcctgctctgcagcccggttcctaataggccgtggactggtactgatctggcggcctaggggttggggtctactgttgtataagtcacatcgtcttgcttcttggcatgtctgatagttgttgattgcctgctgaatattgtgaatgttacattgtttagtatctgaatttttttgtgcatgttatgtgtctttcatgactattgggttttgttctggtaggctgtttagtaatttatgattactttggtcatttgataattgattttagagtggatttagattagcttttactctaagggtggcttaccccactattaaggcatggttcttacaggtttctgctgattgtcttagtggtcagtgaagactcactactctggctgatgagatatcaaatgatttgcagccttgtgtgaactttgaaactattcaactgatagctctctagtttggttcttgccagacctggtggagtgtcacactatgcataagcatgtgtgggaccagggaacagagcatgaaggggaccagtttgcattttcttcagcatagcttcattcactttgaaattgtatctcagaactttcatctacctccgcattcttgaatgccagtttgtccctccagcttctcaattcagctagatagctacttggaattctgctctatgctctgtagtttggaatgtgcctctggggcaatcctggttctcttgttctctttcttactggggtcaaaggctcttgctgcctgttcaatgtctgaaaaa

SEQ ID NO: 1481 - DNA, 1395 bp, Homo sapiens
agaccaacctggccaatatggtgaaaccccgtctctactaaaagtaaaaaaaacaaaattagccggctgtggtggcatgtgcctgtagtcccagctactcgggaggctgaggcacaagaatctcttgaatgcggacagtggaggttgcagtgagctgagaatgcaccactgcactctagcctgggcgacagagcaagattccatctcaattaaaaaaaaaaaaagttatgtgaacatgcttgaaatgatgttcatggctaaatttttcagttaccttgtaaagatgattcttggatattgttttgattctgagtacttttggagtcatctgatagtatgcttcgagaataacaatctgatgatagctttcaacattgggttaccaacaaagcttgttattttgtatacattgattcataatttcaggtttcttcaccattatggtaagtagtgtattgagtcttcattctaacacatgttaggaatttatgtttgtactcatggatgtctttaaccctcagacatttctacttatattgagaactctagactgaaaacattttgaaatgtagtggttttactatgtaggaggaacatgtgattcatttgttctgcttcattttcttctgtttgtgatagagattggatcagatgaaagtgtcttgataatgatatacatgccattcttttcattctatgtatttgtagtccttttttgccatcataactttgtttatgatattccctgctcttaaaataccctcatcttgtccctccacctatctatatctaaaatatccttcaagaccttccttttgcagctttctctgagtactacagccaaatcctcttgtctgaactccaacatgtgtaatacattatcatcctgtttaaatataattatttcttatatttattaatttatcaaggccctaaatatctgcataagcttgccttcatggtttcactttttcattgttctctatattcatgccatgtaactttggcatgccttcccactgtgggtggggtaacctgcccactgtttgactctggtttcaggcatgtgatttgctttaactaatgagatattatcagatatcatgcaagcagaggcttgaaatggtcttgcacattgggaattccctcttgagcctctgccaccaccatgaaaacattcccatgctagcctgctggagagagccacatggaggagagccatgctaccctaactgccatagctgaggctatcctcgatcagcacacatccattcaagcaccagacactggagaaagtccacttgaggtcagtagagctgcctagcagatgcccaactgacccaaaaagcataagacataaacatttattgttgtataccctctgaagttttgcat

SEQ ID NO: 1482 - DNA, 1159 bp, Homo sapiens
ggccgaggcaggtggatcacctgaggtcaggagttcaagaccagtctggccagcagggtgaaaccccatttctactaaagagaccaaaatcagccagtcatggtggcatgtgcctgtagtcccagctactcggtaggctgaggcaggaagatcgctagaatccaggaggcagaggttgcagtgagtcgagatcaggccattgcactccagcctgggtgacagagcaagactctgtcttcaaaaaaaaaaaaaaaaagtattgaataattgaatgaatgttctgcaatgtaacagtccagttagctatatagcactgcttgggatgcagtgtggcctgcttgtctaacactattatggagatatttctatggatttatttgtattattaatgattgagtttataatcctatcttttaatgttgtgtacttcaaatgctattagttttctagatagccaaagatggctaaactctcttctgcccttctttaactacaatttagagaagtggaatttccatgtaagcaacctattgagcatctttactgaatatcttttatttgtgtatattttgggggtagtggggaaaagggacattttaatggcaaaacctaagttagggccccattctctacttgaaactctagacatttttaactgaatttttaataaaaaattactgaggctttgtagaaaaagatgagaatggggtagcatagagtagttgcgctagccacatttcaagtgctccagtgctgcatgtggctagtagctaccatattgaacagtgtagatatagaacattttcatcattacagaaagttctattatacagcactgctccaaacagtaggaactctgaacattgagctagataataagatataatcattttatgttttgtatccacagtggggaaatgtaaggaattgtgtcttgtaattctcttatactgtacctttatttgctcaacagatgtttgttttgcctctaataatatataccaggcactctactaggcactgggaattcaggggtagacacaatagcctcaggcctttctgtatggagcttgtattctcatggaagagcagtcattaagtagataatcatacaaataactatagtctctatagtgctggttgtatagtagatgtttaa

SEQ ID NO: 1483 - DNA, 1203 bp, Homo sapiens
gggtaactgcttattcccaaagcatggctggcaggagagggagccctggttttcagtcattccagggaggaaatgaaatgctaatacctagcctaccgtaaactccacagtggcataagccttgctcaaaagtacatcagtgaataaaaagaatgtcaaaggctgtcagtagcagaagaggaaaggaaataggaaaagaagagaacagaatgagatgagacatgaagtagagagagatgagagaaatactatgctgggtgaaagtgattgggaaaccatttctgaccatgtatttcaccacactcatcccaggccttgcagcattgttttgaaataagaagcattgatattaataccaaaaagccaatgattttaaccagtggattatttgggacaaatcaaaggtaacaaggggtcaagataagcccatacgccttatttgacttgattgaaagattcattctcatagtgtctattctagattaaaactattcagaccagtctatacaacataaagtttggacattctttcaagagaacagcctttcatttactttagtgaataacaatatctagaaaggccatctgcttcgaccaaactttggaaaggatgcatttttaagattaatggaggaagaggatacctgcccaactagctatgttaaccaattcaacaccataataataattgtcaacatttatatagtttaccatataccagccattgtgcaaaacactttgcatacattctcacttaatcttcatgccagtcctgggaggtactcttatatatcctttttacatatgaggacctgaatcttagaaggttgagtcctttgccaaatgaaagcttaacagtaaagaaacagtagaatccagactgtctggttccaaaacttgtgcttttagccacttcacatattgcttctgtcattggtatgacagatgtcacaggcagatcatactcaaattctgtaatatgttctaaataatacaaacaatataactagaaaatggtagctaacttatatagcaggccccactgaaataattcaaacataaaaatgacctcttggcatttgattatctttcaccttagacgttgataaaccaaaccattcccttaggacaatatttttctgtccagcaaagcatttctcttgccaaagtataattttgttggctacatctatctcctccaag

SEQ ID NO: 1484 - DNA, 1167 bp, Homo sapiens
ttgtaatcaattcccagttagaagaatttcagtctctgggccattgagcttggcagtgttgagatctcccatgtgacagaagcctgacatctgggccaccaaggctcactgactgtgtaccttgcagactgtagacccatgtcgtggcggtaacggggccgaacacagtcattcccatgtgaacgatggaggcacatcccactttattattaatccttgtatatactcagtcaggacagattttaacttgtcgctgtcatgactttttttttttttttttgaggcaaggtctcgctctgttgcccattctggagtgcagtggtgtgatctcggctcactgcaacctcttgcctcccaggttcaagcaattttcgtgcctcagcctcccgagtagctgggactactggtacatgccaccaggcctggccaagttttgtagttttaatagagatggggtttcaccatgttggccaggctggtctcaaactcctagcctcaagtgttctgcccacctcagccttccaaagtgctgggattctgggtgtgagccactgtcatgcctggcctcgtcatgactcttttctctttttttttttttttttttttgagatttagttttgctctttttgcccaggccggagtgcaatggcacgatcttggctcactccaacctccgcctcctgggttcaagtgattctcctgcctcagcctcccgagtagctgggattacaggtgcccaccaccacatccagctaatttttttgtatttttagtagagacggggtttcaccatgttggccaggctggtctcgaactcctgaccttgggtaatccacctgccttggcctcccaaggtgctgggattacaggcatgagccaccgtgcccagcctatcatgactcaactgggatctggcacactgcactgggtgttttgttctctgatgtgcacattgatgaatgcatattggtacaagggaaatgaatctgttttcagccatttaaaaaattgtgttgtaaagcaaacaaaaatagcttgaacatttaaaaattactgtttaatattgtttgactgattttctaagaattatgtgaacaatgatgagtccagggcagcagccatcacaaatatgacagtccagcaaggcccatggaggtccctttggaa

SEQ ID NO: 1485 - DNA, 1242 bp, Homo sapiens
tgtcccttcttagatgctggcctcgggagcgtgaggcctggggccagcggaatggcagtgtcagcgtgtttgattcagttttgctggagttcggttcttaacatttctcccccttctcatgcctctgggctcaatttcagttcccctcgccagaggttgcataaatcctatttgcattctgacctgtgctaacgaaggccgaagttttggcttgatcagttgggaggccttggctcggcctgcgcgcaacacgtgtgggtgtagaagaggcctggtatcagtctgcttaacgttatttataaatgatcggagacacactgtttagaagtggtgactgcctccgtatttcaggatctactggagacttcagcatctgaacttaaatagatgttctgtcttggctttacctttggtatttaaaccagggaatgcactctttcatccccacctcccttagttaccaactgaattttgcaacccctacccttccctatttgatcatcctccttggagaagtgtgatgttgaagagtttgcccgtgttaaatcttcagggtcggtcagagctgacgatgaagttgatgtggatggtacagtagaagaggatctgggtaaaagtagagaaggatcaaggacggatgatgaagtagtacagaggtttgtgttcatttgaacttacgtatacagataagccgtgtgaaccttgtgagttacggtcacttcttatgtatctcttctccaaaggtccagataaagtctaacaccctgtatttaaatacccggtgagttgtgtgcatacatacctcctaacttgtccctaggagtgatgaaaactgagtgaattcctttgaaaactatattgcagaatactagcaccataaactttgtaagactttatagaagatactttcagttggatttgtattcattaactgtgtacaccgagtaagtttaaaaatgggatttctgtcagttgaacaatattttaaaatttggcctcttgggacttattgacagttttgaagtcctcactgtggagcataaatgagtatgactttgctttttagtagaggaaagttgggatttttttttttctggcaattttaagaaccgagtatttccagtgtaatgttaaaggtagcctactgctgtgctaacataatgagacggtatatcagttatattttataaaggtttccattttaacccccaagacaatattcagaggcccctgtgctttcat

SEQ ID NO: 1486 - DNA, 1226 bp, Homo sapiens
ctagttttatcttccttggctttaagagtgtgccatggaaagtgataagaaatgaacttctaggctaagcaaaaagatgctggagatatttgatactctcatttaaactggtgctttatgtacatgagatgtactaaaataagtaatatagaatttttcttgctaggtaaatccagtaagccaataattttaaagattctttatctgcatcattgctgtttgttactataaattaaatgaacctcatggaaaggttgaggtgtatacctttgtgattttctaatgagttttccatggtgctacaaataatccagactaccaggtctggtagatattaaagctgggtactaagaaatgttatttgcatcctctcagttactcctgaatattctgatttcatacgtacccagggagcatgctgttttgtcaatcaatataaaatatttatgaggtctcccccacccccaggaggttatatgattgctcttctctttataataagagaaacaaattcttattgtgaatcttaacatgctttttagctgtggctatgatggattttattttttcctaggtcaagctgtgtaaaagtcatttatgttatttaaatgatgtactgtactgctgtttacatggacgttttgtgcgggtgctttgaagtgccttgcatcagggattaggagcaattaaattattttttcacgggactgtgtaaagcatgtaactaggtattgctttggtatataactattgtagctttacaagagattgttttatttgaatggggaaaataccctttaaattatgacggacatccactagagatgggtttgaggattttccaagcgtgtaataatgatgtttttcctaacatgacagatgagtagtaaatgttgatatatcctatacatgacagtgtgagactttttcattaaataatattgaaagattttaaaattcatttgaaagtctgatggcttttacaataaaagatattaagaattgttatccttaacttacgggctttttctatagcaagactgagtggtattctttcccctttaaacctgaggtcagtttaccttctattatatttaacatgtagaatagtaacatgataaaaatcataaaaatgatgaatattttatttttcagacgtccatattttaaatgtaatagttttataaaagaaaaggttggcaacctgttaaggagatcttcatgtg

SEQ ID NO: 1487 - DNA, 1207 bp, Homo sapiens
taattaataacttcataagctcaaagagttccctgtacttagtagtaagaaataataataggttttgggccaggtgcagtggctcctgcctgtaattccagtgttttgggaggctgaggcaggcagatcatgaggtcaagagatcaatactagcctggccaacatggtgaaaccccgtctctactaaaaatacaaaaattagctgggcgtggtggcatgcgcctgtagtcccaactacttgggaggctgaggcaggagaatcgcttgaacccgggaggtggaggttgcagtgagctgagatcacaccactgcactccagcctggtgacagagtgagactccgtcttaaaaaaaaaaaaaaaaaaacttccttttgcgggtggcggcgaacgcggagagcacgccatgaaggcctcgggcacgctacgagagtacaaggtagtgggtcgctgcctgcccacccccaaatgccacacgccgcccctctaccgcatgcgaatctttgcgcctaatcatgtcgtcgccaagtcccgcttctggtactttgtatctcagttaaagaagatgaagaagtcttcaggggagattgtctactgtgggcaggtgtttgagaagtcccccctgcgggtgaagaacttcaggatctggctgcgctatgactcccggagcggcacccacaacatgtaccgggaataccgggacctgaccaccgcaggcgctgtcacccagtgctaccgagacatgggtgcccggcaccgcgcccgagcccactccattcagatcatgaaggtggaggagatcgcggccagcaagtgccgccggccggctgtcaagcagttccacgactccaagatcaagttcccgctgccccaccgggtcctgcgccgtcagcacaagccacgcttcaccaccaagaggcccaacaccttcttctaggtgcagggccctcgtccgggtgtgccccaaataaactcaggaacgccccggtggaaaaaaaaaaaaaaaaaaagtgatctggctggacaaactgagccagtcccacacaaaatcttaaaaaaaaaaaaagaaaagaaataataataggtttttaaaaatcattatttgcctattggagaggtaaaaacagatttctttatcttaatttgtatcactttgattattaatgaggcacaatattttttcctgtatgttgtatttcctatgtgtac

SEQ ID NO: 1488 - DNA, 1449 bp, Homo sapiens
caggttctactccttatagttggcttttatattataagatattgaaagtttttttttttttctgcatcctagtccacattcttgataataattggtgtttcagctgaggacaagcaacacaggtttttccacctcagagctgagtggtggcatgaggatggaggttagggtttgcaaatctataatttgttccaaacagttcaaaatcatttagtgtgaagatgaattggactaactgactaatatcagaagttacacagtttgctgtgtttagctatgggtagcttgagctactcccaaagcaactgagtggcaagaaagggtatctaagaattataaaaacttctcatgtattatgtgtgtagctagtagaatgtttatcatcttgaaagtatgttcttgtcaaagtaaaaatgtgtacttggatttagtaattatttatataggaactttctttttcttctttcttccttttttttttttttcccccagtgatgatcttttctccttgccttactgcccgggtaagaccctggttgttggagcatcctatgtcgctttggagtgcgctggatttcttgctggtattggtttagacgtcactgttatggttaggtccattcttcttagaggatttgaccaggacatggccaacaaaattggtgaacacatggaagaacatggcatcaagtttataagacagttcgtaccaattaaagtaagtgggtttgcctgtaggtttcttgattctacattcacagtaaaaggcaaaaagagagttgagttggtggtagaagcatcctttcagcattataaaccatcaggaatgctgattcccctactgttgtatactggtatataaacttgtacctccctaccatctaaacacctatatagctttgttcttatttgtagattaataatctcttcctttgtcaactttctaaattttggttttcttctcttctgtttaatgctttcctttatgcattcctttgtcatctttggtctcttaatactttgtttcttcatatgtaccagagatttaaataagagttcaacactaggccccacctgcactccctggctccccacaggacatttccccttggtatatgataacataaacactacataaacactacatacttctggcatccctgaaagtgattatctcatttatttatgtgtgctaacctttttcgctcttttaatcttttgaaaggagctaatactatgccaagtcacacctgggatttgttaccattatcacaaatgttttcatatatgagtgacaaaattgaacacttagtgtgtgtctcagactaatagataattttctctagtgcagggaaaatggtgggactattttgttaaagttaaggaattatagttgtcttttttttttttttcatctctcagtgggttgacttgagttgtgtatgtgac

SEQ ID NO: 1489 - DNA, 1204 bp, Homo sapiens
gatggagtctcgctctgtcgtctaggctggagtgcagtggcacgatctcggctcactgcaagctctgcctcctgggttcacgccattctcctgcctcagcctctcaagtagctggaactacaggcacccgccaccacgcccggctaattttttgtatttttagtagagacggggtttcaccgtgttaaccaggatggtctcgacctcctgacctcgtgatccacctgcctcggcctcccaaagtgctgggattacaggcgtgagccactgcgcccggccagtctctggtcatttttgagttggatttttaagaaacagactggagaaatgctctaagctgtgtaggaagaggaggggagaaaaatcagcttaattgcattattgtatttttttttgccttaggaacgtgttgtgggctttcacgtactgggtccaaatgctggagaagttacacaaggctttgcagctgcgctcaaatgtggactgaccaaaaagcagctggacagcacaattggaatccaccctgtctgtgcagaggtgggtcatctacacttatacagtttaaaatgtttaaaatgtgccacatagaagcacaccacccagcttatacatggcagatgtaggaccctgagtttgatgatgattcctcaaaagagggctttgtctctaaaaattagtttttgtctttcaatactgattgctcatggtatgaactggaggcttccgtcatgtcgttaagtggtaaaaattatgagagtgatttatagagctgtgccttaaatattttatttatcatatcttctaaattattttcatggcaatcagttaataatggaagagcttcaatcttagttattccacagctatcttgaggctaattgatactgtctgcctcttcagcttatggtatcagtgaatgagatttgaaaatgatgctttcaaaagatcaaatgacagtagaactagaaattgaccaatctaggcctctgggtgtcagtgtttcttcgctaccagtgatcatccaagagttgaatattgtaatacttaactgcataggaatggtaagccaaaaatgtgtttatattggagaacttgggaaggtgtgggaggaggcacgtcatactataccagcttatatatggagttgaaaattgcagtgattatctgttgtagccagtggcttccaaggtgtacattgcacttg

SEQ ID NO: 1490 - DNA, 1300 bp, Homo sapiens
gaactgtcctgcagctgaaatggactgttctttactgacctgctcagcagtttcttctctcatatattcccaaaacaagtacatctgcgatcaactctagccaaatttgcccctgtgtgctacatgatggatgattattattttaaggtctgtttaggaagggaaatggctacttggccagccattgcctggcatttggtagtatagtatgattctcaccattatttgtcatggaggcagacatacaccagaaatgggggagaaacagtacatatctttctgtctttagtttattgtgtgctggtctaagcaagctgagatcatttgcaatggaaaacacgtaacttgtttaaaagtttttctggtagctttagctttatgctaaaaaaaataatgacattgggtatctatttctttctaagactacattagtaggaaaataagtcttttcatgcttatgatttagctgttttgtggtaattgctttttaaaggaagttattaatatcataagttattattaatattttgaacacaggtggatgtgaaggattttcatttaaaaaccaagtggttttgactttttctgttgaatgaacaactgtgccttgtggaatttttgcagaagtgtttatgctttgttagcatttcaacttgcattattataaagaggtattaatgcctcagttatgtgtttgtcaatgtactggctgaggattctatctcagctgtcttttctaactgtgtaggttgagttttgaacacgtgcttgtggacatcaggcctcctgccagcagttcttgaagcttctttttcattcctgctactctacctgtatttctcagttgcagcactgagtggtcaaaatacatttctgggccacctcagggaacccatgcatctgcctggcatttaggcagcagagcccctgaccgtcccccacagggctctgcctcacgtcctcatctcatttggctgtgtaaagaaatgggaaaagggaaaaggagagagcaattgaggcagttgaccatattcagttttatttatttatttttaatttgtttttttctccaagtccaccagtctctgaaattagaacagtaggcggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtatttttgttacaaatcttctgaaaaaaaacaaaacaatgtga

SEQ ID NO: 1491 - DNA, 1196 bp, Homo sapiens
tagcacttaatcttgtagcaaattatttaaactcattcattcaaggagtatttatttagattctactatgtataatgtgctatgttttgtgttgggctacagcagtggtcaacgtagattattccctgccctcacagagctcttggtcagtgggagagacaaacatttgaaaataacctcacaaataagcacaattgtgattagtgctatgaaaatttcagttcctaatcagtaagaccacaataacctcaaactttgtgatttaaattaattatataaatatataaactgctttccacagtgctgacacaaagcaagaataaaaaaaacctgccactaagaaataacactcaccgctaactcagcctcagattaataggatgtcagaactaaaagaaaccctacaagaatcatctattgcactcactcttagctgagtttgtgtcatggactcctttgacaatctggtaaaaactctatagaatagagttctctttctctaggcaaacacagaggcactcaatattttgagtagaatttcttgatgttcatggactctctgaagccaatccacgtgctggaatcgagggctccaagtaaaaaattcctgaagtagtcatatagtaaatcaacagaagagccaggactaaagagaccatatatcctggactccagccccatgatcttgtattaatattacagcttctgtggatgtcatccacagatacagagctgagattcaaaccaataagcaccatgatgagtgtagcagttaaaatatttcaggattttcattctggttagtaaatgatgtaattacactttaaagcagtaaaattaatttataatataaattctagcactatgattccaagtcctgtctggcttgacattggaacacagagctagagaacctactgcagacatcatggtgtgtatatatgtatatataaatctgtcaatttctgagaaaataaaagcacacagctgagatgaggaagtcctattctggaaatatgcaaaataatgactaactgaaaaatgactaattgtacccaagagaaagcaaagtctgggtttaagtagtagatgtgaaggttaacaggggccataggcctgaagagatgtttggtacaggacacgtccctcctggtgaggcaacagttcctcatgtgggactggagactttgctttat

SEQ ID NO: 1492 - DNA, 1157 bp, Homo sapiens
ctttggatgattttttttcttttatcctactttatgtccttgtgtgtttaattgtggtataaagtgggtttagtcaactggcttcatttctagaaggttttcaggggccaaggctcaactcaggattcctggactgtatgctgtaattctggggggctgatatcaggcccctggctttgttctctggccactggaggttaggtacctgctgtgctagaggggccaagatatttctggaccactggtcagaacacttcaatgggtggtgccagccaaagtgctttgtatggcagtggcagtgggatctgtcctcatatgcacatgccagcaatagcagtggggtgcggtgcacactcatcagcttcagaggggtgctggcagttgcaagggtgctgtttttgtgcaggcatttgtagtggctgtggtgttagcatgggggtggggcgctgtggctgctgctagattttgtgtgccctctgtgcgtgtgcttacatgggtagcagtggccactcagggtaagggggcgggctgctggtctccatgcatagtttcacaccactggcagtgttgacacaggggcagggtactggtggctgcgggactggtgccaaatgtgcgcacgtttatgctggctgcagtggctgcacagggcgcagggcaggtccactggtcactgtgcctagttttgcagctggtggcagtgttggtgtcggagtggggtactggtggtctccgtacctgcagatactccagtggcagtggcagcatggtggtcgggtgcagtgtgctcaagccagcagtagtggcatggccaggtgcacatgtacccacacactggcaggaaattggaggcgaggtctgtgtacacaggtgctggcaaagtgattcgggggttggctgcatgccagcgtctgcaggcaaggtgccatgggggagtctgcagtgggaggagagagtgggatcaggtggtctggtgcacggtctgttgtgggtgggggtagtactggagttctctgccattcaggcacgatctgccaactcaggtgctatagcgtaggcccccaggacgcaccccacctgggcatctaaggctgcactgcaagcagggacagccaggctgaggcccagggagaggtcaggaaactgaggagtgctta

SEQ ID NO: 1493 - DNA, 1094 bp, Homo sapiens
ataggaactacaagtaccaagggagtctcaggctaatggcctcctgcttatttaatttcacatatgtaatattggatgtattttgtttctcagagaaaccagagctagtttttaaagagttgggatatatagcatttggatgtcttcccagggtagaatgatctttattctcttctatggtagagtttagaaagcttaattttgtgcatggtgatgagtgaatttgttagcatcttttttcttcagcatggatttcagaaacatcaattttattttaaagtaaaaataaaggccaggtgcggtggctcacacctgtaatcccagcactttgggaggccaaggtgggcagatcacgaggtcaggagtttgagacctgcctggccaacgtgaatccccgtctctactaaaaatataaaaattagctgggcgtggtggcacgtgcctgtagttccagctacttgggaggctgagacagaagagtcacttgaacccaggaggtggaggttgcagtgagctgagctcactggaggctgggtgacagagcaagactgtgtctcaaaacaaataaataaataaaaattaccagttttgttttaaattatctgtttgaataaaataacctagtttttttaggttattataaagtcaaacttgtcaccatcaagatgggtttaatgagggaggaatatgtgaaaaagaaaaaagatttttacaaagaaaagaattacttatacagttgatccttgaacaatgcaggagttagggtgctgaccccctttgtggtcaaaaatctatgtataacttttgactccctgaaaacttaactactaatagcctactattgactagaagccttagtgaaacataaatagttaacacatattgtatatgttatatgtattatatattgtatttttacaataaagtaagctacggaaaagaaaatatcactaaggaaatcaggaagagaaatatatacttactgttctttaaatggaagtggatcatcattaaagacttcatcctcattgtcttcaggttgagtaggttgaggaggaggaagcagaggggttggcacaggtggaagaggtata

SEQ ID NO: 1494 - DNA, 1228 bp, Homo sapiens
aggagtgcagtctgttgacaaagatgagcatgttaagtaggtttttggaatttttactcttaaaaaattaccatgtagttcttatctcaacttttgttattttaactttcaccaattttacaaccgtttattgtcagcaaggaacttttaatgttattttaggttttctgtttcctgtttgtgaatccctgaacatactaaaggagtgatttattggcgtggtgtttctctagcattgtctttttttttttttttttttttcgagacaaggtctcactctgtcgcccagtgccgtggcatcgccacggctcactgcagcctcgaccagctgagctcaggtgatcttcctacctcagcctccttagtagctggctgattttttctttttaaattgggatagagacaaggttttgccatgttgaactcctggtctcaagcgacccaccggccttggcctcctaaagtgttggggtgagccaccatgcccggcctagcattgtctttaagaagtcatttgctggtcaaatgcagctttgactggtcatttcctgtgtagttgagaataagacaactatttggggttctgagaatctgggcagtcttatatgtaagctgtagggaagagaacacctccctgtgcttggcgttcattaatttttggtctgtgaatcatatctagactaattgttttccaaaattgcctagattaatgctataataagacagaaaccttaatgaactaaatggattcaccggatttaaaactttatgtggttgaagaataaaggagagtgggggctaggtctttatactttaatacagcatgagtcagaacacactttctcttacttgcttcacattgctaatttgaggagagcaaatttttaccttttttagaagacaaaggttgaataaagttattcatatcaataaaagaaactgagttggagttgaatttgttacctttgggaacaagtaatgaatttttatgtgtaacgtgaaatactttgacgaataggcatattttaaaatccagcttattccaatgattccttaaagttacctatgaatgtgttaattctgtgaagaacagcatagtattctgtagtcaagcagtgttctttgctggtttttccaacttgattatgacagttaaataatttaacaaatatcttggttaaattttagacattatagaaataatatgctcaagcaggtataaaacctc

SEQ ID NO: 1495 - DNA, 1626 bp, Homo sapiens
tcggtcaaaatagaaaccaacgagaacaatctggaatcagccaagggtttactagatgacctgaggaatgatctggataggttgtttgtgaaagtggagaagattcacgaaaaggtctaaatgaattgcgtgtgcagggcgcggatttaaagtccaatttctcatgaccaaaaaatgtgtggttttttcccatgtgtcccctaccccccaatttcttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagagaaaaatgataaaggcttaaattgaggattaacagaagcagattaacctcagaaatcctgtctggctggcagatttcaagtaaaaaaaaaaaaaaggtgggttggggggacccttttctttctagttgtctttaaggaaaattaattttacttttttttttgttctggccgaaatttttatgagatatctctcacttgtcttccactttgaaccggttaaagctcatagctgtcagctctgaatgaggaggggagaagcccctgggtctttctttgaaaggaatccgctgcttgagggctgcctccctcatggtgtgcgtgtcgtttctcttcctgacgcatcttgtgatatcagaggtaactatgcaaagcatccaggcggttctgaatgtgaagcactacacccagcagagtcccggtgccctctgtccccactgccggcccatgttctctctccggaggtcaccaaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattgaaaaaaaaaaaaaaaaaaaaacccgaaaagtaaaaaaaaaaaaaaaaagttttgtttagtttactgtgaaatgaactgtatggcttatttacagtatttttaattcttaataaacacttgagctttgttatgacttttccagagtggttacattctgagaatttcgtaattatgatgtgttttattagcacatggtataaacgattagcaaataggtaagtttactattttaaggctgttttttcttttaattctgaaaccgagatggcctcactcttgggccggggacctcctttgatggactgttagcaagtgtgttcaatgattacttgtctccagctctgttagcttcaagcacaggatctcaaccctcactacctattagaatcttcctaggagcttttaaaaaatgcctgggccctgcccgcacagatgctgattgaataggcataaagaggctggcactgttttttttttttttttttttgagacagag

SEQ ID NO: 1496 - DNA, 1188 bp, Homo sapiens
tttttccagatggcttttaatccaagggtaaaaaccttctgattagcctagattcccttgatagtcccttctcttacagcttcatcaaatttatgttaaagattggggaaaaaacaagcaaacaaacaaaaagtaggtagtgtaaactttaacagagtaatagaaggattgacatgggactcgtaactggacataatttttatttctcttaagtataattttattattaaataataaatgcacatggttttaaaaggtcaaacagaacaagaaagggttctttgtacaaaaaaaaaccatcagtccttgtctctcctcctcacccaactttggttaggtataaaagtctaggttgaaaattgttttccctaaggattttggtggccttgccacatggtcatctaaattccatgtaaattgtaatgtcactcttcttcctcgtgtttttgtgccctgtttctctttttccctccttacctccctcctactttattcctttctctctggaagcttttactatcttcttcccttcttgacattctgaaatttcataggctcttctttcattccttgtgctgggcaattggacaccgtcgcatcctggaggtttaagttccttcagttctaggacattttcttatatttatttagttaataatttcctcttcctcattttccccataccctttctggttttcttagtgatcaaatattgggacttccagattgatgctctagttttcttatctttttgccttcttgtttttctttttaggagatttgatcaacgttatttttcagatttttttaaacctatcatattttaaatttctaattaaatgtttaaagttaatttatattctttctctctctcttttttttttttgagacagagtcttgctgtgtcgcccgggctggagtgcagtggcgcaatcttggctcactgcaagctctgcctcctgggttcatgccattctcctgcctcagcctcccgagtagctgggactacaggtgcccgccaccatgcctagctaattttttgtattttttttagtagagatggggtttcactgtgttagccaggatggtctcgatctcctgacctcgtgatccacctgcctcggcctcccaaagtgctgggattacaggcgtgagccagcgcacccagcctattctttctcttatagc

SEQ ID NO: 1497 - DNA, 1177 bp, Homo sapiens
agtaaaaacccgcctgggtcgccatcaccctaggcttggtgcagggcctgccaggcgctcgaatttgttgaagaggtgggtgttcagtatcgaaagagccgcggattgtacattagaaagcctggctttgcgccgcgtccttgccacttgctgaccaggcccctccacgtggtccccgccggggcagcagctctcctcacccgtccaaaggcacggggaggcgcgtggcggccccgccagagctgagccccctgggatgtgaggccgtctcgctctgagcttcagagcagggttgcaggagacacctcagaaggtcgttttgaggacgggaggagatgaactgctcaaagcctgcttaactagataaatggtatcgattaacttttctttgactccctttccacacctataaaatgaagatgacgggaaacttgtcatactttttttgtggtgggtgggaaaggtctttatgaactgtgaagtcctatgcaaacgtgagatgtttcctttcgcaatctgattagcgaagcaaaaacacgcgagtcaaaaacatacacagaaagcaaaaaaaaaaaattcacaaaatggtttatcaactgcagaatattcaggatggtggaactgaatggtaactactgacaacatagctcagaaaggacgtgctaaaacatgctggatgaagctaactttgatccaggtcttaaatggaatggactatagtttatagcttcaacctaatcattaacttatgaaatcagagaattaaggccacttaagccactgtgctcagactgtcaagatatttagtttctcaaagcagaaagaggaaattaaatactcttgtcaattcaacatatgggttggatgattagcaggatccgtggattgttgtttatccagtatgtgaagaaacggatatcctctgttttctcgttattacacaaacttctatccttaatatgtgacctttcaaggttgaactctaggtaaaattatgaagtgcacaattacgtcttgtttcttcttccctttgcacgtcgttttacaagagaatctaattattattaaagtacaaatgactgacaagattgtagccactcctgggagattttgcatttttacggttattaaaagccataactcaaagcagcagttgaatctgtttcataaactaact

SEQ ID NO: 1498 - DNA, 1149 bp, Homo sapiens
caagctttacctagtttttttttcccccttaaatcacagaaaacattcaggaggaatactgttgcagctgaaattggtggggagttcaatacttttcaattaagttatttaaaaatattcttcattgatggaaagcagttacatattgaaatatgttgtttctaatgacatttctgtggtttttaactttttaatgaatttcacagaggacaattggtaatttgtatataaagaacttggcaagagaatttgcttaatgtaaatataaacagtcacaattagtatagacccatcgatatatttttgataatttttcatgtatggtaaagttaaaatgacaaattgatattctgatataaaactcaaagttttgaagtcagtgggaaaaaaggaggtttttagactttcttaaaagacgttaaaattttaggacagaattttcttgatgttgtttgatctaactttgcactctttgataataatgttttagataatgtgcgtaatccaaattggtattgtagcctctgttaacacagacagtatatgttttaaactttgatgtaaacctttttagacccaaacttgtggaagtatcatgtgttaagttctctgtctctgtttctttgttcatttattactaaaatgaacttgttattaaagtatatgcaaatatgaaatcttgtgtacgtgtttttttttcttttttggtaagggagagagtattgctgtatgatatatgattacaaattacaaagagattctataaaccacatcatcattttgaaggaacagctaccatatgtttagttaaacagtgtttttcaaaattatatgcaagaaagaggtaaaactaaagggacttttttcaagtaatggcatttgtaaccataaatcaggcagtatgggctagcaatcaatagagtgagctctcgagtcaaatgcccatttctgccattcattagctttgaggtcttgagcaagtttaaccttctatgtcttctttcttcttatctataaaatagggatgagggtagtatctgctttatagttcagttccatgtaaaatacttatgagctggcatgtgatagggtactcagtgttagccacagggctgccatgctgtgtcaccccctgtcgtgtacagtgca

SEQ ID NO: 1499 - DNA, 1197 bp, Homo sapiens
acctgcttcttaaatctttacttcaatattacttgagcttttcatttttcattttattttaatttttttcatggttgattctatttattattaagcttttatcagccagtcgttcatttagtcaatccataagcatgcattaagtgccagctataagcacaataatagtgagagataatattcatcaaattatttgtgtgccaggcaccattctaagtactttacatgaattaactcatttatcccccatgataactccatgaggtatgtattattattgtcatccccgttttacagatagacaaagtgaggctgaggatagctaatttgcccaagatcacagggactggaagtggtagcacagggattcaggcccagcaggctggctccagaacttgcttcctttgccaccatacttttgctgctgtgtgtccagccctttgccagggaggggggactccgggaggcctcacatgactcccgttcagcacagccagaatggagaaagagtgcagtgtcagaagggaactgctgggaatgggacagatcagggaaggtggtatttgaatcggactttgaaagatgaataggactttgaaagatgaataaaaccagccatttgaggattggaaattgggaaggtgttctaggtgagaggagcagctgtcaaaggttccaggtaggaaatccagagatagtgggggacgcatagaccaactgagacagactggcttgggggctggactgcccatcagctcgtttgcagaggtgcagctgtttaaccagttattaaaatgctgaaatgcttctctctatgggttagtaaaaagccactgcctcaagtgctcccaaagccacgatgtccctgccatccagcaacaacagcttggcatctggccctgcaggtgctccaggatgccctgtctgcgctgaggctgtaggagttgatcggtgcctgagccttaacagtagttaaatatttagaatatcatcctgagttgagagtgtcggggagaagatttttgtctgcaggtgtcatgggggcctttgatcctttgacagcagggttagggttgaaggtttggattggggagaagcataagcaaaatccaaatgcctctgctcatccttcaggactcagctgcatccccacctctcccgtgaaagatttgctgacctgcgcccctggcaggagaa

SEQ ID NO: 1500 - DNA, 1099 bp, Homo sapiens
ggctgtgatgaagatggacggcatgactatcaaagagaacatcatcaaagtggcaatcagcaaccctcctcagaggaaagttccagagaagccggagaccaggaaggcaccaggtggccccatgcttttgccgcagacatacggagcgtaagtgcttgcatggtagactagtgcaaacttcgtcctggctggcaccagttcatggatcacggggggattaacccgggatgaattagcttcctgttaggacagaaaagccaagatgtgctgttccttgtggtaatcactgtggttccactggagcaaggcgtccagagcaggatgcaagcctaggcagtgacctctgcctggtactggccaatttacacttgtcatttatttcagacagaaataaggcagtgattattttaaagtcccctttgccagttggatctgtgtgtttacaaagaaatctcatacccatgtgtgtgccagtctacggccctagctatgatccacataagctgtgctgttcgctggtttgggatgaggaggagatagcagaattgccaggtgactggtgaggtctgagaggtgatagtcacactgatcccctctgagtgtgactggtgctcagggttgatctttgccaaaactgaacaaggccaagtctgttgaagcagtttttacttcataaacagaattaaggaggcagggattatcttatcctttttttttttcaccttttaacttctggttatattaaaactgtcttggcttattttcacaaataaatgaggggccacgaattgttgcttcaaaaggtccattcagtgtttgctcttttaggagggggaagggaaggacgcagctgtctctactgcctcgtgccctgcagcgcccaagtgctgcagctcctcaggctgagaacggccctgccgcggctcctgcagttgccgccccagcagccaccgaggcacccaagatgtccaatgccgattttgccaagctgtttctgagaaagtgaacgggacgctgggagacaggaaatgccttacttcactctggcccggcggacctcccaccacccagcagtgcactggggatggacaggcctggt

SEQ ID NO: 1501 - DNA, 1260 bp, Homo sapiens
cttcctctatggcttccacttcctgcccaaagacccaacttctgtccgaagttgtgacggaacgcatgccattataatgagtttttatatctggtgggagcttttacagggtataaaataatgtgaatttagtgtatgtggagattttcctgttatctaagttcccagtttctctttcaatggcaagaaaacgggtttttgataaggcgcgcgccgcgggcagcttctgcctcagcgggtcttcggcggccgcgggaagacccgagagtcattagaagcgcaagatggcgactgcggccgaaacctcggcttcagaacccgaggctgagtccaaggctgggcccaaggctgacggagaggaggatgaggttaaggcggctaggacaaggaggaaggtgttatcgcgggctgtggccgctgcgacatacaagaccatggggccagcgtgggatcagcaggaggaaggcgtgagcgagagcgatggggatgagtacgccatggcttcctccgcggagagctcccccggggagtacgagtgggaatatgacgaagaggaggagaaaaaccagctggagattgagagactggaggagcaggtgggcccgggggtgggcagcgggcatcttccagtctttcaggtcctcgggtccccatgtcctggcccgcctccctagtcctcggcggcgataaagccgccaaggctgcaaacccgcttttcgtgacagtagctcctgtcggatttgagtgcttactgcctgcccattgccttgcaaacgttatctcattgaatcctcgccacgaccctgtgaaggaagccctgttatctatccccattttactggaggaaactgaggctcgtggaggaaagtttcttgctcaagataacacttcctgcaagtcaggccttgtactttgatcccattccagaactcccactcttaaccacacgtccaacagtagaaataaactcattcgcaagagagtgttattttgttatgtaggaatgacggcgatgatgaaacttgtggtaagaaaaatattgaccgcgatggtgataatagaaatggaaaggtttctggttctggaggttaaggcctcagttctagctgttcaactcttgtatgtgcttgtaagaatttcttaatttctctcaccctctcgacttccttatctgcagattgggagcaacaatttctgcataatataattgttgtaacagtaactatagctcagtgcctagcatctagtcataacatggtc

SEQ ID NO: 1502 - DNA, 1595 bp, Homo sapiens
acgtgtactgctgagtgttccttcttgcccttttcagcagcttgcccagctcttgagtacagtggtggggactaaaaatgtgggcatgtggagaggggtatttgccctgggtgatcctgtttccctgtgctgtccccatgctgtgttggaggaggaagtggctctccttccaccaacaaagctcctgctctaccctcttcctcacatgtgctgcgacctctctcagggctcccccagccattccttctttccttcctgccttttagctctaaccacattaagctaagacaaggccagagggtgcgattgaatgagtattgagactgaggagaatgatagagagtgaagcagaaacaggagcacagacctctgctgtagctttaatgcatacaaacatgtccctccgcacaactaacctgccctgcctctccatctctcaccaaggctgcgtcaaagcacagaggctccccggactcggagggggccagagactgagctctggtcacctgttcattcctcggttagctggaactttgccccgtttccagtttcttatagtgcatgcttgggaaacaagatttaaggagcctctgttttggaagggctgtctgtgattgaacgtgaaatgtgtagtgccattgggaccacgaagggaattcttgcacatgctcgtgctggtgtgggcatgggactggctggaaacgtctgtatgcagggagccagggtgagggcagagtgtggtgacagccgaacttggagtaatgtccgtgtagaaaaaggaccatgttcttatccagccaatactgggagtgctgtctccacaatttcagggcatctgaatgtttgatgtggttttgtgtgtgtgtatgtatgtgtttaatattgaagtggatcatgagatgtaaagaaaacaataatggcaatgacttatattcaaatctgtatttgtttctttatcaatgtaatctgctgaggaccttttgtctaagattcagtagtgttttaaggttctgatatcgaattaatgaagtaaagttgttgatggtggtgaaacaccgtagggcatgtggttcaaagagaagcaggagggcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaacacttgcttccattttcagagataaaaatcattgattacaaaatggtgtttgtgtttatttcacgccttggctgtctgtgaggcagcccccacctctctgcctgacatagcttctctgactttggtggacgagcacggtgccatactcctctccgggggtaagtacaggggaagcgcgtgtgggtggctcagttcaagtacaagtgaggtctccaagccagtcaagcactgtgttttggcttccagcagacctgagcctttggatcctgcctcagacctttgccagcggtgt

SEQ ID NO: 1503 - DNA, 1217 bp, Homo sapiens
agaagtgatataaatagtggaaagctcagacaggaatttggctgagggtggagcaggaattgagccaggggccagctgagctggggaaagtaaaccactatttagtattcttaggataattctgatcccaaccctctgtcccattgttcccataaatgtcccagaacactaacatttcagggtcgaagctacatctcccaatcttcctcagaccaggaggtggcccacagattcctcactaggtgtggtctggggcctctcagagatcaatagaggcataagccatttctatattttgaggctcttggcaaatggaaaaatggagaaatgttaaaacgggattacaaaacgatctatttgaaatatttccattgaacaagttaacagttttaacatatatataaatagctacatttatgatctcattgggagatgatatcaaaagtctaaatatggcatcattagagcaaaactggggccaaagttctcccctgactacaacccccatcagagaccctgatcttttatccagttgtgaggcagccatgaccctcagtcctaatgaacacctacacctttttacctgtatctgcacccactcctgggcctgcactgacacctgcacccccacttgtacccacacttgggccaatacccgcaacctgggccggcacccacaccctacacccacacttgggcctacactcacacctgggtctgtacccctacctgcacccacacctgcacccatacttgggccaatacccacacctgggcctcacccacacttgtacctacacttgggcttacacccacacttgggcttacacccacacctgagcctcacccacacctgtacctacacttgagcttacacccacatctgggcatctaccccacctgtacccacacttgggccaatacccacacctgggcctgcacccacacctgggcctgcacctatacctgcacccacacttgggcctatacccacacctgggcctatacccacacctgggcctgcacccacacctgggcctatacccacacctgtgcccacacttgggtctatacacacacctgggtctgcacccatacctgggcatacaccaacacatgcactcacacctgtacctgtacccatattcacacctacacccacacttgggcctgcacctccacctgggcttacattaacacctggcccgcacatctac

SEQ ID NO: 1504 - DNA, 1190 bp, Homo sapiens
tgcccaagcttgtcttgaactcctggcctcaagccatcctcccacctcggcctcccaaagaaagcatcacagccttggccaggcacagtggctcacgtctgtaatcccagcactttgggaggctgaggcgggcggatcatgaggtcaggagatcgagaccatcctggctaacatggtgaaaccccatctttactaaaaatacaaaaaaaaattagctggatgtggtggtgggcgcctgtagtcccagctatgcgggaggctgaggcaggagaatggcgtgaacccgggaggcggagcttgcagtgagccgagatcgcgccactgcactccagcctgggcaacagagcgagactccgtctcaaaaaaaaaaataaaataagaaagcatcacagcctttttgttcacccacctcactctcagtgtctctgagataactatcaactgccaccctttgggaatgtagagggtacactccccctttaggaaggggaaatggtattgaaagccggactagggcttgctgagttggtagtcctcatcagtctccctacccgactcctcctctctcccagttaccgaattaccatcggcaataagacgtgtgtgtttgagaaggagaacgatcctacagtcctgagatccccctcggctgggaagctgacacagtacacagtggaggatgggggccacgttgaggctgggagcagctacgctgagatggaggtgactgcagagccggccgtggggaatcctgaaccctcaaactcccactcttctggctttgtcccatgtctgaacaaacaggcctacctctccccttgaccactgtctgcaaatttctaagggaatcagtctgtggatttcagccaaatcccctgaagtattcaaagaaaaaaacttcaggctgggcgtggtggttcacgcctgtaatcccagcactttgggaggctgaggcgggcggatcacgaggtcaggagatcaagaccatcctggctaacatggtgaaaccccgtctctactaaaaatacaaaaaattagccgggcatggtggcaggcgcctgtagtcccagctatgcaggaggctgaggcaggaggatggcgtgaaggcaggaggatggcgtgaacccaggaggcggagcttgcagtgagctgagatggcgccactgcactccagcctgagcgacagagaa

SEQ ID NO: 1505 - DNA, 1332 bp, Homo sapiens
tgcatgtgggagccactccaagtccccttctccatggcccagcaggcatggccccccgaggcatgccaggtctgggccccataactggccacagagacagcgtaagtggcactgcatggactgcggagggcgggtagtgccctccagactgggtgtctacccccaccgtgaccctctgtctcctcctcttcctgcccagcagatgagccagttccccgtggggggccagccctcatctggcctgcaggacccgccgcatctgtactcacctgccacccaaccacagttcccgctccccccgggtgcccagcaggtaccaagggctcaggggagccctggactgagcagcagacaccctgccttgggctggccggggacccctctgagcctcagtttactcacccagcacatggggataacattccctccatgctcatgtcatggggtcattcattccgttcccccaaaactcctgccctgagtggagacaagattgtttcctggacggttgtgaatccccacacaaggtgttttgaaactggggtggggacagtgttactgtgagtgacgtatgttatttctcaccttctctctttctctgccactttctccctgcccctgcctgtgggaagtgccctcctgtgggcctctatggccccccatttggggtgcggcccccctacccccagccccacgtggctgtgcattcatctcaagaactgcaccccaaacactaccccaagcccatctactcgtacaggtgaggtccagggtgggccgggtcagggccaagggcggctccgggagagagggatgaggctgccctcagggcatctcagacagctagtgtggcagcccagacttccaagggggaggttttggggagtggggaacccccaggtgggacttgttctcaggaaggcgcatcatagggtcccccaggtcaagagcccactgcagacctgagtccagtgccacagttcacttcattcataagccacgtggccttggggaagtgggatgacctctctgagcctcgatttccccaaatgtaaaaagtcatcaaaataatagtattgtatacctcgtgggagtttggggagggggaaacaacctaggtaaagtctgaaggctcatagccattaaaattatggggatgcaataaagaggggaaagggtaagatttctcaagtcagtaccaattgttgtgcccagatcaaggagaaagggcaaagggtgggaaagacatcgggccatgaaaagatattgagagctcactgtgtgtgagtgtttagggtcaagcagggcaggcttcctggcagaggcggcatt

SEQ ID NO: 1506 - DNA, 1225 bp, Homo sapiens
caattctcctgcctcagcctcctgagtagctgggattacagacgcccatcaccacgcccagctaatttttgtatttttagtagagatggggtttcaccatattgtccaggctggtcttcaacacctgatcttaagtgatccgcctgcctcagcctcccaaagtcctgggattacaggcgtgccacttttttatagtaacaaccatgagacaggtactgacattatcccaatctacaggtaaggatactgaggccaagagacatgacttgctcaaaggcacacatttatgaaggggcagaacttatattattaatcacctgcccctaccttttagaatttattctagaggtcaggtccaacaagctccttttacagattgggaaactgaggcccagtgagatgacggaaggcaggcttctggcttcttggaccctcaccttctcccagggccacaaggctcagtggtcctccttctggatcctcgtgctggatgttcacttcccaaaatctcagtccctgctctaagaaatgaggcgaccttaggggaaagcccttcctctctctggatggtggttctcttatctgtggactgcaatgctgggcacacagtagataaaagttaatacatatgtactggatagatggatgaatggacaaatatcacgtgaaaataacacatccatggaaacacagggaggcttcatgctcaagggatgataaatttctcttgaacccacactgcgtgtggggatagtttaacccatatcaggtggcttcacccatcagttgtgatctccttggaaggggctccgtttcttaggggcagtaaccatcccgatgtcttcccatcccttcaccctcagggtggagagaacagctcctcaggtgaccttatgggcaaggaagagaggtagcctctctgtggtccgactctttcccagtcttgcagtttcatccctaaaaaacacatgtgtgcatgcactcacacacacatgcacattctaagtcccaagccaactcttgttctagaaaggaaagattcttttatccaaattcctaatcaaatcatttcacactacactgacccttggccaagctgggaatttctgagcttgctaaattgtatttgattttctttatcctgcacatggttacaaaagatgtgttagctaaataaacacctccatgaaatgcttaatccctttttgtgtaatggttggattgg

SEQ ID NO: 1507 - DNA, 1214 bp, Homo sapiens
aaaccaccccaaatttagtgacataaaatcacccttttattctcaccaacttggtgagcaaggaattcagaaagtgtataatggttggtcagatgtggtggctaatgcttgtaatcccaacatttgggaagctgaggcgggaggattccttgggcctgagtttgaaattagtctgggaaacatagtgagaccctgactcaagaaaaaaaaaaaaaaagtgttcaacagagctggcttgtctttggtcttcaatgtctgggacctcagctaggaagaccccaaggctggggtgggagtgacttgatagttgatctcaagtcatactaagactcactctcatgcctggctcctggactcggggcactaaaggatgaggtcaactgaccagaatgcctacaggtggcctttccatgcgctgggctttcttacagcttggcggcctcagggggccacatgctgcaatggaagctctgtctttaatctagccccggaagccacacagtgtcccttctgccacattctgttggttacaagtaagtcacaagccacctagattcaagggagagagttacactctaccttttgataggggagtggcaagatgtagaacaagtgggatgggagatactgttgtgaatgtctttggaaaatctaatctgcctaacttattttataagcttccccctgccatgattaagatgcttttgacaaaacaccacacctcttcaatgtgtctcttaggtattaaaattgtgtaattgatattagggtctaaaattctgctcagggagccaagagtgaagataatgggtgaacactgatttctttctacatttgttaccttatctgagaaagaaagtctcagttctcatttctttttctttttcttttctttttttttttaaattttactttaagttccaggatacgtttgcagaatgtgcaggtttgttaaataggtatacatgtgccatggtggtttgctgcaccatccaacccatcatctaggttttaagccctgcatgcattagatatttggcctaatgctctccctgtccttttcccctaccctccaacaggccctggtgtatgatgttcccctccctgtgtccctgtgttcttatcgttcaactcccatttatgagtgagaacaagtggtggttggttttctgttcctgtgttagtttgctgagaatgatgacttccagcctcat

SEQ ID NO: 1508 - DNA, 1201 bp, Homo sapiens
acactaacctaaggtacacatcccatctgggcggtggcttcactcctgagtctgcaaaatcccaggaaacttgggtcttgctgcccatccttcctcagcacagggaacccggaagcccgttgcactgacagaggctcacaccctctgggttttttgttttttttttaaacttcatttctcttccaacccattgtgttcctctgccctcattctttacctttgttgtaagaactttagctccagggaactgaggcagaggccctgtttgtggtctgtgttgacagccacccaccctctcccacctcatgctcctgcacctgcaccaccaaggttgatgccggattcgaagccaggaaggcccagtccctcctctgctctcctcaaagacgcaaaacattttccaacaagagctgtcacagtggcagcaaagcaggggccacccgtctccacagtccttcagagtttcagctgcatcctggtgtcccacccaggtcgagcccccaggcttctggaaaagagtgtgtgctctactttgatggaaacatggcaaggaatttaaagacaggaatgtattaatattattgaaggtgtgttcgtaacctctgattctgtggacttgccactttctccaaacgctcggttcctttgaagatttcttctgaacgtgtgtgcgcacgctgggcgggttcgtgcatacatgcggggaccccagactgtcagcacagggaagatggatcccatcctaatttttatcacctgaaggttggaaccagtgagggactgggagagagtgatttataagcaccaatatcaacttcatgtggatttttgacaaggaggggtagtttgtaatttcatttaaattcttttcagcagctggaaatattgcactatctgaaacactgaatctccttttgtaactggtgttcactgacaccttgatggctcttgatggctctaaaaagttgtaggattttttgtttttgtagctaacttatggattgagatgtgatcaaaggctttattaaatttgtacttcagcatatgatggctgcgttctgcatttcattccgccatatgcctggaccgttcacacttgggtatctgggcttagggagcatgtaggcttccacaatggagggaagatgtggaggggcgcagagcacatgtcctcatctccccagccagagttcagggatgt

SEQ ID NO: 1509 - DNA, 1195 bp, Homo sapiens
actagttgtcacactgggtgcaggggtgccactggcacctggtgggtggagaccaaaggtgctgtcagcatcctacactgcacaggatgcacaggacagccccgaacacacagaatgatccagaatgtcagtagggcctagtccagcagtgtcagcatcagccagggcaggaactagacctgcagagccccgggcccagcccagcccagccctcctgagtcagaatctgcacgtcgctgagatcccctggtgatgcctgtgcacactgtagtttgggaaacacccaaactgatcacgcacctgagccctgatcactcaaaggtgcaaaaaccggctcagagaggagtccaaagtcatctgccccatggggtagggccggggcaatggcctcatcctgcaggaatggccccagccttgacactggagtagagtccttggcattcacagcagctggcctcgtgtgccatccattaagtgcaagatggctgggcccccgccctccctgcacaatgtgcccagagtgcgtcatttatatctcctccttgtaggcggatatgggaagacccagttagcgttgatctctcatttcaaaccattctgtttgcttctctctctctgcccctccagactcagtgactatctcttcacgctagccagatatgcagccatgaaggaggggaatcaagagaaaatatacatgaaaaatgacccatcggccgagtctgagggactctgaaatcacagaaagtgggagcttggaggatccctccatggcgatggccgtggagagaggagcttgcccttctggggtcctggttcctgaagagctcacccagagaggctcaaagcagccttttgtcccagctcagctttgatctacacctcttgccaccttcctcaagggactgtgaccctttggggattctgtccctgaccctgcttccccaagctctcctgggtcttggagggatgtgggaatgaattggcattgcaggaaagacaggtaaagtgattgctgcaatgagaaggagctgtgcggaaaaggaataaaagttggaaaggctggagccgtgtgtgtgtgtgtgtgtgtgtgtgtgtgtgtgtgtgtgtgtgtgagagagagccctcccactgccagctcaggttgttcacagatttggaatgggaccagaggcccttgaaaatgtaattgtga

SEQ ID NO: 1510 - DNA, 1199 bp, Homo sapiens
ggtattgggtgcctgtaatcccagctattcaggaagccaagttgggaagattgcttgagcccaggaagttgaggctgtagtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaatgattttaagttggggacatttgtgggtttgtatgagaacctgactactacccatagtaagtaaatagaggtaccctgaaaatagt

SEQ ID NO: 1511 - DNA, 1197 bp, Homo sapiens
tttatatcaaggatgtgacatcctaaagctatgaacaaaatgaagaagctttggtactgtgggctcagaatagcacaagagttaaagaatggtttgataacgggtgtagtggtatttttttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtca

SEQ ID NO: 1512 - DNA, 1366 bp, Homo sapiens
aacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattg

SEQ ID NO: 1513 - DNA, 1705 bp, Homo sapiens
agtaggattcctgttgtcacatattcaatcaagaaatacttaattatggtttttggccgggcatggtggcttacacctgtaattctagcaccttgggaggctgaggtgggtggattgcctgagctcagcaggtcgagaccagcctgggcaacatggcacaaccccgtctctactaaaaatacaaaaattagccaggcatggtggcgcgtgcctgtagtcccagcttctcggaaggctggggcatgagtatcgcttgaacccaggaggcagaggttgcagtgagctgagattgtgccactgcattccagcccagggggacagaacaagacactgtctcaaaaagaaaagaaatactaaattatggtttttctctcatgcatcgctcagaatagggaagcagttgccttttagccaagggaagatgtagcccgttgctccttgcatgtggaagagagatatcgtgccttactttctttcttctgctttctgttggtttaggcttgttgtccctttctgtaaaaggggcagaggtggcatccatgacaatgaatgtgatccaaaccgtgcctaacttggactggctctctgtgtggatcaaagcgtatgcttttgtgcacactggtgacaactcaagagcaatcagtaccatctggtgagagccacaaagttaattcagtgttcttgaggccctttgcttgtctggaagtctgatgtatctgaagtagcaaaaagaaaaatgagatgctttgctgttggtgctgcagccagtctctgggatgtgttagtcttttatactgaatggtcccaaatgtaatcatgtaatcatctctgttggagacctgtaaaaatagaaatctgactgagtttagctctgtgcctgcacaggtagtaacccttgcaaagcaaagcaggctaccttggtgtgtcatttttttttttttttttgagacaaggtcggtctctctctctctctctctctctctctctctctctctctctctctctctgtctctctctctctctgtctctctctctctgtctctctctctctctgcctctctctctctctctgtctctctgtctctctctctctctctctctctgtctctctctctctctctctctctctctctctgtctctctgtctctctgtctctctctctctctctctctctcccaggctagagtgcagtggcgcagtcacagctcagtgtagccttgacctgtcaatctcccgggctcaaaccatcctcctgctcagcctcctgagtatctgggactacaggcgcatgccaccacacccagctaatttttgtatgtttttgtagagatgggatttcaccatgttgcccaagctggtcttgaattcctgggctcaagtgattctcccacgtgggcctcccaaagtgctgggattatagacgtgagccaccatgcctggccttggtgtatcattcttcagcctggaagaaaatcattttgcactcaccagaagcttggtttattgcagtgtctaacctagcttgcctgcttaggactagggattttctttatattcagataaagttcaaggacaagaagagacttgggcttgtgttatgcaaagtcgtttacttgagtaataaataggtgtcacttgtgaatgacattacctttaacaccatgtagcgtatgttgtgttctgaagaactgcaaccacagagtt

SEQ ID NO: 1514 - DNA, 1384 bp, Homo sapiens
ggatcccctacaggttggagaaacacttttgtaaagaactttttcccctgtatcagaaggagtagctaaagatactaccaggtgtagacttcagaagattgtcattatactcagaggcaaaataatttgtccagataatagattttatctgttcgtcatagcgttaattaccaaatgtttacattcaacatagcttgtgttaatatgctaggggggcttttacagttgttggggcagttgtgaacaccatctgaacagaagatctgaatgaaatttaaggactcttaagatttggggttgagtatatttcctaaattaactgtcttttgaatctccagattttaaagcctgcagagaaaaagaagccaaatgccacgagacctgtaacgcctccaaggggtatgatcacaaagcaagcaaagaaatagatgtcgttttgacactgcctagtcgggacttgtaacatagagtatataaccttcatttttaagactgtaatgtgtactggtcagcttgctcagatagatctgtgtttgtgggggcccttccttccatttttgatttagtgaatggcatttgctggttataacagcaaatgaaagactcttcactccaaaaagaaaagtgttttgttttttaattctctgttccttttgcaaacaattttaatgatggtgttaaagctgtacaccccaggacagtttatcctgtctgaggagtaagtgtacaattgatcttttttaattcagtacaacccataatcatgtaaatgctcattttctttaggacataaagagagccctagggtgctctgaatctgtacatgttcttgtcataaaatgcatactgttgatacaaaccactgtgaacattttttatttgagaattttgtttcaaagggattgctttttcctctcattgtcttgttatgtacaaactagtttttatagctatcaacattaggagtaactttcaaccttgccagcatcactggtatgatgtatatttaattaaagcacacttttccccgaccgtatacttaaaatgacaaagccattcttttaaatatttgtgactctttcctaaagccaaagtttctgttgaattatgttttgacacacccctaagtacaaggtggtatggttgtatacacatgctgccttcttggggattcaaaaacaggtttttgattttgaatagcaattagtgatatagtgctgtttaagctactaacgataaaaggtaataacattttatacaatttccatatagtctattcattaagtaatctttttacagttgcatcaggcctgaacccgtccattcagaaagcttcaaattatagaaacaatactgttctatacgagtgaccgattatgctttc

SEQ ID NO: 1515 - DNA, 1114 bp, Homo sapiens
tctctgcatctatcgaaatgatcatatggtttttgtacttcaaaagcaggattccagagtctagaatcaattctgccaaattggccatgccccttacagaatgccacttggtaggggagtgcatgtttccctgcatcttcaccagcactgggtgttatggtcgcgttggatttctgctgtggtgcccggtgtgtaatggggcctacacctgcttgcccacctgcttactccttgtcgcccccccacccacgtgtctttcagcccggccgcaccacctgggtctccgccatgaacgggcctgccctgcagccctcctcgccctcttccgcgccctcagcctccccggcggcggccccgcggggctggagcgagttctgtgagttgcacgccgtagcggcggcccgggagctggcccgccagtactggctgttcgcccgggagcatccgcagcacgcgccgctgcgcgccgagctggtgtcgctgcagttcaccgacctcttccagcgctacttctgccgcgaggtgcgcgacggacgggcgccgggccgcgactaccgggacacaggccgtgggcccccagccaaggccgaggcgtccccggagccaggccccggccccgccgcccctggcctgcccaaggcccgcagctctgaggagctggccccgccgcggccgcccgggccctgctccttccagcactttcgccgcagcctccgccacatcttccgccgccgctcggccggggagctgccagcggcccacaccgctgccgcccccgggacccccggagaggctgctgagacccccgcccggcctggcctggccaagaagttcctgccctggagcctggcccgggagccgccacccgaggcgctgaaggaggcggtgctgcgctacagcctggccgacgaggcctccatggacagcggggcacgctggcagcgcgggaggctggcgctgcgccgggccccgggccccgatggccccgaccgcgtgctggagctcttcgacccacccaaggtaagtaagccctgcccgcggggttgcgcactgcactgcgcccttcgccttcaccctggggagagcgcgggctggggaggtgtgatggctttcc

SEQ ID NO: 1516 - DNA, 1191 bp, Homo sapiens
tcctaaattcctttgtactttttattttcttccttggtcttcaattatcttaagactaccaagaaaacaaaaattttaaaaatcttcttcagccggtcaggcgcagtggctcacggctgtaatcccagcacttggggaggctgaggcgggtggatcacgaggtcaggagttcaacaccagcctggccaacatggtgaaacgtcgtctctactaaaaatacaaaaattagctgggcattgtggcgcgttcttgtaatcccagctgctcaggaggctgaggcaggagaattgcttgaaccaggacccgggaggtgtaggttgcggtgagcggagatcgcgccactgcactccagcctgggctatagagtgagactccatttcaaaaaaaaaaaaaaaaatctgcttcagctattctgttaatcttttgacattacttagatggtctggaaataaattttgagaataacatgattagaagtgagagagtataagcatagttttggagatacactcagaatagcattatagattttctctttttactaattggaaaaatggcagttgttgaataatagttttcttccgtgacccttgtgacttaaaaaaaaaaaaacactgaaatgaaataatcgaaccattttctctaaacctttgaatctgagctctgcagttaggtttataatggtatatgaaacctattagatatatacttggaagtcatatgggatacaaaccctgcttttattatcttccccttttgactaacttgggtctcaagtttccttaattactgcacagtggaccttgatgttgctataaagaatgtgtagggctgggcatggtggctcatgcctgtaatcccagcactttgggaggccaaggtaggcagatcacctgaggtcaggagtttgagaccagcctggccagcatggtgaaaccccgtctctactaaaaatacaaaaaaattagctggttgtggtggcgagtgcctttaatcccagctactccagaggctgaggcaggagaatcacttgatacatttagttaggagagaaaatcatacttatgttagtaattgctgctgttcttcatatacttgtggttttgattgccagcaaattcctaacattttggaaaagaaaacagtaatgggataaagggtaagggctagagaggacagttttatttacct

SEQ ID NO: 1517 - DNA, 1099 bp, Homo sapiens
agggaaagcgttggcttctcccttctttctcccaaacattggaagtatttttggctgttaaaaagcaccccttgttccatgtggaatcccttgtttaaaagaagtaaaatatgtacctcctgtcctccacagacctgaggaccagtgtgatctcaagaaggttacaggtaaatgtagatgtctctaactgaaaggtggcttttacaggttagagaaaagagagaaccctgatctgaaggctattttatgaagtaattaaaatgttctaaactttaaaaataactgctcaaataattgtgttgtatagttacttatcaactggaggggctgataagtatttttctaaaacatttttaaggaaattttttcctattttctaatttgctaattttgctcaagtagtttgttagatattgttaatatagatgttggttataactgaatgaaagggaacaactactttgacattttgaaaaacaagcttcattttcttctagtctaatggatgggatcccaatgatatgtttcgatataatgaagaaaattatggtgtagtgtctacgtatgatagcagtttatcttcgtatacgtaagtttgaaaagtttgtttttattttagtgcatttgtctttgattttcatcagcttaatttatgatgaataaatgtttgttagtttttaagttaaacaattacatgaaataatttttctcttattaccaactgtgataaatttccattaaaaaaagggaataaatgtagtttgcctataccctgtttttatgctctaaacaaattttggttttgtctttttttttcttttgagagggaatctcgctgtgtctccaggctggagtgcagtggtgcaatctcggctcactgcaacctctgcatcccgggttcaagcgattctcctgcctcagcctcccgagtagctgggactataggcgcgtgctaccatgcccatctaatttctgtatttttagtagagacggggtttcaccatgttggccaggatagtctcgatctcttcacctcgtgatccacctgcctcggcctcccaaagtgctgggattacaggtgtgagccactgtgcctggc

SEQ ID NO: 1518 - DNA, 1194 bp, Homo sapiens
acgacgccctggccggggagttcatcagggcctctggtgtggaggcccgccaggccctcttgaagcaggggcaagataacctctcaagtgtgaaggagactcagaagaagtgggccgagcaatacctgaagatcatggggaagatcttagaccaaggggaggacttcccagcatcagagatgacacggatcgccaggctgattgagaagaacaagatgagtgacgggaagaaggaggagctccagaagagcttaaacatcctgactgccttccagaagaagggggccgagaaagaggagctgtaaaaaggctgtctgtgattttccagggtttggtgggggtagggaggggagagttaacctgctggctgtgagtcccttgtggaatataagggggtagtgggaaaagtggtactaacccacgattctgagccctgagtatgcctggacattgatgctaacatgaccatgcttgggatgtctctagctggtctggggatagctggagcacttactcaggtggctggtgaaatgacacctcagaaggaatgagtgctatagagaggagagaggagtgtactgcccaggtctttgacagatgtaattctcattcaattaaagtttcagtgttttggttaagtggacctgaagccattcttttttcttttcaaattatactttcgtctatgacctgctttcctctttgaatctaagctggtatagactccactttcccagggtaacaaactatcctcataacactgtggaaactggcatacctttgttattttccagtgatattcagactgacatggattgactgtcaatggtaaagtttgtctattttccagtccttaaaactcaatagcagtattgatgaatatattgaaccaacattgatggaccatggtgtaattattttccatgctttgtgaggtacacatagcaaattcttagttttactgatatattctgtgacttggatttacacagctaaatgatatagtccgatttcaaaattaaaaaatattttccatctaaatcactatcactaaataaatactaacttctagaaagcagaataaagagcacttgtgccaacattcacatcttttcttcagactcagaagcagttatctgcaaaagtgagcttcacgacagctctactttcatatttaaccatttgaaaatgtca

SEQ ID NO: 1519 - DNA, 1159 bp, Homo sapiens
aatctggggggatggtttttaaacaagactaattattcttgtctcctcctttataggaagagagaaaattttcaaagactgtgcaagggaaggtgcagagcagttatctgcactcacttctggaaatgggggagctgctgaaaaaaagacttgagaccacaaagaaactaaaaatttaaggaagtatctatcatgggcactgatgactctgcaacagaatatgacaccatcttcccaggcaaaagcaacatctggttgaccatgattttaatccagaacttcctcataaaatgcatgaaggactttgatcgtgaatttttttaggtgttaaatatatacaactgattaaattattgtatataaaccagaagcgggaccctcatctgggtttgaccactttttatacatgttcatatgcatatggcagcaacaagagaaccctacttttcttcttcccatcaccagaaacatcttttcaggggagcggggggtctataaaaacagcaatagaaattaagcataaagcatcaacctcatagcaactgaatagcccttccattataaataacattgagagtttttggtctggtccttgagccacaagaagtggaggggagaccatgcctgggaacagacccccttttcacagcagtaagtttgttttgaggctttctcagctacttggctcccacagaacccaaggcaggtacacaaaggaccttagatgagatctggcatatgcacccgcaatagaagggcaccacttggatgaccacaggcacttagtttttggctagtttttgtctgatagttaagacatccccatcctagcttctgtgagagttaaaaatctcaggtaagaaggcaaggaaggctctgttaatttatagctgtttagaggggaaagcagtgcagaccacttattaagcccgctgaggactagctttctgtctttcatacatttgggaaagataggaatgactgtttcaaagaagagaggtgcacataatttatgcaggcaagtatgatacttatttcattggttttgtgagtcatatatatacatatatatatatacacatatatatatgacttgaaaattaagatttaatactttaatgttttaagtgtggggggtttgggaaggaaggaatgtaat

SEQ ID NO: 1520 - DNA, 1137 bp, Homo sapiens
tgttaggacctttttgtgtgtatttatattcatagagaaaatatacagtattattgtattattttgtactttaaaaaatgtaaactcggccaggtgtagtggctcatggctgtaatctcagcactttgggaggcccaaggctggaggattatttgagctcaggagttcaagaccagcctgggtcacttagtgagtcctgcctcttttaaaaaaaaaaaaaaattttaaattcagttttatattcaagagatctgttcaagctaatgcctgtggatcaatcttgttcattaaacagctgcagaatataaatgcaccactgctgttggacattttaggttgtttctttatatttgcttttacatatgttaccgagtgaaatgtatttgtgcacacctttctatgcacatttgtatttctaaggaaaattaggtctgaagtactagtattgttgggtcagaaagtatgttcccggtttcttctacagttctaggctctgcagcactcaacttcatgtaaacctaatcagtcttcagccaacctcctttctctgtgagaactcaccccttcccttttgttttttgtgatctctactacagcaaacatttgccagcaaataataactcatattgaagaatatatagttggtctcttgaactcaggggctttgtcaatatggaggagacttgttaatattgtaactggaaatgatggagttggtaaagttgaggccattattaaaagtggctatgatgatgtacaaattagtaataaatttctacttttttctgatgaaaacaatcagaaatctcaaaatttccactttgcacaggttataacaaaatagtagggattttatgtccaaactagtcataattttctgtttttattgattaaaaagtagtgatcagaaatctcagtttttcttctaatttttttttttttttttttttttttttgagacagctttactctgtcgcccaggctggtgtgtagtggcacgatctcagctcactactacctctacctctagagttcaagcaattctcgtgcctcagcttcccaagtagctgggattacaggtgtgtgacaccatgcctggctaagttttgtatttttagtagagatggggtttcacca

SEQ ID NO: 1521 - DNA, 1197 bp, Homo sapiens
ggagtgaaataagccaatctcagaagttacacatagtatgattccgtttatttaatttttttctttttcttttttttgagacagggtctcgctctgtggcccaggctcattgcaacctctacctcctgggttccagtgatcctcgtgcctcagcctcctgagtagatgggactacaggcacatgccaccaggcctggctaatttttgtatttttagttagagacagggttttgccatgtttgccaggctggtctcgaactcccgacctcaagtgatccacccgcctcagcctttcaaattgctggtagtacaggtgtgagccactgtgcgtggctttattctataaaatagaacaagtgttccctactgttgagtttgcagagatttttatatatcttagatacaagttctttgtcagatatgtggtttcaaatgtattctcccagtctgtagtttgctctttcatctttttcatgaaattctgcagcacaaagtttacattttaaagtctagtgggctctccttttaatgtcttgtttctttgtttctttttttttgagacggagtcttgctctcgctctgtcgcccaggctggagtgtgttggcgcgatctctgctctctgcaacctctgcctcctggttcaagggattctcctgcctcagcctcccaagtagctgggattactggtgtgctactatgcctggatgatttttgtatttttagtagagatggggttttaccatgttggtcaggctgggaagattggaagtctttctataacagggctgccatcatccgttctcccagaaagccttctattgtccccatgtggaatgaatgaagtgcactgggagcacagtggatataattagagtatttttttagtgaccacatttgtagtccatgaaggttcagtactttggcagacttggggttacacatttgggcagatagagcagtgcattccccaactgataagtaaccagtggtctctggggttctgaaatgactgctgccattcacgttggtttagtaaagctctgtttgagttgctgtggttatagggctcaggccaagcctagaagtttctggataaattgtaacacatccagaaaggagagttatgggttataggaggatttaaaagcatataagagggaaaaatggttgagtggaggagaggtttggtctgtcaa

SEQ ID NO: 1522 - DNA, 1213 bp, Homo sapiens
ttttccctattgatgatacttggatttttgaagatctctttttttttcctttgtccttttgttattggctattgtaggcagtactacaataaattttttttcctttttataggcatctagagttaaatgaataaatggggccgggcacagtggctcacgcctgttatcccagcacttcgggaggtggaggcgggcggatcacaaggtcaggagatcaagaccatcctgtgaatggtgaaaccccatctctactaaaaatacaaaaaattagctgggcgtggtggcgggcgcctgtagtcccagctactctggaggctgaggagggagaatggcgtgaacccgggaggcggagcttgcagtgagccgagatcgtgccactgcactccagcctgggcgacagagcaagactccctctcaaaaaaaagtgaataaatgggatcttttaaaaaattaatacagaagtaaaattcaagatgacagttatgagctgatgcttgcttcgtaatattaactaggttacctaatttttctcagttttcattcttaaagcaataaaatgtacaagaccccatctcaaaaatatatgtgtgtgtgtgtgtgtgtgtgtgtatttaatttttaatttttgttttttttgagacagggtctcactctgtcacctaggctggagtgcagttgtgtgatcttggctcactgcaacctctgcctcctgggctcaagtgatccttttgcctcagccccaaaagcagcttgggactacaggcatgagccaccacgcctggctaatttttgtattttttgtagagatggggttttaccatgttgcccaggctgatcttgaactcgtgagctcaagtgatccacctgccttggcctcccaaaatgctaggattacaggtgtgagccaccgtgcctggcctttttttctttttgagatggggtcttgctctgtcacccagtctggagtgcagtggtgtaatcttgcctcccactgtaatctctgcctctcaggctcaagtgatcatcccacatcagcctcccaagtagctgagactacaggtgtgtgccaccacaattggctgctttaaattttttgtagagatggggtctccatgcattgcctaggctggtctcaaactcatgggcccaagcagtcctcccacctcagcatcccaaagtgctgggattttaggtgtgagccaccacacccagc

SEQ ID NO: 1523 - DNA, 1180 bp, Homo sapiens
gctggtgcgatactggtatcctattgacatgttggaaaggcccccagcaggctaccgaaggactgccaccaatgggctggtcacactggacaataccaaccttcaaattcacaggtacaattgggcccttctttctactgggtcacagaaatccaccaacttcgctctaccacatgtaccatgtaccatttatcctcagcaagaaagtttttccttcaaagctaacacttagagaaggcagctaataaagataacagcaaaattgcaggaggtgtgaagaaaagtcgggggatctaggggccaggcatggtagctcacgcctgtaatcccagcactttgggaggcccaggtgggcagatcacttgaggtcacaagttcgagaccagcccggccaacctggtgaaatcgcatctctactaaaaatacaaaaattagccgatcttggtgatgggcacctgtaataccagctattctggaggctaaggcaggagaatctattgaacccgagagacggaggttgcggtgagccaagattgtgccactgcactccaacccgggtgacaaagggagactccgtctcaaaaaaaaaaaaaaaatgggggatctagaatcatctgacttatgcaacatgcaccctgctgtgatttgggaggactgatgggtagctagagattgactgactcattgaacttaagaccacccaaacgctgcaatgcaatctcaaccggagacagcaagaggtcttgccgtctagacagataagcgtatctggagttctagtgagagatgagagctggagatacactcaacttgattcaaaattgtcaacatcacaagaaatcgtgatagctaatggatgaatagccatcacattccacggattggaagagcgtggagaaagttacggagagtaaagcaagtcaagaaaaggtaagaagatgtccaggtacagtgtaagctcctttcgctgtgaagccaatcaggtattgcttgagtgctttctatgtgcctagcactgtgcaggcttccagaagagaaggtgttcaaggcatgtgcctgccctcagtgggctgaaacctaaagatctggcaaagctccctcatgttcaccattgccaattcccctgagaattattcctttccatcttaaaatgtcttgtaataattcagaggaaaatata

SEQ ID NO: 1524 - DNA, 1288 bp, Homo sapiens
ccaggctagagtgcagttgtgtcataacagctcactgcatcctcaacctcttgggctgaagcaatcctcctgcctcagactcctgagtagcttggatgacaaggcatgggccaccatgcccagctaattgtttttattttttgtagagtcagggtcttgctatgctggccaggctggtctcgagctcctgggtcaagtcatcctcctgccttggcctaccaaagtgctgggattacaggtgtgagccaccgtgcctggcctgcagatacatttcttaaatatgctgactaacatacatgaagaagtgtaaatattatctgaatatgcagttgtttccttggggacaaaaaaaggacggctgttcaaagataattaaaggataattcttaccttctgttaagaccagtttaagtaagttattgatttcagtttcacctgggtacaagatatttaaaccagagctgaaatgacaaaaaagtcaaaaacatttaagcaaatgttctagaaaatcaactctaaatatttaaattcatatttttattaaagatgtcaattggatgtgagggcaatctggctgcgacatctgtcaccccattgatcgctggggttgattcggctgatctggctggctaggcaggtgtgcccttcctccctcaccgctccatgtgcgtccctcccgaagctgcgcgctcggtcgaagaggacgaccatccccgatagaggaggaccggtcttcggtcaagggtatacgagtagctgcgctcccctgctagaacctccaaacaagatgtcaattgattacataaaactgtgaaataacttttatcactaaaaaggcattaaaaaaaaattgagacagggtctcaatatgttgcccaggttagtcttaaactcctgagctcaagcgattcacctgccttggcctcccaaagtgctgggattgcaggtgtgagctactgcacctggcctaaaaaggcatttgaacctaaattcactgtcacgatccagtccaatcacttccctgataagtggcatccctctcctcctcttcctgtgaattacccaaatgataagtacttggggctagatgcagaactggttagagagaattggtaagctatgaaaagtcaatgtagtcaagcctacatataactattgtgcctccccaaaaaaacacttgagaaagtaaatttctaattctcagcttttccgaagagaagggaagaacaatattgcaaatggcatcagaatcttttttcttttcattaatttatttgtgtgtgtgctt

SEQ ID NO: 1525 - DNA, 1152 bp, Homo sapiens
ctttccccatcttgttctgttaatgcattttagccttgttttggcccagaagagtttggtagccccaagatcattgtttccagccagaaagtcctccatgatcagtatttttgtaacaatatcagtgacttctccatgttaataagtggacatttttctacttaagtctctttgaacttgggtttgacattggattagcaagtgattttcagttgggatataagatctataaactgctgccaaaagaaactacagtttgaaagccttgtatacatttagatcttttcccccaaatttttctcccctctaagttattgtggaaagtcaatatttgctatagtttggcagtcctgaagttaatgtaatacattcactttccttcagatgttttacatacttactcattttttaaaattaggtcgaaaatgttgtttgtgtctgttgtagcttgtgtggggtttctgacatagccaggtgattcagcctgtgctccatttcattccacagaggttttgtgtactgccggaacgaggagttggaaccaggatgggtggcttttggcagcggcagtcttctccaccggcctgtctctttcgataataaacctcactcccttttccaggtcattgaccagaacacccttcaggtaaacagaaaaccaaggcatttttaaaacatattttagaggcaataaagaaagttcctatatcatcagaagtaataataatacagttgatatattttcctcccagagtggcatccttttaattgttatagtttgggcattctgttttttatttaatgtcttagacttttcccatatgaactgagtgaatgtgttctctaagtttctgcagcctacaacaaacttttttttataattaagaaaaaattctagacagtcaaagatggtataaatactagctggttttttttttttgttttgtttttgtttttttttttgctttttttgaaccagatctattttgggaaggcatcatttccttattcaatttgttctaaacagcctctctgtgggaaagggagctttgaaatgagtgtagagtaaaatcattgtgtgctagggattgagagcttggctttagtgctctcgtaagcactctgccatggcacttgctgtattatactgca

SEQ ID NO: 1526 - DNA, 1213 bp, Homo sapiens
tgtctgtggttggttccttctgttaattaattttctgtctgcccaagatagatcatctcaaggcttgggatctctcagtgtcagggaccttagggtgccagatttgtgtcttgactcctcctcactgggcctgtgagtcctgggtaaggcctgcctcctttctgggactcagttcccttaagtgggaaacagacaaacacctcctgagggctcctagaactgttctgcttgctgatcccctgagctcaagttactggagaaagggtatatacctaaactgctcagaagaagactttgtgggccgggcgcagtggctcacacctgtaatcccagcactttcggaggccgaggcaagcggatcacctctgatcaggagttcaagaccagcctggccaacatggtgaaaccccatctctactaaaaatacaaaaattagccatatgtggtggtgtgcgcctgtaatcccagctactcgggaggctgaggcgggaaattggttgaacccaggagatggaggttgcagtgagccgagatgtgccattgcactccagcctgggtgacaagagcaaaactccgtctcaaaaaaaaaaaaggaagactttgtgaatattcgcaaagctgtaaagctgtacctttcaatttttttttgagacatagtctcactctgttgctcagggtgcagtcacagctcactgtagcctcaacctcctgggctcaagcgattctcccacctcagcctcctgattagctgggacaataggcaggcaccagtacacctggttgattttacagtttttctgtaggccggcgcagtggcttacgcctgtaatcccagcaccctgggaggccgaggtgggcggatcacctgaggttaggagttcgagagtagcctggccaacatggtgaaaccccatctctattaaaaattacaaaaattagctgggcgtggtggtggatgcctgtaatcccagctacttgggaggctgaggctgaggcaggagaatcgcttgaacctgggaggcggaggttgcaatgagccggaggtgctatgtgcaccactgcactccaggctgggcgacagagtgagactctgtctcaaaacaaaaaacgatttaaaaaataataaaattttttctagggcggggtctccctatgttgcccaggctggtcttgaactcctgggctcaagtagtcctcctgcctcagcctccca

SEQ ID NO: 1527 - DNA, 1611 bp, Homo sapiens
ctctctctgcctgcagtcctgagtctctccttcttcgtgtagtctctttcagtggcctggctggcagggtagctagacctctcacatgcagctcagagctcccaagagctcaaaagcagaaatggccaggccttctgaaaacttaagtccagaattgtcacagtgtcccttctacttccctctattgatgatgatgatgatgatgatgatgatgatgatgatgatgatgatggttttttctaatcagaagaaagctggggtatgccctctacttactaaacaagtcacaagcccagctcagattcaagaaaagggtgtgaagtagaggtgcagttaagtggggggccactagtctaacagacggtcacaaccagtgccatggaaaaccaaggatattagcaaaagcagaagttgctagtgaccttgggaagccgaagctgcttacagtagctgggacaagctgaaagtcagactaagaaataaagagagggccttcaagaagcttcctgaatgatttctgctagccctgagcctatttttggaaccagcacttggggaaactgatcttgtgaggatggatgtgtttagggacacagggcttttgagagcagcaccaccccactggggcatccccagacttgggaaacgtgactctttcttaatgccactgggttttagtcaggccacagtgagaaggaacagccctaacaggcctccagccaggttgaatgagctcatttttgttgtagccaaccagtaagatttgctaatgttctacattaagtgccttctccaaagacatccctctttgcctcatatgttgaatcatccagtgcggatatttcaatgaaaatatcattggttgacttttgtgatggtaataatgctatggcatctttgccatgaagttgtggcctccttggattcttctgactttggcttctgaaaggaaggcctagatccagccctggtggtagttcctttctgaggtctctcagtcccttgagactttggggtagtttggctgccattctcactgacaaaatgtatatcagcccccacctccaccccccaatattccttgaactttgaattgcttcagaacacaggtgtggcctgaaggtattcccttattagggaagtgtcactgctgtcttctagtcaaacttgtaaagaaaaagattccagttcagtatttgcagcaagaagcttgaatgctgttctttttatcgcattgttacatcgactcattctccattttgctttggttttgtcttgacttgacttgactttgggggtaaagtctttcaccagcacacaagagtttgattgtacaaatatatcttctgcattaacatctctgcctgttgcttaagatcagttgcttttatactcagaatggaaatacctgatcttggctagttttgttataagatattgatttcatttagatttccctccacgaggtcagcaaactatcatgttcttatgtaaacttaggccaaggccagagttatcatagtccctaggttgctacggcttatcatgtgcttggtaaaaggtgatcgcaggttctcagacgagtttactttacatgagatggaatcaggc

SEQ ID NO: 1528 - DNA, 1225 bp, Homo sapiens
ctgcactcctagagccatactgaagaggagctggaccttcatcctggggtggcggaaaagccccgggcactttaagcaggggaatgaccattgtttttcagggtagtgtctgaacattcattcatgctgccctggcaagagcagttggcaatgatggcaagaccgggcagtgtggaggtggcccagggacacggggtgcctactgtgttttgcctgaactgtgttttaagaggctgcataaccaagcagttgctgtgcacgtacagcttggcatctgagtctcccaccccccggcaccccatgtttgttacctgcctggtgcctgtaggcatttgagtttgtagcccctggttgaattctgacggtacagccctttggctggacaccatgcagctcagccaggggagtagcagaagatcaactatggacaggtgtgacttaggaagaggtggagtttggggtgctggggagagggaccgaacatcccagggaggggaaatggcataggctgaagtaaggaggggggttgcagtgagtcgagattgtcactgcactccagcctgcctgggtgacagagcaagaccctgtctcaaaaagaaaaaaaaaaaaagaagtaggaactcttctgagacccacaccctggacggggccagagactagcatgctgggggcagattggatttgggtgtggttacatgcactctggggtcagacccactgagtttgaatccagccctgacttctcctgctgggactttgggcagatgatgtaacctctctaagctttgatttcctcatccgtaaaatgacactaatattagtattaccttttaggactgttctgaggtttatacaagatagcatgcctcacacaactagcacagtgcctggcttatacagaatgagcattgggtggatgtcagccattataattagggtcaggggtcagagcaggcatatctgttttacagagtgcctaaaatgctgatggcaggagtttggacctggttgagttgggcatgggagctgctaaatgtgtttgggccagaaagcaagtgatgacagagcatcttcctgctgacatcttgccagctcgggatgctgtctctagccaacttgataagccctgagcttagaaaccctggggtgggtcagccctgaataggggttacttttccctctggagattgagaggtggatggagaggaaactgccaggctattct

SEQ ID NO: 1529 - DNA, 1130 bp, Homo sapiens
gacagagcctccctctggccttgtcctcttcccagccacagaacgggcagggtggcacccgaccccaggggagcagtacctggtcccccaccccctcctcccaaccacctccaaggccaagctgggtcccatagccagcacggcatggttctccccttccccccttcccaggtcaggggagttggacaagtagcaggtgtttgtttttaaagcacagccctttgggaaagcaacacattattgagactcactgtgattcccccgggagtcagactggctttgtcctcttcctctctggagggccatgggccatcagcaggagctccacatcgagccccaggccagaaccccctccctttcacagagagggaactttattgcacaattgggtgccttttagcttttgtgtgttgaaatgggcgttttggaagcaagggtcaggggacagcttctaaaggtgtgagtctctgacctgagcatctgggcctcgcctgggcccttcttcctccccaggggtggaaacgtggaggggccagcagcaccccggggtctgcccaggggagtcaaggccccgaggtgggggggcctattccaggaggagtgggatctcggccctgtccagagcgagttaatgtgtccatctgcccaaccctgtcctgagaaaggacctggttttggccaggacctgacaaatacccaatggcagcagtgtcaacagacgggagtccagccagggtgggtgcccttgtcattgaggttagggacagctatccccaggttatgcctggccccacccagcagggagttggggtccccccacaggctgtgagctctgtgggccctgggatgtgatctagctcagatgccctctcatccttgatgtcatagttgagtgcacccaagtggcacccactggcggccaggggcacagcctggtggtggtggcaatagaactgtgcccctcctcagctcctcgcttcccctcccacagccccagccttactccaccatgcggacaatcattttgtacggatcacgggagcaatgctgtacggttttgtacactggtggtttgtttcctagaaaacccattgtgtctctggatttctagcacattactaaaagagcct

SEQ ID NO: 1530 - DNA, 1401 bp, Homo sapiens
cctgcagtgtggccaagagcctgggtgccaagacggtggccgctcgggccctggagtgcatgcaggtgtgcaagattcactctgaagtggtggaggacaccgaggctgtgagcgctgtgcagcagctcctgggtgagtgatccctgtcctccacctgggctcagagacccacgaagtccctgcatcctctagcaagagtgtgttctgtcttatctgtatcctcagcaccaggcactggctaggtgtgcagttactgtgcactaagtgcacgtcgagtagatggaagggggtgaggataaagaaggagtgtatcttgctgtctctagcccccagactttcatacatgctgctcctctctctggctggccctgctccctattggtttgatgtgactgagggctatcagccatcatagcacctccttcaggaagcctcccttgatcactcaccccacgctgcctgggttgtggacctccaatgcaccactccctgtgttcataacctcctggttcttatccctctacatcactgatgtgagccccatgagggctggtgtgtcttagtccctgacgtgtccctagggccttcctggcatagggcatggcaggtagtaggcactcaatagatgtttgttgattgaagggatgaatatatgagtgagtggaaaggtgggtaatggatagatggacagtggatggatggacggatggatggataatgaagtgacggattgatgaatggtatagaaatgaatgaatggacagacacattgattaatgaacatgttgatggatggacagacagtcaaatgatggatagaggaatggatggatggctatgaatgggtggatggatggatatgttgatggatgggtacactgatggatggacagatagatagtctaatgatggatagaggaatggatggatggatagagagataaaaggtggatggtggaaggataggaggccaggctgatggatggggagagcgtgagacaagtgatggattgccagcagagcagatgaatggctgactggctggagagatggctgcaaggatctgccgtgcccagggcctgctgagcaccgagtggttcttcttccctttccttcctctctccatcccccgatcctggcagatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgagga

SEQ ID NO: 1531 - DNA, 1206 bp, Homo sapiens
ctttcgcttgggaaaggaagatttcgagccccaggaaggagttgggagtgagcgacagcccagagcgtcccataaggtccttttggccatgtttctgccccggggggcttcacctagatcccccaccccaccccttacccctgttgcaaatacgtaagctggacgcgcctcggtgcggatccaggcctcgctgagcacggaaccggagaagcagctcacggcctcggattctactctcacccaagggtggaagggggtgacagggctcggatcttgccccaaacgctgcacaggcccgcaggagagcaaagaggtctcggacaggctgtccttccccagctctcggtcgcgacaaggtcccgacaggcccgggaaccggcgaaccgcctgcaggtaaccctgcgctgggtacctgccttccctctccagctaccggggcggggcgcggcgcggcgcggcgcggcgcggcgggctgcccgggtgggggatgaagaaagcacggcggacccagggcagcgaagcgcaggtctttttccttttgagaactaagatcaagattgcagggattcagttagaagccgctcacctacctccacctcccaccctaccctgtccgatttgtcttttgctgccgcattgattgctaccttcccccctcccttcgcttgcaaaggacacatcgggagtggacggtaaagaccttgcggggagccgtggggggcggggaggagtaaccaaaaatgaaagagaaatgtaggactctctgtctcccaaagtggtggaaaagcaattgcaaggagatggctctcgggagaataacaggctcagagagaacgcagccgagcgggggaatcttcgtgcgcgaagccgggagggttgcggggagggagagttctcctctcccaccgctggggtgtgtttttacatgttttcttagcagcaagttttataaacaggtcaaccctacgctgccagcccagggagttggagcctgtctccggcttctagtgccgacacccctctttcccattcaccccttgcaagccaaacgcgcagagttgggagggaggggaaacttccttccacttctgatgtgggggggacatttgcttttgaaaggctttccttgtcttcagacggtaaaatacgagttctccacatgtctgagtctggtacctcaagcatggatggatggggaagtggggg

SEQ ID NO: 1532 - DNA, 1142 bp, Homo sapiens
atttttaatagagatggggtttcaccatgttggccacctggtcttgaactcctgacctcaggtgatccacccccacctcggcctcccaaagttgctgggattccaggcgtgagccactgcacctggcccctaagtgtttgggctccagtgcctactttacctgcagtccacgcaagttcctactggcctcactggcggagctcaatggccatgtgtggctgctggctactgtactggatagtccatatctagaaggaaggaggaacatgagacaaaggatgagggaaagagcctggggcaagttaaggaatgcctttgagacctccttcctgctaagatctggaatgtattagaatctgagaaccagccttccctcttgaggctcacgcccctgctctgtgtgttctctttggcaggtttgttttggagcagtacaacgctctgtcctggctcacgtgcaatccggccacccaggaccgtacttcctgccttcccgtccactttgtggtgctcactcagttgtacaatgccatcatgaatatactttaattggaaaagcacttgttctctctggctcagttccttctccctgcaacctcagtccaaggaacctgctacactctgcaaataacccacatccttttcttcagaccactctccacagtcctgcactgtgattccttctcagcaggcacatgtcaattctgcagtgttcattaccagagtgactccttgacacttctctcatggacctggaaacttccataagtggtgactttcagccagtgcggtggtgtgtgtagccccaaccactggtccccaggaagtggtggtggttgatggcttttcagcgggaaacagaagagacagtgtccttttgcacaagagtctgtgttttcagcctctgtatacaattgagggcagtctagccctttggatgaaatcctcttagttactggtgtatggcctgtgggttacctgaactccataatctgggactttttaaaaataagaaccagctcaagtacatggtttcatactggggtttctgtctccctagtgttcccatccagattagcatgagtgctttggttgacttcaaacctgtgtgtcaatgcagaaggtctggagacagcttcatt

SEQ ID NO: 1533 - DNA, 1183 bp, Homo sapiens
actccaccatctttggaacagcatcctgcattttctcctgtgatgaattataaagatgggatcagctcagagacagtgacagcattaggcatgatggagagccctatggtcagtatggtttcaacacaactcacagaattcaaaatggaagtggaagatggattaggaagtcccaagcccgaggaaattaaggtagttgtcaatatattaacatttccagggcagagcagtttccaagtggattcacatacatctgctttaaaatggtattgtctgtgtgccatatatacataagttcctaagaatccttttaattagaacatgaggcacaccagcaggcatattaaatagtgtcttttgattgatttaacatttctgcattagcattttctaatgatcataggagagaaatactgaaatacgatcattttggttgctgtttttatgatagcactatgccactgtggtgtgttctacagagtttaccaatattaacactgaccccactttgttgtcacaggacttttcatatgtgcacaaagttccatcctttcaaccttttgtgggatcctccatgtttgctccactgaagatgttgccgagccattgtttgctacctctgaagatacctgatgcctgtctgtttcggccttcatgggcaattcctcctaaaattgaacaactgcccatgccccctgcagccactttcattagagatggctacaagtatgtatagggattgtgtcatttacttgccatatttgatgcaatttttatcttaactaaatgtttgttaaaaatgatgacaaggtccgggcgcggtggctcatgcctgtaatcccagcactttgggaggtggaggcgggcagatcacttgaggtcaggagtttgagaccagcctggccaacatggtgaaaccccgtctctactaaaaatacaaaaaattagctgggcttggtggcaggagtctgtaatcctagctactcgggaggctgaggcaggagaatcgcttgaacccgggaggtggaggttgcagtgagccaagatcgcgccactgccctccagcctgggcgacagagtgagactctgtctcagaaagaaaaaaaagaaagaaaaaatgatgacaagtagcatatcatttgaaactttcctttattggtcgttcatgtttttgtgcaaatta

SEQ ID NO: 1534 - DNA, 1417 bp, Homo sapiens
actacctcttatactcatctccccaaattatttgcctcccttaaataagttttcctagaaggtaagctggtcaggcaatttgaaaaatattagatcccaagaaatctattccgtttgcattggacttctcggattccatgtgtttgcagcaggactacatcgaactctgatgtgccggattgtggcatgtctgcatgtctcatccatctattgtttttggtaactcagtttggaatttcagtgtctgtcttccctgggttgacattggaatcagcctctcctttgagcttattttaactcttgagcaacataacatagatttaatgtgaacagtttataccaaagggcagcctgtgcctgtttatggatcctctctgcctttgtacttgaagagcgcattttacatttccagtcctttcacagacaggagctccaaccttacgatggagaattaaacttgcttgtatttccactttgtggatgaggaactatgagaggtggagtgacttcctgggtccccgctgagacttagtgacagatcccagacaagaacttcatctctgactccaggtctagtcctcttccccctgtctcttgccaactccagccctgacaccgtgggcgtctcccctgagagcagatatatttcaattgtccaggccaaaagaggggcgaggcggcataaacacccaaattaggtggaggatccaaaagtcattttcatttggctgtggaatatgttttttgtatttcaatcagctaggggtgtgttcactgtttttggaaattcacagcgcttgagcctccataatgaagctgggctgcagagcacctggcacgtgctccaggctcccagctcccaacctaggacctctccctgccctccactctggttggtttgtggttccctcgaccgagggtttctagaatcagggaccttgtctaagttttgtttgcccagagcccagcgaagtgtgtgatacaccttgggagtttaggagatcacaaaagggatgaaaacacctttagaaaacatttcattggtggggcgtggtggcttatgcctgtaatcccagcactttggaaggctgaggcaggtggatcacctgaaggcaggagttcagaccagcctgaccaatatggtgaaaccccatctatactaaaaatacaaaaattagccgggtgtgggggcgtgtgcctgtttttgtgagactctgtctcaaaaaaaagaaaaaaatattgttaataagtgagtgttttcggctcaagggaattgagtcatacgttgcatctcccccagttctgcatcttatttgctgcgcttgctggagttgtaaagattggtcctaacagggaaagaagcacacaagagactgtgaaaagggctctgagacaagcaaggacaaaagagggaggg

SEQ ID NO: 1535 - DNA, 1239 bp, Homo sapiens
ctttttgctcatgtttatagccctgttcttttcccagtgaaaaccccttagtgacctagagcagcttttctctagctgtgtgtgctcactcccttcctagttgagagtagtggtggttgtcctgggaagaggggtggcctccctgatttcaagcctcactttcttggccgcctgctgctcacctttccttagaggtcaggaggctttccacagaccttgacggtgattcctgtgccgtataccaggctggaagatagcacccctgctgctttgtgaagcaccatgggaaatggtcatatgggtttcctaagtgaatataaggagtgaaggcgtgtgggggtcagagaatggaggatggctggcagattctgaaatagttccatgactgcctggtgaaacagtatggatgcctccctcctgggaaacagcctcatctatcttgttaccacctaagaatatctctggtcatttaaagggcctgtaaatttgagttattttcatatctaaaaattataaacttctttcttttttttttcccctcagaatgaaatgaatgatgtgcctttctttgatatccaactgccttacgaattggcaatcaatatatttcagtatctggacaggaaagaactaggaagatgtgcacaggtaaggtgtcaccaacagatgttccagattttcctaaatgtgtgattaaggtataggactctccggggtaatagaaatttactcacagaattataaactttgcagaattaatgaattggatggcaagtttacttgaaggaaagccaccttgaccttagaggattatgttccacatcactactcggtgtgtatctttctgtgacccaagagctcttttctccctgcagtctgagttatggctgacctgtggcagtgtgctggtggccgacaacttggtgctaagcctttattgagcttgtctgtgctgttaatgcactcacagtttttaatgcaaagatgtgagcccttggttaaatcgagcctgttattaggttggtagctgagggggtcagcacgaggacagaacatgttttaggtgaagtcatgttttaggtgtatagtccaaattaccctttaaactttaggatctcactcagtgaggtgcaaggcaggtgagaactgagacccaccaagggaattacagatcaatgtcacccgtctcacacttactctggggcatatgcctgtggagtggaatggtgggagatatca

SEQ ID NO: 1536 - DNA, 1731 bp, Homo sapiens
aatgtatagtttatctatattcttttctggatacatgtaaagattgtaatataaaaaatgattagggtttaatatatcaaaccaaacaaaaaatgtcatattcccaaatgacccattctggcttcaccttgtaaactgtccatcaatggagaaccagttaaataaataaatatgatatgaccatataataaaataaccacttaaggaatgaggtaatctatgtgcaatgcaatatgaaaagatgttaaaaatgttttggtcaaaaacaagctataaagtagaatccaatttttgcaaaatagtaataatgtgagtatacgtgtagaaaaaattataaaagaattgcttcttttccgagaaaacaacaaatggcggatgacgccggtgcagcgggggggcacggaggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcccattaaggaatcagagatcattgatttcttcctgggggcctctctcaaggatgaggttttgaagattatgccagtgcagaagcagacccgtgccagccagcgcaccaggttcaaggcgtttgttgctatcggggactacaatggccacgtcggtctgggtgttaagtgctccaaggaggtggccaccgccatccgtggggccatcatcctggccaagctctccattgtccccgtgcgcagaggctactgggggaacaagatcggcaagccccacactgtcccttgcaaggtgacaggccgctgcggctctgtgctggtgcgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtatttaccaagtctccctatcaggaattcactgaccacctcgttaagacccacaccagagtctccgtgcagcggactcaggatccagctgtggctacaacatagggtttttatacaagaaaaataaagtgaattaagcgtgaaaaaaaaattataaaagaatttataccagaatatatatcagtgataatccctggagcagtgctatctgatagaactttctttgatgatgggacagttctatttctagattgtccaaaagagtaacatgtgaaatgtggctagtgtgactgagaaaataaattttaaattttaatagttaacgtgcctacttgctattgtattgaacagtacagcagaaagtaagattaatcctaagggggactttggttttcaggattacttatattttataataagactgtattacatatatacatgcctacatttatgtatgtatatatgtgtattttttatctatagaggttgccttgtctcataattatgtctacttgtcttctccatactccaaatgtaacagttcattgaaagtacatatgaaaaccattaataattcaagtaatag

SEQ ID NO: 1537 - DNA, 1183 bp, Homo sapiens
gagatgtaaattggaattgaagctctgccatttcctggctgtgcagcttagggtttctttgagccttggtcgtcacatctgaaaaatgctgctcaggctgaaagaagagctgggttaccagaaaatatggaaaagaaagcccactttagataaaaattcaaaatatcttcctattatgggcacaagatatcaataataaaatgaactaatgtttatcttgtgttcattatatgccagtcactgtttaaaagctatttgcattaacaaatgtaattcttctaataactttattaagtagatactattattaggtaggtacttatatcagttttaaacatagtggttaacttattcaaacaaatatttactgaatgtgtttgcatttctcagcaaaataggattagttgatttattcattaaaatgtatattaagtacctactgtgtaccaggcatatataattctggagatatattggtgagcaaaattaagagtctttgctcttagagaaattagcatcttgcctacaaccataccaccctgaacgtgcccgatctcatctaatcttggaagctaagcaggatcgggcctggttaatacttggatggcagaagttagagtctgggtaaaaaggtagattgtattcagcttctctaaaaaatgatgaattgttataaagtgaacaatatgtgaaggatacagcgacttgctcctgtaagagaagctaacaaagacatctgttgtagactgggaaagtgacttgggtgctgaaatctaaaggagatgccagaattgattaagtgaggaacagagcataggtgggtgtgttccaggcagtgggagcagtccttgcataggccccagagtgggaggaacatgggttgtgagagagagcccccctttaacccatttccatctctctttcccatcctggaaagtgaagaggatcggggcatttttccagcactttaattaagagggccactgtgctgttgagtggtaaagaggaaaaggtgtgttataagatgtggaatcatgaccataactcagttttgttcgaaaacgattttctggggctcttgccaatgtctccttgcttccctagaagctgagagacccaagtcaaggtaaagagaagaaggaacctctgtgaatgaagcctaaagaaccaatatggcagctca

SEQ ID NO: 1538 - DNA, 6942 bp, Homo sapiens
tgcacaggtttagatggtaaatattttcggctttgtgagccatatggtctctgtctcagctgctcaaccctgttgtggtcatgcggaagcagctgtaagacaatgcataaccagatgggcatggcttcattccaataaaactgtatttataaaaacaagcatcttccggatttggccctcaagcctgttctagagtctctccttccacaataaacactgtctttgctgtcgcttctcaattatggacgttgacagaagaggttctgatacagttagaccaataattgaagaaagaaatgaacaagttgataaaattatagcctcttccaatgagaaggatttaaatatcaaggattaagatagtcctttgggaaaacacttttcttgttttaatttttagttttagttttttagaagcggggtcttgccatattgcccgggctggtcttgaactcctgggctcaagcaattctccttccttagccttcctaatagctaggactacaggcatgcatcactgtgcccggctttttcaaatatttttgaagagccttctttaggatccactgcaaaagtccaatgtgtccaacgttggtgtcagagcatgttagcagcaattttgttgagacaattagcacaaaacaaatcattctgtgattcatgcttggttcatttttggaatcagcatgtaattgcattgtaatttaaatactaaaaatatctagcataaaataagtttatattccaagataaagcctcaatcaaacaaaatatgttttcaagtaatattcactgtaatttttttcctccattttaagtagggccttttccaagcacaaattatgctgagataatagggaccctagtacttttagagctgatcaagggtgggaaagaattgactcagaaggccacatttcagttctctctgtgtttgtaggtcttactacatcttcagagagggagtttggcccctgggtctgctgaaatcttcatttgaaatatccaggccaggagtgggtggaggattgggttgggttgtacaaaaaggccgcagtgttttcaactgcttggttactaattatcaacctttgaggcctgggacgttttctgagcccgctttactttgtctgccctgctcagtttcctgactctatcaggcctgatccctacacctctcggtcgtcttattgtcatgactgagaaccatccaccttctgagcatctgcatttgcatcaggtgtcagagactcttggaaagccacatgggggcagaggtgaccaaacacgaggcccaggagtgggacagacatggcagttaacagtgatcagtacagggtttctccaaactgcttccttgcactgagggcctttgtgggtccctgacttctgggtcttagtaggctgacctcctagttgatgacttccttctgtgccttctaggctctgggaaatagtaggtcagtaggatattatatggggcttatgacatcaaactggtcttttttttttttttttttttttgagacggagtcttgctctgtcacttaggctggagtgcagtggtccgatcttggctcactgcaacctccgcctccccagttcaagcaattctcctgcctcagcctcctgagtagctgggactacaggcacacgccaacacgcccggctaatttttgtatttttagtagagacggggtttcaccatgttggccaggctggcctcgatctcctgacctcgtgatctacctgcctcggcctcccaaagtgctgggattacaggtgtgcgccactgcgcctggcctatcaaactggtctttattggaatcccagctctaccactcattagctcaggcaagtcacctaactcctgtctgtccccattttcttgcctgtacagtgagggtcatgcttgttcatagctcaggagctgctgtgatgatttaatgagataatgagagatggcagatgaagaacttagcacaggcctggcacacagtaggtgctcagtaaatgaaagcctgcactgaggaaggtgggttgtcttttgttgccatctttgctctcttccctgtctttgctaccaaaatcaaatgcaggcaaagtccaaagaactccaggtctaatctcttgataatcagtggtgaggctgggtcaaggagggggttgctcaggtaagaaggaaaatgcccctctggggttgtggcctcgcagctccctacgttcctcttgtgtcgccagcagccccaacaagcgaggcccacccacgtacaacgagcacatcaccaagcgcgtggcctccagcccagcgccgcccgaaggccccagccacccgcgagagccaagcacaccccaccgctaccgcgaggggcggaccgagctgcgcagggacaagtctcctggccgccccctggagcgagagaagtcccccggccggatgctcagcacgcggagagagcggtcccccgggaggctgtttgaagacagcagcaggggccggctgcctgcgggagccgtgaggaccccgctgtcccaggtgaacaaggtgaggcagcattccgaggcctgtgtgtctgttgcggaggccaggagtgacttggggaactgaggcccccacggggccactgttgtttaaaaaaggaactccatgactgtaattcagactttgcgagacacaggaatttaggaagaaaatgtaccttaagaaatagcttcctggccgggcgtggtggctcacgcctgcaatcccagcactttgggaggccgaggcgggtggatcacgaggtcaggaaatcgagaccatcctggctaatgtggtgaaaccccgtctctacgaaaaaaatacaaaaaattagccgggtgtggtggctggtgcctgtagtcccagctacttgggaggctgaggcgggagaatggcgtgaacccggagggcggagcttgcagtgagccgagatcgcgccactgcactccagcctgggtgacagagcgagactctgtcttaaaaaaaaaaaaaaaaaaaaaaaaaaaaagagcttcctaagcaaatggataacgtgtgtgtaattgaaaaggaaaatatgtatgcatgtaactcaaaatataatagctaccaaaaaatgttttcccttctccagaggcaagtggtagcagtttctagagatattctgtgcgtaccagcaaatatatatgtgtgctctccttttgaaacccaaatgatagcatcctatatgaaatgttgcatgcttttttcaaacatagatatagattcacacacatacacacatatgcttttctttttttttttttcttttgagagacagcgtcttgctctgttaccccaggctggagtgcagtggcgtgattatagctcacggcagcctcaaactcctgggctcaagtgatcctctcacttcagcctcctgagtagctgggaatatgggctgtagctaccatgtctggctaactttttcccccactttttgtttgtttgtttgtttgtttgttttgttttgttttagagacagggtcttactatgttgcccaggctggagtgcagtggtgtgatcatagctcaccacggccttgaacttctgggctcaagtgatcctccagcctcagcctcctgaatagctgcgactacaggctcaagccaccatctgtctgattcccacccccacccccggccctttttattttttttagagacataatgtcgctatgttgcccaggctggtcttgaactcctgggctcaagcaatcctcccaccttggcctcccaaaatgctgggattacaggcgtgagtcaccacgctcagcccacacatgtgtatatataaattgtttttctggaaggctacacagaaagtgttcacagtggttgccttccagaagaactttgaacttttggaaatgtttaaatcatgtgcatgaatgatctgtgtaattttaggtttgcgatcgaggagagggatgggtgtggaagaccaggggctcccccaggcagggcatggctcaagtgcttggtgcctccttagcaggctaagcaggtcaaggagccacctttctgccatttggggctgattttctgggtggcattctccttctgatgccacctgcagttcacctgctggtaaagaaagaaggaaacaccatccatatggcttcttatccctcccaattgaccgatgaaactgtgtatgtgcatgtgtgtgtatcacatgcttacagcatcgcaggtacacacacggctttgggattttccagtgagtttcactccctggcttccccaggctctggagcgggtgctgccctgccaagcactcactgctagctgctgaaggggatagcccaggggctgcagattcccatttgcatcatgcaaggtgagcacagcaacttctggcctcggatggctaacactcctccttatttcactcctaggtctgggaccagtcttcagtataaatctcagccagaaaaaccaactcctcatcttgatctgcaggaaaacaccaaacacactatggaactctgctgatggggacccaagcgcccacgtgctcagccaccctctggctcagcggggcccagacccacctcggcacggacacccctgtctccaggaggggcaggtggctgaggctcttcggagctgtcagcgcccggtgcctgccctgggcacctccctgcagtcatctctttgcactttgttactctttcaaagcattcacaaacttttgtacctagctctagcctgtaccagttagttcatcaaaggaaaccaaccgggatgctaactacaacatggttagaatcctaattagctactttaagatcctaggattggttggtttttcttttttttttctctttgtttctttcctttttttttttttttttttaagacaacagaattcttaatagatttgaatagcgacgtatttcctgttgtagtcatttttagctcgaccacatcatcaggtctttgccaccgaggcatagtgtagaacagtcccggtcagttggccaacctcccgcagccaagtaggttcatccttgttcctgttcattctcatagatggccctgctttccccagggtgacatcgtagccaaatgtttactgttttcattgccttttatggccttgacgacttcccctcccaccagctgagaatgtatggaggtcatcggggcctcagctcggaggcagtgacttggggccaagggacctcgagacgctttccttccccaccccccagcgtcatctccccagcctgctgttcccgctttccatatagctttggccaggaaagcatgcaatagacttgctcggagcccagcactcctgggtctcggggtcggggaggggacgggggcacccacttccttgtctgtgacggcgtgttgttccccactctgggatggggaagaggcccgtcgggagttctgcatggcagttcactgcatgtgctgcccccttgggttgctctgccaatgtattaataccatcccatagctcctgccaaatcgagaccctctgacgacttgccgactaactggccaccacaagctgcagtctgtagcactgaacaaacaaaaaacaaaacgctcaagccttacgaccagagaaggatttcagcaaaccaccacctcccactcagtgtcccctccaaacttcacacttccctgcctgcagaggatgactctgttcacacccaatccagcgcggttctaccccacgaaactgtgactttccaaatgagcctttccctagggctagacctaagaccaggaagtttgagaaagcagccgcagctcaactcttccagctccgccagggttgggaagtccttaggtgcagtgcggctcccactgggtctgcggaccctcctattagagtacgaaattcctggcaactggtacagaaccaacctagaggctttgcagttggcaagctaactcgcggccttatttctgcctttaatctcccacaaggcatctgttgctttgggtcctccacgactcttaggcccgcctcaacaacccaggcacctcctaggtaggctcaaaggtagacccgtttccaccgcagcaggtgaacatgaccgtgttttcaactgtgtccacagttcagatccctttccagattgcaacctggcctgcatcccagctccttcctgctcgtgtcttaacctaagtgctttcttgtttgaaacgcctacaaacctccatgtggtagctcctttggcaaatgtcctgctgtggcgttttatgtgttgcttggagtctgtggggtcgtactccctcccctcccgtccccagggcagatttgattgaatgtttgctgaagttttgtctcttggtccacagtatttggaaaggtcactgaaaatgggtctttcagtcttggcatttcatttaggatctccatgagaaatgggcttcttgagccctgaaaatgtatattgtgtgtctcatctgtgaactgctttctgctatatagaactagctcaaaagactgtacatatttacaagaaactttatattcgtaaaaaaaaaaagaggaaattgaattggtttctacttttttattgtaaaaggtgcatttttcaacacttacttttggtttcaatggtggtagttgtggacagccatcttcactggagggtggggagctccgtgtgaccaccaagatgccagcaggatataccgtaacacgaaattgctgtcaaaagcttattagcatcaatcaagattctaggtctccaaaagtacaggctttttcttcattaccttttttattcagaacgaggaagagaacacaaggaatgattcaagatccaccttgagaggaatgaactttgttgttgaacaattagtgaaataaagcaatgatctaaactaatgtgtgctttagtgcaatgacctcttctttttttgag

SEQ ID NO: 1539 - DNA, 1225 bp, Homo sapiens
accagttctgaacgtagatgttggagggctgggggaggagggtgcagtgcaagcattacatccttcccctgttgtcttccaagatatgctggagtagatgcttggctctgagcagtgggcttgggctctcttgcccacccgtctgttcccagagcctagcgcagcacctggcacagtattcactgagttaatgtttgtcattccaccagctgacaacgccacctgtcaacacccgggtgctggctttcctttcgtcagtggctggtgatgccctcacccgtcatcttggcgtgatcctcccagcggtcatgctggccctgaaggaaaagcttgggaccccagatgagcagctggtaaggggcgagcctgctcctgctttctcatgtcccgtctgcccggaggatccctgctcagcacacatgtcccttgtggtttgcaggagatggccaattgtcaggctgtgatcctctccgtagaggatgacacagggcaccggatcatcatcgagtatctgctggaggccacccgcagccctgaggtgggcatgaggcaagctgctgccatcatcctcaacatctactgttcccgctcaaaggctgactacaccagccacctgcggagcctggtctcgggcctgatccgcctcttcaatgactccagccctgtggttctggaggagagctgggatgccctaaatgccatcactaaggtgaggggactgctgaccccacagccaacttttgcttttagaaaattccagacatttacaggaatagacttataagaatcccccacgtacctgtcactcagcttcggcgtttacccactcgtggcaagtcttgtttatactcccgcccacgctttccccatatattctttggaagcagtcttgagagggctgtacatcctctcgctttttcctggattcctgcagaagctggatgctggcaaccagttggcactcattgaagagctgcacaaggaaatccggctcatagggaacgagagcaaaggcgagcatgtgccaggattctgcctcccgaagaaggtaagccagggcctcgtgcagggggctgtgggcgtgcagtctgttgtgcccttctggcccttacccctgtcccaggtctgcggtaggggctgctggagcagtagccgtggtggttggtgttcagcaccttcgcagacagcatgttttcttccatggcagtcagatggggacagggtt

SEQ ID NO: 1540 - DNA, 1509 bp, Homo sapiens
actaagcagtcatgatgtatcactgtattttttcctttaccttggaacacttcacttaatttttaaactggaatgtggaccttggtacttccacggacagagctaacttgcaggaggagttcaattctttagcccactgccatgtacttggtttttcttcatggcttttggaccaaaaactgaagcatccccttgtagtggtaagacagtggttcctacctgctgatccacagcctcctgctattgatatgtgacagagttttcactggcttttggtaaaatgtgaaaatgatgacaatatagtaaatttttccttaaaatttttttgaacaaaaggaatacgctttttctgaggtttttatctgtctggtttatttaacgttttaattttcacattaaaaaaacattttaccacctcacactctaaggaacttacttagagttaattttaattgatttaactttagccacatgcggttagtggctacatcttggacagtacaacctagagagaggtgaggaggcaggtcagaggctcttctgaaagatgatgcctcacacggtccaatcccaccccttccaggggctgatggaactccacatggtattgccagcacctgatactgatgagaagaatggcctgaaccttctgcggagactctgggtggtcaagtttgacaaggaggaggagatccggaagctggctgagaggtgagagagccagcatgtcgctttctcctgctgcatcctctcttcctttaggaaataactgaacccagtgtgctcagcctccagtgggaagaagggctgggctggcagggcaagtgctgcagatctttgtctaagcagcccctgccttggatctcccacaggctctggtcaatgatgggcctagacctgcagccagacctctgctccttgctgattgacgacgtgatctatcatgaggcggctgtaaggcaggcaggggccgaagccctctcccaagcagtggcacgttaccagcggcaggcggcggaggttatgggcaggctcatggagatttaccaggaaaagctctacgtgagtgacctgtgcagccctgatgcagtctgggtgtgtgcggttgggtgggtctctgctcaccccgctactgctccagacaggaatctcggggctcacggtggctcagggtagctgcggctagtttcctgcctcacaatcctggtgcccaggtcattgatctgcccgttgcaaagcatttaccaacttgtctgttgcagcggccgcccccagtgctggatgctttgggacgagttatttcagaatctcctccagatcagtgggaagccaggtataacaattgttcagcctcgttctactccaagctttgtgagatgtggcaggttggctgggtgggtgctgtgaggaggcagcatgggttaatgaaagagcaggacctccctcagagtcggggaggcctgagttccatcagcccctggaaggggtgggattggaccgtgtgaggca

SEQ ID NO: 1541 - DNA, 1509 bp, Homo sapiens; identical to SEQ ID NO: 1540

SEQ ID NO: 1542 - DNA, 1177 bp, Homo sapiens
ggcaaatagggcttgttattcttgtgtcatatgaattgaccagggttctaggagttcaaatgacttgcacagggtctcccccgacggagggagaccctcaaagacctggctgttatttctgtgctctttgtgccgtgttccactgcttccctccctcccaaagcctgttgaggaatgtgggccagtgacagacttgccaccacaggctgggtctcctggaccagttcctggtgccttctttacccctgcaggctttttagatgcaaagccacaggtgcttccttcttccaggcacatctcacagcctgtgggtcccattgcaggaagctgggcatccatttctactccagcaaggaccccagggaagaactgagtgaggggccgctgtgtccgtagcatatttggttcctgtgttccaagcctgcacagggctcttagcagtattatctcatgtgtctccacacaggtgctgcccttagaggctttggtgactgatgctggagaggtgactgaggcaggcaaggcctacgtgcctccacgggtcctgcaggaggctctgtgtgtcatctccggtgtgccagggctcaagggtgatgtcaccgacactgaacaactggcccaggaaatgctgatcatctcccaccacccatccttaggtccgtggctgcggtgggtgtgggagagcccagagctttaggggatggggtaagagcaggccaggcagaaggcctcaaagagctcccttccccttcagttgccgtgcagtctggactttggccagcacttcttgccaggatgaagatcgatcctgaagcctttatcaccaggcacctggatcagatcattcccaggatgaccacacagagtcccctaaaccaggtgacgggcacatgagctggtctggcctcaggtccgggagggggccctctcatcacagtgtacaggaagagaggattcaaagaagcaggtgaagatggatgaaatgtaggcttggacccttggttgcacgtgacagaaatgtaaactggtttaagcacaaaagggaacttactgcctcatttacctgcaaagtccaaggatatgactggctacaggggttcacatgttgcccttggaacattgtaggtgatgtctctcttactctgtcccatccatctttgtctgttgtctctgtttt

SEQ ID NO: 1543 - DNA, 1438 bp, Homo sapiens
aagcaattaggcagcattgtagagcatagcttgtattacattttcccacacttagaaggttttcagacacaaaacccaaaggaattgtgtaacaatccggataaacacgcctagattgtttttacaaataataatgttgctatatttgcttaacgtggtgcttttaatgctgtgaatctagccctcctcttgaccaacttacttggaacattccttttttatcctgttaaccattttagtgaatcagaagcatgcctggtaattgggaaaaattaaaaactaagtaaaaaaagaaaaaactccttgattgaatgtagaaacctaattttcagcgttcatacccagctagccaatcatccagtttggcagtgttacaacgtagctcccaatctccctctgacttcaaaagcttagaagaaagggagtgggatggaaacaaattgtggggttcagtttcttctggcattttttccctctctcttcctgttaaacttggctcctctggcttgttttttgtagcaactattggatgattatccgaaatgtttcattgtgggagcagacaatgtgggctccaagcagatgcagcagatccgcatgtcccttcgcgggaaggctgtggtgctgatgggcaagaacaccatgatgcgcaaggccatccgagggcacctggaaaacaacccagctctggagaagtcagttcccctggcagttttgtcctttctccccagtgcccgtctccctcttcctggagaatggtgctgaaaggtgattgtctcccataaacttctctttgcagactgctgcctcatatccgggggaatgtgggctttgtgttcaccaaggaggacctcactgagatcagggacatgttgctggccaataaggtaaggggacaattgggttggctaaagagactttgttgttgctccttaaagcaaaatggaccattctcaggttgtgtgagtggagaggcttttctcactgtttgttgtctttgtcaggtgccagctgctgcccgtgctggtgccattgccccatgtgaagtcactgtgccagcccagaacactggtctcgggcccgagaagacctcctttttccaggctttaggtatcaccactaaaatctccaggggcaccattgaaatcctggtgagtggacctggtttgcctgtgctaaccaggcaaatggggagctgcttttagtggccatggatctgctggttgtccaacaggtgtttactgccccactattatctggttcagagtgatgtgcagctgatcaagactggagacaaagtgggagccagcgaagccacgctgctgaacatgctcaacatctcccccttctcctttgggctggtcatccagcaggtgttcgacaatggcagcatctacaaccctgaagtgcttgatatcacagaggaaactctgcattc

SEQ ID NO: 1544 - DNA, 1210 bp, Homo sapiens
ctgcccgcctcagcctcccaaagtgctgggattacaggcgtgagccactgtgcccggcctcctcccctcttcttaccacatcccttccctaccctctgtcctcttgcgggggaagacttcgcatctcctctgccttgttctccttgggaatctgggaactgccaagccagtacaaggccagaaagcatctctcactatcttctttcctttgcctctcaaagcttccccaacaagcagaaatcagctgagccttcacccaccgtaatgagcacgtccctgggcagcaacctttctgaactcgaccgcctgctgctggaactgaacgctgtacagcataacccgccaggcttccctgcaggtaggaccgggtccctggggcagggtctaccagggcccagggcccatctgctgacctctagatcccaggagggctcaagggctgagcagcctttttctctcctctctgcaagatgaggccaactcaagccccccgcttcctggggccctgagccccctctatggtgtcccagagactaacagccccttgggaggcaaagctgggcccctgacgaaagagaagcctaagcggaatgggggccggggcctggaggacgtgcggcccagtgtggagagtctcttggatgaactggagagctccgtgcccagccccgtgtgagtacccactgggccctccccaggtggggaagggctggcccagcctgccccgggtccagtgtctgtccccttagccctggtatcacccactccctcccgtgtctgccatttgccaggcactggggggatagtggtgagtcacatggacaccatccctgccttcagccagtcactgccagtcagaaaggacagacgttgtgcaggctgagggcgcctggagcttagcagctcttagcacaggctttggggccacacagtggggttcacatcttggctctgacagttactgtcagctctcaagccttagttttcccatctgtaaaatgggacaagaacttatgggatcactgggataagaccacctacctcagtaagggtgagaaccagtaatccatgtaaagcgcttggaatggtttctggtgtgtagtgcgtggcacacatggtgagtgcccaacacgcgagctcttaccagtgccgtcgtgttactgcagtagcctcacctccatgtccagtgttgtggaggaaacacagggcg

SEQ ID NO: 1545 - DNA, 1218 bp, Homo sapiens
aaataaataaataatttttaaaaagtacatttaaaaaaatgtcactactggacgggtgtggtggctagtgcctataatctcagcacttagggaagccaggcgggaggatcacttgagttcaggaaaacagcccatctctacaaaacattaaaaaattatccagttgtagaggtgccaacctgtagtcctaggtactggggatgttgaggaaggaagattgcttgagcccaggagttggaggctgcagtgagccatgatcacaccattacactccagcctgggtgacagagcaagtccttgttccaaaaaagaaagagaggagcgcagcactgccgcctggcccctccagcttcccggaccacggccaacctcgagcgcaccttcatcaccatcaggccggacagcatgcagtgcggcctggtgggcaagatcatcaagcgcttcgagcagaaggggttccgcctcgtggccatgaagttcctcccggcctctgaagaacacctgaagcagcactacattgacctgaaggaccgcccattcttccctgggctggtgaagtacatgaactcagggccggtcgtggccatggtctgggaggggctgaacgtcgtgaagacaggccgagtgatgcttggggagaccaatccagcagattctaagccaggcaccattcgtggggacttttgcattcaggttggcaggaacatcattcatggcagtgattcagtaaaaagtgctgaaaaagaaatcagcctacggtttaagcctgaagaactggttgactacaagtcttgtgctcatgactgggtctatgaataagaggtggacacagcagcagtctccttcagcacggtgtggtgtgtccctggacacagctcttcattctactgacttagaggcaacaggattgatcattcttttatagagcatatttgccaataaagcttttggaagctggaaaaaaaaaagagagaaagagagaaggggagggaggggaggaagggagggagggaggaaggaaggaaggaaggaaggaaggaaggaaggaaggaaggaaggaaggaaggaaggggaaagttaaatagaaagaaagagacacagacgggccgcgagcggtagctcatgcctgtaatcccagcactttgggaggctgaggtgggcggatcacaagatcaggacatcaagaccatcgtggctaatacagtgaaaccccgtctc

SEQ ID NO: 1546 - DNA, 1232 bp, Homo sapiens
tagtagcgaccccgtttcaccatcttgtccaggctggtcttgaactcctgacctcgtgatccacccgcctcggcctcccagagtgctgggattacaggcgtgagccaccgcgcccagccgtgttctccattcagattttgtcacagtgacgtcctaaaattattcccaactccccccaccctgctgtttccgcaccctcgagcacagctagtcgtccgtctgcgccctccaggctcgctttcccactgctcactctcctcgctcaaaattcaagtctcaaccgagtcatctctgtgacgtcacgttgatttgcataagattccccagcgtcccaagcgaatattcttatggttttcaaaacctgaatgtttgacacgggatgttccaacaacaagaaacctcctatgcagatgggccttaaatacggctggtggagtgggaacacgtcgtatacacggacacacgggcaggcactcaccctcaatgtaatggtagtcatcatccgtgggggagcggggcgcgaacagaacctttccagctttgcgcagtggcagtatcgtagccaatgaggtttatccgaggcgcgattattgctaattgaaaacttttcccaataccccgccatgacgacttgaaatatagtcggcattggcaatttttgacagtctctacggagactgaatttttaaaagtctaaagaaaagggttttaggaagttgtattatagcaggttgtgtcttatgtttggtttgataagttatgagctgttcctatgatagttttttggttgttgttcaggagtattccgtgattgaatgtccggggttctgtgcgggtactgtgagttgttttccaaaatgtatgacactatgttgggaactgggttctaactaagacagttatcgttaatcttttttatccaaatgcagccagcgagtgagctactccacttcctttgtcactgaaggtcacagattcccttaaagggaaggggaactctaaaactaacacattaatacatccaaagtcttcctttttttttttttttttttttttgagacggagttttcgctgtttcccaggctggggtacagtggcgcgatctcggctgactgcaacctccacattccgggttcaagcgattctctgtctcagcctccggagtagctgggattacgggagcccaacatcacgcccggctcatttttgtatttttagtggagacggggttt

SEQ ID NO: 1547 - DNA, 1248 bp, Homo sapiens
atgggtacagagtctcagtttccacccttgggcatgaaagataaagttctggaggtaagtagtgatgatggttacacaacaatgtgaacatattctatgccagtgaatttacacttaaggttaaaatggtaaattttatgtatactttggcataatttaaaaaaaagtttgaaaaagaaaaaagacaaaacaataatcgtctttggagaagtctgttacactgaatctggagccaagtgaacagaaccctgattttgatcccttttctctcaaaagcccttcgcagtctctgaattaagtctattagcatgttcctcccatagtgctttgcttcatatcaacaaaaacctagctaagtgaaatcagcaacgatatgcagaaaccacctacgcaggtcacaaacatctttctatgattgtataattttcaagcaagcaataagtgaagatttttccataggccctaaactcacctttgcgaaataggaagctggtttattgggagtgatgagcagggggcgtaacaaattagctttgcgcagtggcagtatcgtagccaatgaggtctatccgaggcgcgattattgctaattgaaaacttttcccaataccccgccgtgacgacttgcaatatagtcggcactggcaatttttgacagtctctacggagactgaattttcttgcagttgaacaacagaggctttttttgtgtgtgtgggggtgcttggttttgggaggttgaagagtacttgttcgcaaactctctaaatgagagatggggaagtgtcttaccagctgattcgcgagagcacctgcaagtttacctgttttagtgatttgcgtttatgaaagttggagttgctgattttgtgatctctacttttaaggtaaaagcagggcggtgttgacttttcttgccagttggctgtcctgttttctttctcgcactgttttctttttgagacgaagtctgtcgctcaggctggagtgcactggcgtgatctcggctcgctgcaaactttgccgaacccctgtttagcgatttccgtttgtgaaagttggagttgctgattttgtgatctctacttttaaggtaaatgcagggcggtgttgacttttcttgccagctggctgtcctgttttctttctctcgcactgttgttttctttttgagacgaagtctgtcgctcaggctggagtgcactggcgcgatctcggctcgctgcaaactgccgcccgggttcaagc

SEQ ID NO: 1548 - DNA, 1320 bp, Homo sapiens
tttttttttttttttttttttaaagaaaccttttttaaactatttctaggtttgtgaatgtgaagccccaggccgcagggggcaaggggccaggtgccccccaccagctgagaacaaagtgtctatctgggtgtgggcccctggccgcctccctccagccctggagaggagggcagggctgcggggaggccaggccgagcccctggaaccatcccgtcctgtatcatatgtaaatactgtgaggtgatgtgcccacccctctctaagacccctcgggggtgaggggctcccccctcccctgtttctgtcccctcagacaccgttactgtaagcttgcaggcctcagctgtggccacggcaggcccgctctctcaggccctcagggtcaaggccttggttggacctgcccactccaaaaacccagtgtgggggcaaagggcgtgggaagagcagggcttgcccagcgacactgctggacaggaattaactctccaaaggtctcccctgctccctacctaggttggggcttcatggtttctgctcagtctgtcccccttccccctcgacccccgcaatgagtgggcaccaggggacgctctggcgagggcagaccccaggggaaagcaaagggcgtctcagggaacccccacattctctcactgaagtttcccaccaggatgaccccacagccagagtcccttggcagcccctcaccccagaccccccttctaaggaaaaagagaggttcagagcgttggaccttcatgaacagtggcctggctggcgtggcagggccaaggcccacccactgccatcccccttctgtgtgtccctctcccccagttatgaggcccagggcctgagctctcttccccagcattgcccccacccggaaaccccacctttggagagttaattgtctgtgtgaggtgcttaacctatcagccctgagaacacaaagcaataatctttgttactgagatgcgcggctgttcgtgttttgggttttttttttttttaatgtttcctaataaaagagaagctgcattttattggtttttatttttaattttctacacgtttgagctgagtcctgagacacttagcttccctctccctcattcccggacccttccaccccactgggcccaaccatgggctcaggaccctggaattccgttttctgatttgctttgggattttttttttttttaagatgttacatggtgtttcgaagccagcaagttaccatcctccggtgtctcttctctccacatctgtaacttctttttccaggttttattttcagttttaaattcc

SEQ ID NO: 1549 - DNA, 1200 bp, Homo sapiens
ggtatgattccaaattacaccattcccagattattctgagaatgctgcagtgccaaactcttggtatcacagactttatattctagtgggggagacagacaaaataataatataacgacgaaggtgcaatgttatgtgctatgagaaaacgcagtcggaggatggcgaggaaggggaacggaattttagatagggcggtctgggatcagaacctccagatgcccgtccatggactccaacgaagggagcgattccaggtaccagggcaccctgcacaaacctctcttgagcttccgcctcgcccaggtggggacggtagggagaccggagggcacacgcatgcgcacgaaggaaacggtaaagcctgaagggaggtgcagagcgcatgctctctcttgcccgagatgccgaggattttgacaaggactccgtcgtcccggatgatagtgctcaggttaatgccagtgggagggcggcgcccaatagtaacttcctttggaggttgtagtaccgcccccagagccaattttccacttccgcttccggcgctgcggcagtccagatcaaaaatggcggtagttggtgtgtcctcggtttctcggctgctgggtcggtcccgcccacagctggggcggcctatgtcgagtggcgcccatggcgaagagggctcaggtactggggccggggtcgacgggtcgagcctcagccccactcgggcgagacagggagggactgtgaccttggcccgaggccttgcgggagggaaagtgagacccgggcccgccccataccggcgctgaacgtttgtggcttctccgcagctcgcatgtggaagactctcaccttcttcgtcgcgctccccggggtggcagtcagcatgctgaatgtgtacctgaagtcgcaccacggagagcacgagagacccgagttcatcgcctacccccatctccgcatcaggaccaaggtacgcccttgtacatctcttcaagcgtccgttctcttttcgttatgtgtgccttagtgcaagttcttcattctctgaaggcatgggtgccaggcgtgtacagcttgtttatcctcacaaacagaaaatgtattttcttccattttgtggatggacagctgacacttgggattacgtctcaattctcttcttcaaggtcatacaataagtgctcttcagtttcccttttctccgat

SEQ ID NO: 1550 - DNA, 1191 bp, Homo sapiens
tgggctgcagtttcccagcccagatattgtttgaagtctgggatggtgccagaaatctgcatttaattaagcatctccctcccctaatactgccaccattttgatataggtgatttgaggattacactttcataaacacagcactggatatactagttactagggagaggatgatgagtaactaacttgagcttgcattttctgccatccatatttgtttctggaattaaaactgtcctgtagccaggataactttaagggctcccctggtagttataagagctccttaaataatgggaaggttgaactacaccagtagataaaggactaatttccattttgtttttatatatgatctgtcaccccgttataagcagttcatgacggtgttctttctaaattattttctggaattatctaactgacatcttcactccacagccgtttccctggggagatggtaaccatactctattccataaccctcatgtgaatccacttccaactggctacgaagatgaataaagagaatctggaccactacccgggcaccagggaccacagcactggtttggaccgttactctgcacatggaccagaaaaagtatatgggaccttaagctcaccttctttacttgtatcaaatgatgactggtatactggtctcccatccctttgcttgtggcaggagatggcttaaataaataacttaaatttagattggtcatgagctgagagttactttctttggttgtgttttttcgcagaaattagcatttgagcttcaagtcagtgtccaagttgaaaagaaattggcattagttatttctgtttccacagtgaaggtctaggctgctgtttagtgttacaggtccaattcagcccattgaataagtgtttataacagcccctcttggtttattgtgcctgatgtggataaagggaccaagtggagtggtgctaattaagcatcaagattagtccttggtcaggtgcggtggctcatgcctgtaatcccagcactttgggaggctgaggctggcagatcacctgaggtcaggagttggagatcagccgggccaacatgatgaaatcctgtctctactaaaaatacaaaaattagttgggtgtggtggcgcactcctatagctgggtgtagaggcttgaacccgggaggtggaggttgcagtg

SEQ ID NO: 1551 - DNA, 1196 bp, Homo sapiens
gcttgtggacttcggcagccgcgaggcagtggcgcgactggagaaagctatcgccttcgccgaccggctacgcgccgtggacacagacggggtggagcccatggaatcggtcctggaggacaggtaaactcgcggctgcagccccgaagccttgaccgtggcccgttcgcagccgtttaatgtgacgattagcgaacagttttccagggggttaaagagtgttagcaagattcaggaacttgcccacagtcacctcgcgagtcagtggcttcactcttccccttgttcattactgatgctctcgctagtgtaagtggaaacaaaacccgaactgctaatcactgcctttgtttttttttttgtttgtttgttttgtttttttttttttgagacggagtctcgctgtgttgcctaggctggagtgcagtggctcgatctcggctcactgcaacctccgcctcccgtgttcaagcaattctctgcctcagcctcccgagtagctgggattacaggcgactgccaccaggcccggcttattttttttgtatttttagtagagacgtggtttcaccatcttggccaggttggtcttgaactcctgaccgtgatccacccgcctcggcctcccaaagtgctgggattacaggtgtgagccaccgcgcctggcctaatcatcgcctttaaggccctactccatagagtccctacctactcactccaacgtactcttctcagtactctccttggctaccttgactgcttctccagcaagacaagttcttttcctctctagatctctgcactggcccttcgtttttttccttcctctcagtatttgcatggctgcctccctcttggcacaggtctcagcttatcttctcagaaagggctctcctaaccactccaaatcccttctccccttctagttagtaactcatcctattgggttttttccctaacattttaatggacttttgttcatttgttatatctcttttattaaaatgtgagctcattatgtagttactgttttattcctgccttgaatttttattttatttgtttttgagatggagtctcactctatcacccaggttagagtgcagtggcatgatctcagctcattgtaatgtccacctcccagactcaagagagcctcccatctcagcctcccaagtacaggaccacaggcgcgt

SEQ ID NO: 1552 - DNA, 1331 bp, Homo sapiens
gatctttgtgatgaggaatgggatgggctaattttttgccgttttcttggaattgggggcatggcaaatacagtagggtagtttagttctctacacagaacatgataaactacacctgttgatgtcaccgtctgtcaatgaatattatagaaggtatgaaggtgtaattaccataataacaaaacaccctgtctttagggctgacctttcgtcctttgacctcctcagcctccattcccatcttcgctcagactgcaagtatgtttgtattaatgtactatgtaggcggcttggagctggggaacattctttcattctaagaatttgcagatgctgacgttcctcctttctgcccctacaggctctggcttatccaagaggcaaacactgacctctggtaattaaaatcctagttcttttcttttgtcttttccaggaatttgacaagaagtacaatcccacctggcattgcatcgtggggaggaacttcggtagttatgtgacacatgaaaccaaacacttcatctacttctacctgggccaagtggccattcttctgttcaaatctggttaaaagcatggactgtgccacacacccagtgatccatccaaaaacaaggactgcagcctaaattccaaataccagagactgaaattttcagccttgctaagggaacatctcgatgtttgaacctttgttgtgttttgtacagggcattctctgtactagtttgtcgtggttataaaacaattagcagaatagcctacatttgtatttattttctattccatacttctgcccacgttgttttctctcaaaatccattcctttaaaaaataaatctgatgcagatgtgtatgtgtgtgaattacaatttgttcaaataacagcgttgaagacggtcacttgatcagatgcccaggttggtggggatgagtccatccttacagaagttaagtttctgtggggtatttcagtactctttagtcacattctctcacccatcctgcaactgttgtgcatgttgagaaatgcagtgcatgataaagaaacatttaaattaaatctttagtcctaatctgaaaaaaatcaatgtttaaggatatttgttaagacattgctatagaatgttctgggcctttggcctcaggttgtggtgatggatgtgtatgtagtagtacttgaagctttctatggctataaaatggaaataagctcaaaacaaagttgggataatgaaatggattccaggacccttgtctagccccctcccctgcctagaaagaaggtggccttaggggaaagtaaatgtttctgagcagcagttttc

SEQ ID NO: 1553 - DNA, 1165 bp, Homo sapiens
gcctctctgggaaagcatgggtcctctccctcacgcggggaaaaggactgcgtctcttaggtctggagagtgtccattgcttctcctactagaatttatgctcatgctgctccctgagaaaagaagagggggcgggaaagtcggccacgccccctccagagcctatttggtctcaggagctagagcaccggaagtgctggcgacatgtcagtgcgccctaccctaaaccttccccccccaggccacctttcccattcagctgtgggattccggggccgcctgggcgctgcacccgccacttccgcatcgaaccgccgcttcaaccgaactcactccctctgcgcgcgctccatctggtgcccgactgctgggccggcgcctgggagaagccacgccctttcccgcgcctgacagccaatgagcgggcgcctcccggcggggtggtgggtaattaatgagggccgggcgctgattggctgcagcgtcgtggccgggggcagggcggcggggtaggttgttcctgaggtgggaggcggtacccgtggctgagaagaaggaggcctgagagcgacatgtccccggcggctcaggcggagcggcccgtggcgctgtttttctgagtccggggtggcctggcagccggccgaggacgagggtcggcgggggctgcccccgtggtggtggccgccatgctgggagcctgggcggttgagggaaccgctgtggcgctcctgcgactgctgctgctgctgctgccgccggcgatccggggacccgggctcggcgtggccggcgtggccggcgcggcgggggccgggctgcccgagagcgtcatttgggcggtcaacgcgggtggagaggcgcatgtggacgtgcacgggatccacttccgcaaggaccctttggaaggccgggtgggccgaggtgagagtccccctgccgagccgcgggatccagggcctgctgtgctgggcgcagccggccgggggctgcgggccccgagcccctttcgaccctggggccgcgtctctggagcgaagtttctctctgcagcttcttcgggggcccgctctgagctcagggcctggcactggctccaaggtacctagagtcatacaggcagagagttggccagaagttagttatatttggatttctcatcctg

SEQ ID NO: 1554 - DNA, 1099 bp, Homo sapiens
gggcattccctctagattcaggtttgggcaggggtcctatagtccctgccatggggctgcttccctgtcccttccctcccctttgctggcctactctggcataattcaagtgtcttcttgccttggggatccttagtggcatcaaatggcaacatggaatattgtcctccatgcccctccagaaggacctaggagagtaggtgagctttccaaagtgagagacgaatctttctttctttttttttttaaagggcaggatgggtatgctttgggctttctccttctgtggccccggaggaaggagagactgaggcaaggcaaagtgatagtacacggaagcagaaccggaaacacccaggaactgttcagaaatctcagaagaaatctgcttctcttcgatggaaagatataattaacgatcaaagagctctaagaaaattgcaaagaagccttaatgttcaagctttagaaagatcagagcaatttttctctttcagtccaaactaagactctctgtatttaaatctctctggggcaagagggctagatttcctcattttgttatgagactagattggtaccagtagatcagctgcctagcgagggcaggtttcttctttgcatctgtgtggcttgcttccagtctggcctgtcctttccagctgccttttgtctagcctgctatggggggccagattatcttgataagagcaggtgatttggggactagctgggttggcaggaaaagagcaggatggatctcttgggacaggttcccccaggagtataaacacaaggagccaggattgtgctggcagccaaggaaacagtagtgcctgtttgagttggcagagagggccttggcacctcttgcatccaggcagtcttgtgagatgggggcacatagcactggggaaagcagaactccattctcacctctattttgagcttcagtgctttatttcagtatgaggaaaaacaacaacaaactgaagtgcgctttccgtcctttcaaaggacaactgtcgggaagggagagccgagttgcgaggtaggaggggagcactggcagggagagacattcttgactcctctcttc

SEQ ID NO: 1555 - DNA, 1740 bp, Homo sapiens
tgtcctcagacccttagtggacagactccacaaaccctctgatgagacgattgatgtggccagggtccagttagcatcagtagaaggatgtcactaggaaaggcccaggtatctggtaagtgactgtgaggtgtcacagtacctgtgacaggagagtgtcctgatgtgcttgggagaaaggccgtatgggggccagggatggaagagacagtgtgtggccacagaaattcctgtccatccaccaccagtgctgctccctgtgtgggctttagggcgagtggccccgaaccttggcccagtgctttgtcccaggccagagtcttggcaatgccacatgctggcagctttctcactgagaaggtcctagcttacccctgtgtgctggccttggattcagccccgagagaggggagagaccattcctcctgtggagtgggttccttatcaccagaccggccactctcagaactggcgtccactgtaaatccaggtgccttacgtgtggctctgtcccttatgctgcaggggaaagctgcattgccattgttcccacctcctcactggcagaaagatgccagggctgttagcactgtctcctcaccttctgtttctcattgtggctcctcaaatgggatttgcatgttcctgtcaagcgtaacaacaatcccttctctctttgacagaggcccaggtgggacagtttctactatttgatatttgagtattatctgggatgtggttctggagctgcccagagctgtgcttagtagagtgtgtcttggaaacatgcccctgggcacactgtatctgctacattagtgggctatctcttatctgcagtgttcgcttttgctagaaagaggatgtggaggaaggaggaggtgggcaatctggcttgagttgtgctgtatcctcttccttgttagcttgccttagtctcactggagaccatttgcggatagtgcttggtccatgcccagcaggacagggctttgctgcttctgaaagtctggtgttctgtatctggggctgtgggttcctgtgtctagctgctcaggaaatcttgagaagcattccactctggggtgtaaaccagtatgagtttgaaattcaagcgtttgtacctgagttggggagagaattgcaaggcatactttctctgaaagtaacagaaccattcaggctgccatgttattaaggaatctgaactgttgatagcagttaccttgtgggtgatacaatgggaggcggcaaaaaaactacctgcataggagaccctgccctttgtcaagagctgggagcacatttcatcagagtagcaggcccacctggtgccagagggcctgcccctcctgcttctgttcctttgccttgcagtctcctggagagagcctctcttttcctgtacagcctttgggccaaaatgcccttctagcttctccaaagaagatccgagtttatttcattctatgttttaagaggtaaaaggacataacaagtgaaagaagttttgggctaaagtaggctatgtctccttatgtattactcaatactgttttgcagagaaaacatttttcaagcatgtgcttcctgaagacacctcagtctttgggccatttgatttccaatacatagggtggaagaatgtgattttggggctgaccataaactggaaatttgtgaaatggcagtgattgggcaatcttcagtttattttttcagttgaagtggaactcattt

SEQ ID NO: 1556 - DNA, 1124 bp, Homo sapiens
gcccgagcccaggagtttgagaccagcctggccaatatataggaagacttcatacctggaaaaaaaattttttttttttaaagaatcagacagctgtgtgtgcctcatgtttaaatctgtaacttagaaagtcccttgtttcccagggcgacctccggcggatgtggtctgagcctttccactccaagtccagcagctcccgattcctggaagtatgatggatcacgtggaaagtgaccagatggccgtcatagtccttttctctcaactcatggtttgtttcctcttagagctggcctggtactcagaaatgtacctgtgtttaaggaactgccgtgtgactggatttggcatttaaagggagctcgtttgcaggagagaggtgctggagccctgtttggttccttctcttcctgcggatgtagaggtggggccccttccaagagggacaggcctctccccagcgcgccttcctcccacgtttttatggatctgcaccagactgttaccttctgggggagatggagatttgactgtttaaaaactgaaaacagcgaggagtctttctagaacttttgaacactaaaaggatgaaaaaaattagcaaaccgaagtttcttcaatgacccctcgagaactttgggaccagtttcctataggggactcagtttcagagaactgagacagaagctcttctgtcgttatattcttctttcctttttttggatttattaaatattttctgtggtgtgaagtgacttattaaatccacagacattgagtgacttcttacaacatccacataagaatttgttgtaatgagttcatgtccacccagatgttgtgttggcagtgaacaagggcacggtttttatacatacgtacatatatatatataaacacacacatagatatatatgaataaacaaaaatgaaatcctgctaagatcacgctgtgtagctgacaggggcttgctgtcgttttgagcatgtcgagcagtttactgtggcttccttgtatatggataagctgctgtccttccccttcacaactgaccccgcagttacaaactagtatagcatttgtgctgattgatgatagactcatggacttcaggagccct

SEQ ID NO: 1557 - DNA, 1209 bp, Homo sapiens
tctcctgccttagccgcccgagtaggtgggattacaggcgtgcaccaccacacccagctaatttttgtatttttagtagagacagggtttcaccacgttggccgggctggtctcgaactcctgacctcaaatgatccactcatctcagcctcccaaaatgctggaattacagctgtgagccactgcacctggccattttatataaaggactttagcatatgtgaattttgttatccaagggggatcctggaatcaatcccccgtggataccaggataccaagggatgattgtactttcagtgatttatcactttcatttgtcaacagattttatgtcaattctgctttctactttgccagctttttttctttttactttttaaaaaactgtggtaaaatgtatatataacataaaatttaccattttaatcgtttttaaatgtactgtcatgtggtattatgtgtattcacattgttgtgcagtcatcatcactgtttacctccagaactttttctttttttttttttttttttggagacggagtctcactctgtcgcccaggctggagtgcagtggcatgatctcagctcactgcaacttctgcctcctgggttcaagcgattctcctgtctcagcctcccgaataactgggactataggtgcctggcgccatgcccggctgtttttttttgtgttttagtagagacaaggtttcaccatgttgcctaggctggtcttgaactcctgagctgaggcaatctgcccgcctccgcctcccaaagttcatcttcttaaactgaaactctgtacttattaaacagcaaccttcattttcctctcactgagcccctggcagccaccattccactgtctatgaatttgactgctctagctaggtcacataaatggaatcctttatttgtccttttgtgactggcatacttcacttatcatgtcttcagggttcatccctgttgtagcatgtatcagaatttaagaattaacttttttttttaaagctgagtaatatttgaatgtatagataggccacatttttcttacccattctttcatcactgggcatgggttgcttccaccctttggctattgtgaataatgctgctgtgaacattgctgtacagacatctctcaagactctgctttctgttcttcccagtttgatttttgcatttatctttgtatctttt

SEQ ID NO: 1558 - DNA, 1175 bp, Homo sapiens
catgtctctattcatgagacacactggtctgtgatttttttaggtctttagttttggtatcagggtaatgctggccttatagaatgagttgggaagtgttttctgtcctcttctggaagatggtgtagaattgataattctttcttcaaatggttggtagatcactagtgaagtcatctggacttggagttttctttgtgggaggattttaagctacaatttcaattttgttaccagatattggcctgtttaggctatatattgatttagggtttgtatgtatctttatcccaatttatgttgaaattggtagtttgtctctttccatttcatctacgtagtctaatttgttgtttgtataagtttataggtttttttttctaccttttaaatgtttgtaacgtctgttgtgatgttccttctttcattcctagtgttagtaatttgtacttctccctttctcctgatcagtttagctagatgattttatcttttcaaagaattgcttttagtttcattgctttttctctagtgtttttccatttttttgatgtctgcactcatgtttatcacgtccttctttctttgcatttaatttgtgtgtgtgtgtgtgtgtgtgtgtgtgtgtgtgtatgtgtttctcaaggtagaagcttagatcattaatttgaaaactttctttttttccagtataggtattgaaaattatacgtttccctctaagcactttttagctgcatgctgtacatactgtacattttggtctgcttgattttcattcaagtcaaaatattttctttcttcttttttttttttttttttttgagacagagtctcgctctgtcacacaggctggagtgcagtggcgcgatctcggctcactgcaagctctgcctcccaggttcacgccattctcctgcctcaccctcccaagtagctgggactacaggtgcccgccaccacgcccagctaattttttgtatttttttttagtagagacggggtttcaccgtgttagtcaggatggtctcgagctcctgacctcatgatctgcccgcctcagcctcccaaagtgctgagattacaggcgtgagccactgtgcctggcccattcaagtcaaaatattttctaatttcccttattatttcctttgacccatgagttatttagaagt

SEQ ID NO: 1559 - DNA, 1162 bp, Homo sapiens
gttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatg

SEQ ID NO: 1560 - DNA, 1113 bp, Homo sapiens
cgggtctggaactgctggtctgaaccacaaagccgcccccgctcggttccttccttggctgaccttcggcctcacgcctggcctaacttgctctcctggcccattaacctgtgttccccttttctcctctccccaaggatttggaaggagtgccaccctctaaaaagatgaaactggaggcctctcaacaaaactccgaagagatgtagacgatgctttaaagcctccgatccatgttccatggaaggtacatcagcaattaattctagagcaactttgccccagcgattcctcttgggtgcgaacagaactactaacgtttcaagtttaccaagtgcaaatccaagaagacccagaacggcgtcacttctcagacactgaagaactctgctgtgaagcaaaacactcaaacctttaagggactgtccttggggaggcaggcggggctgacagctcaggagtgtctgcacactgtctcggaagccaggattccatttgtgttgctgctgtattttccccccacttctctatgtaacgatataagctatcggagggtggtaccgatcaggaacgctttttggcggggctttccactgttcaaccgattccttccgctttctttttttgtgccttgtgcccttgaggtgacctctggcatgtatcctggtggttcttacatccccctctgcaaagtgccctcttggtttggttcgggcggcggctgccaccctactcaccgctctcctccctgccccaggacttcatcggagcaggcagggtggagcgaaggagctccttagcccacctggtttgcaggtgcagggggaccttaggcacgccccaagcaccaggcaccagggcccaaggacgcgcaggtgttggggcacagtccccaagggctcggccccttggatcaggctgggcactcgctgtgctctcccctccttggggcgtttaggactgggcgtctccaagcccaccatggcccagatggacgtgcaaagcccttggaattttctggcacttcctctctattgcccccaccaccaccacccccatcactgctttctcccagacctccgaatacgaaatggcttctctggctgactgcaa

SEQ ID NO: 1561 - DNA, 1151 bp, Homo sapiens
agcccggccgagggtacctcctcgtggaaagaatgcactttaaagctctgctgaggagttcggagcccaggctttcaggcgacctctgccctccctgcctctcctcaccctccctctcttcctgcagggcctgggaagggctttgagggagcctgggagccatgtgaagaggggcacgcctgggctgtcccacagtttagatccagttggaggttctccctggctcctgcaggcctgcggggatctctccccacttcaggcctccggccagctgcctgccctcttgtctgtgcttcagccctgcacaaaagcagcttggtgacaccactcagccacccagagtacgtgtttacaggctttccagatcaccttcctgtggggtgaacgtaatgaggcggggctggtccttggaatttcccctggaaaatggtaacagactccatccttgacccggggatgagcatgaaggcattgtcccaaaggcagaggccaccgtggtaggaattccaccaaggccagaagggaaaaaggaagaacccaccgtgtctggctgtgcgggccctggggagggtcgtgagtgcagcccctctctacttctgtgcctttgtaaaacgtgtagataaccgcagtggttggctgagccaagaactctcctaaatcagtggctttctccccaccccttgctggggagtcatttttaaaaaaatctgtgggatataaaattggcctcctgctgcttcagcctacctctccctctgctgacttaatgtcgtgattctgtttcttcagatatttaaggctgttaggttgtgtgagccttgaagtgtgtgtgtgtgtcccagcgactgtccactgtccaggagatgcatgtctttgtattggagatatttctgtaactcattctcttggtgctcacgattgccatggccatagggccacagtgccgtatctgctgcagacatgattgtttcttgttctagaggttttcttgttttcgaatcttgcctgatgaatccagccagaccaaggggcctagatttgacctctgtcctgggctcctgggccaggtgcaggaacatctgaggccactctgctggccacctccagtgggtgctgaccacaggatgggctttgtttacactcattttcac

SEQ ID NO: 1562 - DNA, 1217 bp, Homo sapiens
ctgacagaattaaaaagagaaattgaaaattcaacaattatagctgaaggcttcagtaccccatttcagtgatgggtagaacaactatgcagagatgaagaaggaaacagaagacttgaataacactctaaatcaacaggacctaacagtcatctgcagattgctccatccaacagcagcagaagacacacacttctcaagtgcacagggagcattctccaggacaggttatgtgttagaccataaaatgattttcagtcaatttaaaaaggtgaaatatttcaaactattttcccttaccacagtagaaaacattagacattatacataaggaaatttgggaaattcaaaacattatatagccttatgtatctagtttctttttaattttttgaaacggagtctcactctgttccccaggctggagtgcagtggtgcgatcttggcttactgcaacctctgcctcctgggttcaagcgattctcctgcctcagcctcctgagtagctgggatcacaagtacacgccaccacacctggctcatttttgtgtttttagtagagatggggttttatcgtgttggccggctggtcttggactccaacctcaaatgatttgccgcccatctcagcctcccaaagagaaaatctttttctatttttaattttaatttattgatttttaattattatttttctttttttttttgagatggagtctcgctctgtctcccaggctggagtgcaatggcacaatcttggctcactgaaacctctgcctcctgggttcaagcaattctcctgtcttagccttctgagtagctgggattatagaggtgcatgccaccacgcccagctaattttttgtatttttagtagagacggagtttcaccatgttagttaggcaggatggagtctctatctcctgacctcatgatctgcctaccttgcctcccaaagtgctgagattacagacgtgaggcactgcacccggccctatttttatctattttattattattatttgagacagggtctcactctgtcacccaggctggagtgctgtggtgcagtcttgactcattgtagcctcccacttcagcctcctgagtagctaggactacaggcgtctgtgtcacatttgattaattttttgatctttttatagagacaaggtctcactatgttacccaggctggtctcgaactcctgggctca

SEQ ID NO: 1563 - DNA, 1138 bp, Homo sapiens
ctttttttctttggactgctgttaataggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggtttgtattgacatcctccattcttttcttttccatttgttattcttgttttgcattatgttacttttgagttgagatcattcatcttccaaattgctgatttaattaaattgcttgatgtccccagttgagtatagtgtagtatgttctgagtatctcaagtat

SEQ ID NO: 1564 - DNA, 1156 bp, Homo sapiens
agatttgtccatgatgctagttgttccatttcctttaggggataataaccttgtgttatgaattgcacctttatcaaattaagagaaaatgagaaagcagctttgtgataacaactttgagaccaactaaaagaaaatagctgactgggcgcagtgcctcacgcctgtaatcccagcactttgggaggccaaggtgggtggatcgctaagtcaggagattgagtccatcctggctaacacggtgaaaccccgtccctacgaaaaaaaaagaaattagccgggtgtggtggcaggcgcctatagtctcagctactcgggaggctgaggcaggagaatggcatgaacccgagaggcagagcttgcagtgagccaagatcacgccactgcactccatccagcctgggcgacagaccaagactccgtctcaaaacaaacaaacaaacaaacaaaaaactatttgtaaaaatactttatgtggtaggaacaaaacttatgttcatgacgtacttttaaacagaagttttaaaatgggccagatgtggtggctcacgtctgtaattccagcgctttgggaggctgaggcaggaggactgcttgagcccaggaattggagaccagcctggcaaacatggcgagaccctgtctctacaaattgttttgttttgttttttttgagatgaagtcttgctctgtcgctcagcgtgaagtgcagtggcgcgttctcggctcaccgcaacctctgcctcccgggttcaagcaattctcctgcctcagctttaaattagctgggcgtggcgaaggcacggtggctcacgcctgtaatcccagcactttgggaggccaaggcgagcggatcacaaggtcaggagattgagaccatcctggctaacacgccatggtggtgggcgcctgtagtcccagctactcgggaggctgaggagaagcagaggttgcagtgagccgagatcgcgccactgcactccagcctgggcgacagaagcgacagagcaagactccgtctcaaaaaaaaaaaaaaaaaaattagccgagcatggtgttgtgcacctgtagtcccagctacttgggaggctgaggtgggaggatcgcttaagcccaggaggtcaaggctttaatgagctgtgatcatgccaccaca

SEQ ID NO: 1565 - DNA, 1180 bp, Homo sapiens
ctggtcttcaactcctgacctcaggtgatccacctacctcggcctcccaaagtgctgggattacaggcgtgagcccatttccttattatctgtctcctgcatgagtatgtcatctccaggagagcagggatctttgttctttttgttcatgacaaagaacaaagaacagcacctggccgcagtgggcactcagtaagtatcccttgaatgagtggaatcttagtacccgggaagttgatattgccattttacagatgagaaaactaaggctcagagatgtcaagtgactttctcaaggtcacacagccagcgagtggcaaacctgaaccccttgtgctgatgtttgctgttgtccctacaggcctggcctcgccctgtggatgatgatggccttgcccccgtgagctacaacctggccttcagcacccgcccacctccaaccagcaggatgcggctgtggaaggcggtggtggtgactttggccttcatgagtgtggacatctgcgtgaccacggccatctatgtcttcagccacctggaccgcagcctcctggaggacatccgccacttcaacatctttgactcggtgctggatctctgggcagcctgcctgtaccgcagctgcctgctgctgggagccaccattggtgtggccaagaacagtgcgctggggccccggcggctgcgggcctcgtggctggtcatcaccctcgtgtgcctcttcgtgggcatctatgccatggtgaagctgctgctcttctcagaggtgcgcaggcccatccgggacccctggttttgggccctgttcgtgtggacgtacatttcactcggcgcatccttcctgctctggtggctgctgtccaccgtgcggccaggcacccaggccctggagccaggggcggccaccgaggctgagggcttccctgggagcggccggccaccgcccgagcaggcgtctggggccacgctgcagaagctgctctcctacaccaagcccgacgtggccttcctcgtggccgcctccttcttcctcatcgtggcagctctgggtaagtaaggacctcggggacatgtggccaccagaacatcaaattaggtggatatgactgccttagattttaaaagattttacttacgtggttcagacatcaaattgatatgaaaaggaaaagaggccagg

SEQ ID NO: 1566 - DNA, 1152 bp, Homo sapiens
tggaaggatggatcctcttgctgtttcagaatgggctttgctggctggtcctgtgcacttgctgacctcaggtctctgcctctgtttcaggcatcattcacgctagaggactggttcgggagtgcttggcagaaacggaacggaatgccagatcctagctgccttgttggttttgaaggatttccatctttttacaagatgagaagttacagttcatctcccctgttcagatgaaacccttgttttcaaaatggttacagtttcgtttttcctcccatggttcacttggctctgaacctacagtctcaaagattgagaaaagattttgcagttaattaggatttgcattttaagtagttaggaactgcccaggttttttttgttttttaagcattgatttaaaagatgcacggaaagttatcttacagcaaactgtagtttgcctccaagacaccattgtctccctttaatcttctcttttgtatacatttgttacccatggtgttctttgttccttttcataagctaataccactgtagggattttgttttgaacgcatattgacagcacgctttacttagtagccggttcccatttgccatacaatgtaggttctgcttaatgtaacttcttttttgcttaagcatttgcatgactattagtgcttcaaagtcaatttttaaaaatgcacaagttataaatacagaagaaagagcaacccaccaaacctaacaaggacccccgaacactttcatactaagactgtaagtagatctcagttctgcgtttattgtaagttgataaaaacatctggaagaaaatgactaaaactgtttgcatctttgtatgtatttattacttgatgtaataaagcttattttcattaacaatttgtattaaaatgtgggttccttgaattcttacgtgctgttttatttttttgagacagggtcttgttttgccacccaggctggagtgcagtaatataatcttggctcaccgcagcctcaacctcctgggctcaagcaatcctcccatctcagcctccctagtggctggaactacaggtgtgtgccactatgcctgaataatttttaaaagactttttgtattgaatgaatgggtgtgtgatggaaaaaaaattttttttg

SEQ ID NO: 1567 - DNA, 1158 bp, Homo sapiens
agtctgttaagtgttgacttcaataagatagattatttctctcatggacacatttgggtaggtggagcagggcttgtatgccctcttgaagtccaggcatcttccgtgttgttcattaaattatgtgggcctccatttccaagttacctttgtattccaagatacctgttccagactcttgtcagtacctctacattttacctaacagagaggagacaaggggatgagaagggcatgtcgcctacttttaaggacatttcctgtgcatcatacattttacctacaccttgctggctggagaatgttcacacttagccgtaagggagactgggaaataaaactggaagtcttcattattgagaaagaaggagagaataggcagtctgctgaaggacttcatttaaggcactggcctgcttgttcttatgcaaaagtgactttatttttcttatatttgacacagaatattgctatcatctcagaagctgccagctcgggtatttcattacaagcagataggagagctaaaaatcaaaggcgaagagttcatatgactttagaattaccttggagcgctgatagagcaattcaacagttcggtaagttcctacaaactggatttcacttaatggatagctaggaatcattggggtaaatttgcgcataccaaaacctaggtttaggccgggcacagaggctcacgcctgtaattccaacatttcgggaggccactgtgggaggataacttgagtccgggagtttgagaccagcctggtcaacgcagtgagaccctttctccaccaaaagaaaagaaaaacagctgagagcagtggctcgtgcctgtaatcccagcactttgggaggctgaggtgggtgcatcacttgaggtaatagtttgagaccagcctggtcaacatggtgaaacccagcctctactaaaaatacaaaaattaactgggtgtgttggcacacacctgtaatcccagctacttagggtgctgagacgggagaattgcttgaacctgggaggcgcaggctgcagtgagctgagatcacgctattgcactccagcctgggcaacatagggagattccatctcaaaaaaaaaaaaaaaaagaagaagaaaagaaaaacttgctgggtgtggtggcgtgtgcc

SEQ ID NO: 1568 - DNA, 1223 bp, Homo sapiens
gcccactgcgcatgccctggagggctctgtgggttccgccttcagttttgcttttcacaggaggggcaaagtcttttttttttttttttcctttttgagacagtcttgctctgtcgcccgggctggagtgcagtggtgcgatctcggttcactgcaacctccgcctcctgggttcaagcgattccactgcctcagcttcccgagtagctgagactacaggcgcccgccaccacgccctgctaattttttgtattttactggagacggggtttcaccatgttagccaggatggtctcgatctcctgtcctcgtgatccacccgcctcggcctcccaaagtgctgggattacagccgtcagccaccgtgcccggccaggaggggcagagtcttaccccgaagacccaggaaggagaggcttcatttatttttttgtttttccccagagacagggagtcgcccaggctggagagcggtggcgcgatctcggctcactgcagcgtcgacatttcgggtcaagcagtcctcccgcctcagcctctcaagtatctgggaccacaggcgcgaccccacgcccggagaattgattattgattgattgattgaaacggggtctcactttgttgcccaggctggtctcgaatttctgggctcaagcgatcctccagcctcggcctctcaaagtgctggtattacaggcgtgagccagcgcgtgcctggccaaaaattttctaaatttgtataataatttataattgtaatgcatttttatagacaccatatgatctaatcttcacaaaaacctagtgaagtgacatttagctacatttcacaataagaatcctgaagctcaaaatttactgacctcaaataatccacccgccttggcctcccaaagtgctgggattacaggcatgagccaccgcgccctggcccccaccattcatttcggctctcatcccctgttgatgagtaaaatgagaatgaggcccaggcgcggtggttcacgcctgtaatcccagcactttgggaggctgaggcaggcgggtcatctgacatcaggagtttgagaccagcttggccaacatggtgaaatcctgtctgtactaaaaatgcaaaaattagctgggcgtggtggtgtgtgtctgtaatcccagctactcgggaggctgaggcaggagaatcacttgaacctgggaggcagaggttgcagtgagccgagatt

SEQ ID NO: 1569 - DNA, 1137 bp, Homo sapiens
tgccatgacattgggacagatctactacctgaagagattttttgaagtccggagagttgtttaaaaagcctcttcctgatgatcccaactcagaattcactgtttaccaaacaccttggtcataataatgtcattagtttctccatttttattttctgaactgtacattcacaacttatgtttctttgagattaatagatattgggggaaaaacgcctttttaggaaaattatagtgaaaatttgacagttgattggcataatttcttgtttgaatgctgcctccattatataggtccttccaggaactcaaacactgtaagtgaaatatgggagtatagtttttattatttcttcttttccttttgttttcataatataatgcagtttgttcaggaaatcagcacaaagcctgatagtactttactaaaatgactgcattctttggattccttcagtctatggttcaagtcactaaagattcatttttgttgagtccttatgagaaacagcagtatgaatcttgacggtttctgcccgtcctaatggcagagctctctgacttgggtgtatgctgccaggctgggtactttcatactttgttttcttgttttgctttaaaactacgactcagcatacattttcccacatacatttttacattgtaccttaggactcagtcatctccacttaaattgatgacacaagcagctaataaccatttctgggtttctgcctaaccccctaattgtctgttaaagccaattctctgggtgtcccagtgagtggtggctttttttctttccacattggcacattcacttctcccactcttggcatgtaagaaataagcatttacataattggaaaaatctggatttctgatgccaaagggttaaagcttcttggatttcatttcattgatatacagccactattttatttttgatcagtggcctttgggccactgttcagggtactgaccatcagtgtcagcattagggttttggtttttgtttcttttgggtctttcttttttggcacatgtgaatcttgttttgtgtaaaatgaaattactttctcttgttctctgatgatgggtttaaaattaaaagagcatccggttttggtatgggga

SEQ ID NO: 1570 - DNA, 1183 bp, Homo sapiens
caaaggattagacccatacagttttggttttcaaatggcagtgctgtaatttttaaaatccctttgctgtctctcacctccctccaatttttattggaatttatgaagtcccagagatttgtagaaagaagaaaaaatcaaaatattaccttaaacatttgcttctgtgagaagctccagcacctgtgtgtcactgtcatcgagatcagtaggctgtttgatggtgatgaagatggtggcctccttactcagaatgcttttttctcatttcctagtgggattttagtgtgcactgatgtgatggcccggggaattgatattcctgaagtcaactgggttttgcagtatgaccctcccagcaatgcaaggtatggtacgaggctgccacccactctctgttgaggaatttagcctaataaaggaggaatcccgaagaagataaacagataatgatgttcactgaaacattttatagcaagcctccagcgtgcttgggtctgcagtgaccccgtggattcctacagggcttgccagaacagttttgaaatggtttgaggccttgccgtgctccatgtagagcaaggttatagaaatttcagacaatgagagaaaacaaaaaacaacaacattatttgaggctgggcgcggtggctcacgcctgtaattccagcactttggggaggccgaggcaggtgaatcgtttgagcccaggaattcaccagcttgggcaacaggacaaaaccctgtctctacaaaaaatatatatacagattagccaggcgtgtgttcctgtagtcccagctacttgagaggctgaggcaggagaatcgcttgagcgcaggaggcagaggtggcaatggattgtgccacttcactccagcctgggcaacagtgtgagactctgtctcaaaacaaaaacccgttgttttaagtagcaaaaataggcaaatggatgaataacccattcatggtgaaatcgtgatactgtattggtagcaattaaaagtactttcaaatattatcagttcttgcagaaacacacaatagaatgtctaaatgaaaaaagcaatacataccaccacatgtgaaaattacaattactttcttcaaagtcagcatatattcctaatacatgcttccacgcataggaaaatgcctataaacccccaagtgttgatgatta

SEQ ID NO: 1571 - DNA, 1255 bp, Homo sapiens
ctatttgtggagtaatggcattaatcaacatagaacatcttatttgaatcaacagttaacttcagtagtcatgtgaataaaattcttattgtctaaattgagacagcctcagatatttgcagatatttactttttgtctgatatcagtacatatttggacaaagtcatctaaataatagtttgtcaccaaataactacaaaatctcattttaaatgagtaaggagaacgtgtacagaagcaaattttcttcaaaatagttgtgggaagagcttatatgtgaaagcttatgactggttttgagggagaacttactggagaaaatggactctatgttaagtatggttttcagatagaattctttccttttttaatgaggaaaaaaaatccacattaatattgaaactgcacctgtaatcccagcactttgggaggctgaggacagaggattgcttgagcccaggagttcgagagcagcctgggcagcaaagtgagaccccatctctactaaaaatttaaatgtatttattaaaactgttctctagaagctttggactgaatcccaaaagtgtttataagttcaaaagcaaaagtatttgtaatttcaacaacaaaaaatgtatttctttatgtaatcttgaaattattaaaagtccttttagcttctagcacatatttgtacaaagagtttaaggaatggtggctggtttggtttgttttttaaaaatgtttactgacgaggccgggcgtggtggctcacccctgcaatcccagcactttgggaggccgaggcaggcagatcacaaggtcaggagttcaagatcagcctggccagtatggtgaaaccctgtctctactaaaaatagaaaaattagccatgcgaagtagcaggtgcctgtagttccagctactcgggaggctgaggcaagagaattgcttgaatccaggaggcagaggttgcagtgagccaagatagcgcctctgtactccagcctgggtgacagagcgagactctgtatcaaaaaaaaaaaagatcgggcacgttggctcacgcctgtaatcccagcactttgggaggccaaggtgggtggatcacgaggtcaggagtgatcaggctgggtttctgttttgttttgttttgtgagacagagtctcgctctgttgcccaggctggggtgcagtggtgcaagctcggctctctgcaagctctgtctcctgggttcacgccattctcctgcctcagcctcccaagtagct

SEQ ID NO: 1572 - DNA, 1193 bp, Homo sapiens
agttgtggtacaacaataatctgtgacttaactcctgtcagcaaatgggaacataagcaaaagccaaacaaagtcagaaaactcctttgctttcttccccccatggacaactcagcttgccttgtttcttgcagggtggaggggggtttgggcattttctgtttactagaatttggttctcaattggtggaatagaaagtaatttcaggtgtcacctggataaaccttttattttcatagatagatatttgttttactgcagattaaaaaactatacccagctcagcaaacccatgatttcacagatattgttgcttaggataaggctagaataggtatttaatttttcaaaggcagaacttaaagaaaaataaaggtatggtgttaacatatgaaggtggtccgggaatggctgcagtttggggacacagctcgtcattccctcgtgcagtctgggtgccgagtggctgagtggccctgagaggacctgtcaaaggcaactgctaggaagccagagctcttttctccttttgttttcgtgtgtgtgtgtgtgtgtgtgtgtctgtgtgtgtctgttgtgtgtctgtgtgtgtctttgtgtttgtgtttaaacctgttcagtgattcccagcccaaggacattgttgaattttaggaagctggaattgggaatgagcttccaggaatcattgagggcaggagtggaatttggatcccagagggagtttgctaaatttatctcactcagcaggtgcttgttgagcatctgtatgcacagcccgaccaagggcagatgactgcatctgcacccgtgtctcccaaacggctgctttcattccgttttgccagaagatgtgccggggaggtgaacgtgtttagttctagtgctgacagatgtgagactgtgttcaactcttgtcttccagctaccactgccacgtgtacccctatccaaacacagccgaggagcggagggagatccaggaggggctgaacacccgcatccaggatctctacactgtgagtaagctggaagtggattgcctctttatctgagggctgccaaacatttacacgtatattttctctcttttttaacatagataatattggtcgtagacaaatcaagatgttctagtgagattggaatgttgcttccctccctcctccccatggaagttttattttagcaa

SEQ ID NO: 1573 - DNA, 1175 bp, Homo sapiens
gtcgtcctgtttgggtgttgatgtctctgaggtgtgttctttcctttctggcctctgtctttgctcctggcctgggtgaccccacatccctgagaatgccaccttttacccattttcagcacagatgctttgggcctcaaggcctccagcccagaaccaaagatggctacccaagttagggccaatctcggttggcagagggcagacccgcggagactgcgtcctgctcacatctggatggctggaggaattgttttctggtggggcaggcaggccattttatttcaactacagtgtggtctgttttctcccctcccaagtcccttggaatggtcctgggcagagcaagcgagggaggaaaatcagacccgcagggtcatgcggggcccttgtctctgccctggggttcaccctgggccatgttaaagggggaagtcctaggacattccctaggaactgaggttcacccggatctctataggttccacaaaacaaaatctcagggtccccaggaaccactgccaacaggaaccgcgcccatgcgtgtgagaagtggacggcctgaccctgaccctgtgatgagcaaaggcctggcctgcgggtttctgagggcaccaaatccctgagcttcttgcccgacagtcccagcttggaaaacagtgttcatggtgtggctgggtctgccctggaggcaggcagccagggccattgtgcctggatagcggggtcagggcagacggctccccgccccgctcctgctggctgtggggacagagtcatagaaacacatgtttctgccttcgccgggggaccgctgaggtcatggggcagccccattgataagctgcctcccagagtctgtattttgggtccatgtggctggccccggactggggagccgggggatcagcttgcatcctgtccgtccccagaacactcaggctaggcctgaggccccgcagggcacttgcagcctcccgtcctctcccctgcagccccgcccagggccgtgtcctccctccccgagctgggcctggcgtacgtccaccccttgcccagtgtccagcacacagcccccgggtgcaggagtcctcggctgggagtcaggacacctggtttgtcccgccctgtgcgactaggcccaggcccccgcccttggggcctgctttgccctc

SEQ ID NO: 1574 - DNA, 1174 bp, Homo sapiens
ccaaggcagagaaaagaaggaaacccaggaagaggcgcgtggggcgtggggcgtggggcggtcccgatgcacaaggcttggaagaggctattcaggacctcaaatatcagggaagagaaggctgaagccagggaaaagagaacccggacctatgtttggggaaggctttgagtttgcccggctgtgggctggagtccttgtttcccataagggctgggggtgacatggcgacgtcagcgctgtcattaaccatagcaacagcggtgactgtgataacaggaaagacttccatcatgtttgctctgggccaggcctcgtcccaagtactttacctatgtattaactgatctgatctttgtgataatcctgtgaagtatgtacaattagcattcccattttacagatgagaaaactgagacacagaggttaggtcatctgtccgaggtcacccagccggtacgtggaagaggcaggatatgagcccaggatgtgagctcctggctcctgccctgaatgcctgtgctgtaccctgctcagcgtcctctttctctgtcccacagacagtggctgagtgcgtcctctattactacctgactaagaagaatgagaactataagagcctggtgagacggagctatcggcgccgcggcaagagccaggtaagaggcaaggtgggggtgactgtccttgcaggctccctgcatgctcagcggccacttgcttggtggccagcaccccgcatggctggcggtaactgtctccatgagttgttgttgcttggccaccggcagtgtgagtgcaggctcccctccgtggtagcagcagatgtggggagaccccctctggggtgctcaccctgccaggctatctcgagcctcccgtagtggccaggaagatagctggggagaaacagccacgggcctcctcagcctgtgaaatcccagactcctgactgggtgacctgtgatctctgtgcgtaaaaaggctacattccaaaagtaagagcttcccaggatgacttggggtagttcacaaacttcatgtttaaaatgttaatggttgtgtgtgtttatcttaatacatacttgaaagaaaaaatagccagtacttcagctcgccgttttttcagacgccgttgcttgggatgagactgaaagattatttacgctagagc

SEQ ID NO: 1575 - DNA, 1375 bp, Homo sapiens
tgtccatcatgtctgcctgcgagaccctgtgtgtgcatctgtttgtctgcctgcgactgtgtgtgtgtctgtcatatgtctgcctggatgaccgtgtgtgtgtgtctgcctgcctgtgtgaccgcctgtgtgtctgcctgcctgcctgtgtgatggactgtgtgtgtgtctgtcatatgtctgcctgcatgaccatgtgtgtgtgtctgcctgcctgtgtgactgactgtgtgtctgtctgcctgtgtgaccatctgtgtgtctggctggctggctgtgtgacttatgtgcctgtgtatatatgtgtgtgtgtgtgtctctctgtgtatctgcctatatgactgtctgtctgcctgtgtgactgtgtgtctgtctgtctgtctgcctgtgtatctgtctgtgtgtctgccatgtgactgtgtgactgtgtgtctactgtgtgtgtaccgtgtgggtgactgcatgtgtgtatgtgactgtgtgtgtctgtgactgtatgtgtgtgtatctgtgtgtctgcctgtgtgacttgtgtgtgcctgtatgtatgtgtgcctgtgtatatctgtctgactgtatgtatgtgtgcctgtgcatatatctgtgtgtgtgtgtctctctgtgtatcttgtgtgtgcctgtatgtatgtgtgcctgtgtatatctgtctgactgtatgtatgtgtgcctgtgtatatatctgtgtgtgtgtgtctctctgtgtatctgcctatatgactgtctgtctgcctgtgtgactgtgtgtctgtctgtctgtctgcctgtgtatctgtctgtgtgtctgccatgtgactgtctgtgtgactgtgtgtctactgtgtgtgtaccgtgtgggtgactgcatgtgtgtatgtgactgtgtgtgtctgtgactgtatgtgtgtgtctgtgtgtctgcctgtgtgacttgtgtgtgcctgtatgtacgtgtgcctgtgtatatctgtctgactgtatgtgtgtgtgcctgtgtgtgcatgtctgtgtgactttgtgtatctgtgtgtgtctgtgactgcatgtgtgtctgcctgtgtgacttgtgtgtgcctgtgtatatctgtctgactgtatgtgtgtgcctgtatgtgcatgtctgtgactgtgtctgagtatatgtgtgtttgtgtgactgcatttgtgtgtgcctgtgtgacttgtatgtgcctgtgtgcttgtgtgcctgtgtgtatctgactgtatgtgtgtgcctgtatgtatgtgtctgtgtggctgtatctgactgtatatgtgtgtgcctgtgtgactttgtgtgtgtgcgcacgcacctgtgtgtctgcctgcatgtgagtgggcaggggggaggcggcgggtgccaggtgcaggagcatct

SEQ ID NO: 1576 - DNA, 1684 bp, Homo sapiens
ggggtgtcttccagccctcatggcgtgggctccagaacctcccgcctctactctccagggctccctccctttgcctgtctcagggtccctgtcccctttcttcgggtcttgtctctttccctctccccacttctctctctttccctctcctagtttcatcttcctctgagtctctgtccccttcctttggatcttgtctctctgtgactgcctctctctctctctctgatcctctctttctcatctctctcactccagtctcacctctcagtctcatctcctgtccatctccaggtctctgtcctttcttggatctcatctgtctatctatctccgtctctgtgtctccccttctcccagtctctgtctctttctcacctctgtctccctgtctgtctccctctctctgggtccctgtttccctctctgggtctctgtctccgtctctctctctctgggtctctgtttccctctttctctgggtctctgtctccctctctctgggtccctgtttccctctctgggtctctgtctctctctctctctctctgggtctctgtctccctctgtctctgggtctctgtctccctctgtctccgggtctctgtctccctctctctctgggtctctgtctctccctctgtctctgggtctctgtctctctctctctgggtctctctctccctctgtctcagggtctccatctctctctctctgggtctctgtctccctctgtctctgggtctctgtctccctctgtctctgggtctccgtctctctctctctgggtctctgtttccctctctctgggtttctgtctccctctgtctctgggtctctgtctctgggtctctgtctctccctctgtctctgggtctctgtttctctctctgggtctctgtctccctctgtctcagggtctccatctctctctctctgggtctctgtctccctctgtctcagggtctccatctctctctctctgggtctctgtctccctctgtctctgggtctctctctccctctgtctctgggtctccgtctctctctctctgggtctctgtctccctctctctgggtctctgtcttcctctgtctctgggtctctgtctccctctgtctctgggtctctgtctccctctctctgggtctccgtctctctctctctctctctctctctctctctgtctctctgggtctctgtctctctctctctctctggttctctgtttccctgtctctctgggtctctgtctccctctctttctgggtctctgtctccctctctctctctgaaactcccgtctcccaggacgtgcctccttctcttggagcctgcagtggtgtgtgtaacctgcttggttgagaccccatgggccctgccctgaagtctgagaccgcccccgcccgggggtttcctgaagtccatgcctggtggccccaccagctgccccacactgcttgtgtccctccccccgcagcaggactgggtgtgctggaggtccatgcacagcacctggttggagccaatcctggggccacacaggccacactctgacacccggcctgtgggcggcagcaggtctcggggtctcgggctctgtggcctgtattcctagttggaggctgtggctgtttctccgtggccatctttccgtgggcagatgtggctgccggggtgcat

SEQ ID NO: 1577 - DNA, 1178 bp, Homo sapiens
taacctcatatcagtcctgtcccatgtcatggtgtcagcctcctgcacagggtcatagccttgcccaggtcatgctgtggcctgtggcccgtggcccgcctgagctggccctggtccctgctgcccgggacagcggtgtgtgatgtccctgctgccggccgcccctcctgggacaggtgctttctgggaattctgccctgtgacttagaaacccgggggccatggagtgaagttggatgggcttaggggggctgggagccatctgggtggtggtgagggcagcgcagagtccctgtgcctgccgggtgaaggcctgggtggggaggaggcctctggtcccttgcgtggcttgcatggctcggagggaccttgaatgccatgcctgtctccttgtgctcccggagaacaggtgagtgtggcagtggatggaggagggtccaggcaggcccctgggtgctcgcgtgtcctcacgggaccacaggaacgactcggggacctgtgcacggaggagccagctgccccgtggctgatcttgtttttcttttcttgttttcccgcaggtgccagtgacggggtggcccgtgagctgatgacgaggactggcttttaatccttggtggtgattaagagaaagcttattggggcctgggagcagctccccgccgacccccaccaccatgtcgggatccacacagcctgtggcacagacgtggagggccactgagccccgctacccgccccacagcctttcctacccagtgcagatcgcccggacgcacacggtaagggggtgcacatgtgtgcgcctggggctacctttgagacccttcttccattccactgagtcttcaccccttcctttctcctgggagccaggctcatgtggctctgagcctcccagggcagaggggaggccgccacagagacccctggtgtctgaagccttttccagaatatctgataaaatctctttgctcccattttaaagctgggaagatggaggctggggccaggctgagctggggctctgccctctctggactggtagtgggattggcacgcgaatgtggagctcctgctgtattcactttcctgcagcctagcctcacctctgctcccccgctgccgcagtattgggtaggattggggtggcttccagggggcaagggggccggata

SEQ ID NO: 1578 - DNA, 1183 bp, Homo sapiens
ttgcacacctgcacacacgccctggcacacatacacacatgcgtgcaggcttgtgcagacactcagggatggagctgctgctgaagggacttgtagggagaggctcgtcaacaagcactgttctggaaccttctctccacgtggcccacaggcctgaccacaggggctgtgggtcctgcgtccccttcctcgggtgagcctggcctgtcccgttcagccgttgggcccaggcttcctcccctccaaggtgaaacactgcagtcccggtgtggtggctccccatgcaggacgggccaggctgggagtgccgccttcctgtgccaaattcagtggggactcagtgcccaggccctggccacgagctttggccttggtctacctgccaggccaggcaaagcgcctttacacaggcctcggaaaacaatggagtgagcacaagatgccctgtgcagctgcccgagggtctccgcccaccccggccggactttgatccccccgaagtcttcacaggcactgcatcgggttgtctggcgcccttttcctccagcctaaactgacatcatcctatggactgagccggccactctctggccgaagtggccgcaggctgtgcccccgagctgcccccaccccctcacagggtccctcagattataggtgcccaggctgaggtgaagaggcctgggggccctgccttccgggcgctcctggaccctggggcaaacctgtgacccttttctactggaatagaaatgagttttatcatctttgaaaaataattcactcttgaagtaataaacgtttaaaaaaatgggatgcctgcctctgtgacagccttgtttgctgaggtcgtgggggtgggggcctctgggaagttccgggctcctcttctcttggtcaatagctcctttctggtggctgccaagagcgtctctcccagggccgggctgctggcttaccttcctgttgttttcaaatttcaaccttgtgcaatgttgagtttcatagaaatactgcatgagtacgcccttgtttagaagcagcagggtctgagtcccatcccacagcccccagtgcagacgcttttgccacttttgcatggggccccctggatgtgtttctgtgcatttatctacaaatcctggtgcccataggacatgccccgtgttgttctaggcctttg

SEQ ID NO: 1579 - DNA, 1162 bp, Homo sapiens
tcagccacctggaatcgccttaccctggcctttggtttctagcaaatgggatggaagtgagtccccatggagggcttgctccatgaaggtgtttttcctggatgagtcttggccccagtggcgatttgctgcaggcttgttggcactgtcattcgtgggtcctgcatggaggttccttagtgtccagagggtgattccatgtctgtggtcagcaaaagagaggcccctggggccataagccacaccccccaaggctgaacccagagagtttgtggtttaaatcttgggcctggaggattctgtggaggagagttcggtccaggccttctgctccaggaggcgctggcagctccgacaccacagacacattaattgtgcggagaattcaacgctagggctcagtcaaaaatcaaaaacgcaaaacaaaaagagaatcccttttatttacctcgtctccctccccctgtttggacatgaccttgagctctgctggcccacaagtggccaggctggagctgtcttgcaaagagaaacaaaaacaacacaaaaagctgcgttcttgactttgaagccttaaagggcccaggggctggctccctgtgggtgttgggggcgattttcctcccaaagcctgcgtgagatatggagacactccgcctgctcagaagctccccaggtcccgggttccaggaagcctcatggcccaaggcctggccgtcttaattttcttgttttctttccctccactccactgtttcttcctgttcactgattgcctgtgctggggagggggaaggaacgggaggggcctgaccttgttcacttcctggcattttgggtgaagttccttacaccttctctggaagcttctagaaggacccttgaggcgctttaaatctccattctctgggttttcctcccaccttcctggctgctctgtcttcttgcctgctgatgcctcctcatctccctggcctcctgcctcctgctggtggagctccaggcatcctttctgtgtgtcctcatccctcatccctggggtgggctcctccagccttgcgcctgaatggcatctctgtcctgaccactcccaaattggtatccctgggcccagacctttcccctgaaccccacccccgagtgtccaacagcagagtccgta

SEQ ID NO: 1580 - DNA, 1199 bp, Homo sapiens
ccttcgctaatgcgggaaagctcttattcgggtgagatgggctggggcaccatctggggaccctgacgtgaagtttgtcactgactggagaactcggtttgtcgtctgttgcgggggcggcagttatggcggtgccgttgggcagtgcacccgtacctttgggagcgcgcgccctcgtcgtgtcgtgacgtcacccgttctgttggcttataatgcagggtggggccacctgccggtaggtgtgcggtaggcttttctccgtcgcaggacgcagggttcgggcctagggtaggctctcctgaatcgacaggcgccggacctctggtgaggggagggataagtgaggcgtcagtttctctggtcggttttatgtacctatcttcttaagtagctgaagctccggttttgaactatgcgctcggggttggcgagtgtgttttgtgaagttttttaggcaccttttgaaatgtaatcatttgggtcaatatgtaattttcagtgttagactagtaaattgtccgctaaattctggccgtttttggcttttttgttagacaatgcagatcttcgtgaagactctgactggtaagaccatcaccctcgaggttgagcccagtgacaccatcgagaatgtcaaggcaaagatccaagataaggaaggcatccctcctgaccagcagaggctgatctttgctggaaaacagctggaagatgggcgcaccctgtctgactacaacatccagaaagagtccaccctgcacctggtgctccgtctcagaggtgggatgcaaatcttcgtgaagacactcactggcaagaccatcacccttgaggtcgagcccagtgacaccatcgagaacgtcaaagcaaagatccaggacaaggaaggcattcctcctgaccagcagaggttgatctttgccggaaagcagctggaagatgggcgcaccctgtctgactacaacatccagaaagagtctaccctgcacctggtgctccgtctcagaggtgggatgcagatcttcgtgaagaccctgactggtaagaccatcaccctcgaggtggagcccagtgacaccatcgagaatgtcaaggcaaagatccaagataaggaaggcattccttctgatcagcagaggttgatctttgccggaaaacagctggaagatggtcgtaccctgtctgactacaacatccag

SEQ ID NO: 1581 - DNA, 1606 bp, Homo sapiens
atcccagctacttgggaggctgaggcaggagaatcgcttgaatccaggaggctgaggttgcagtgagctgagactgtgccactgcactcctgcctagataacagagtgagatcctgtctcaaaccaaacaaacaacaaacaaaattctccaggtgtggtggtgggtgcctgtagtcccagctcttcaggaggctgaggtgagtggattgcttgagccgggagaaggagtttacagtgagcctagatcacaccgctgcactccagcctgggtgacagagggagactccgtctcaaaaaacaaaaccaaacaaaaaaagataattggaagctttgacatggttgtatcttagaatatgtgcaaataaaaatgcaaataaaaaatgtgtaccaactcactgaggcattttgttgaggtgatgtatcattttcctcattgccagcaggtgacacaagaagagtttaaaacaacagcggcttttaattgcttacagagctttctcaattaaaagtctagtgttgtgactgcttaaaaaatcagatcccattggctgaggagccaatggggcgaagctaccatctgtgggattatgactgaacgcctcttaagtcagaatcccgcccaggcggaacgatacggcagccccgcggcgcctcggttggcctcggtcggcctcggatggcctcggtcggcctcggtcggcctcggtcggcctcggtcggcctcggatggcctcggtcggcctcggtcggcctcggtcggcctcggatggcctcggttggcctcggtcggctcggttggcctcggatggcctcggatacctcggatagccggtccccgccggcgggccgccccgccccgcgctgggaccagggtccggtgcggagtgccctttgtcctgggaaacggggcgcggccggaaaggcggccgccctctcgcccgtcacgcaacgcacgttcgtggggaacctggcgctaaaccattcgtagacgacttgcttctgggtcggggtttcgtacgtagcagagcagctccctcgctgcgatctattgaaagtcagatctccacacaagggtttgtaaaaaaataataataataataaaaataaaaaataaaaaataaaaaaaccatcagatccccatggctgacagatgctttaaaggtagtgaccccatccctccaggctcagctgcttcctccactttctcctcctccaggaagccttccctgaccacagcagaccatgatggtctttcccttctctcacttccacgctctgaccccacagttggggtaagcaccagtttatcccaaagctaaggagctccggggcctctacggaaaatagaaaagtttcttaacgttaccctaataagttgtaacaaatgtagtggctaaaaacaatataaatttattatatgacagttcttttttttttttcttgatatagagtctcactctgttacccaaactggagtgcaatggcacgatctcggttcactgaaacctccgcctcccagattcaagcaattctcccacctcagcctcccgagtagctgggattacagacacctgccatcatacctggctaatttttgtatttttgt

SEQ ID NO: 1582 - DNA, 1166 bp, Homo sapiens
tgagctcaggtgatccacccacctcagcctctcaaagtgctgggattacagacgtgagccacattgcttggcctatctggattttttaagacaggaataatgttttccagtatagccagccatttaaagaccttctgaagaatgtgtttccaggccctaccctcagaatatggcagcttggttatccagaatctcatttagcattaattacttcagatacttttttgggatgaggggagtattaatggtgaagtatatcagggagatttgatagggtcagctcatctctcttaggaggaattgtgtattaacatttttagaattgacagagaccttgaaagtgaggggagagatacaggtgactcgttgaggtctaagactataactagttgaatcctagtctctggttcttagcattcttcacttgtgcagtaaactgagtgtactaattcccacaaatgtttcttcagcccagtgtgccatcataatgtttgatgtaacatcgagagttacttacaagaatgtgcctaactggcatagagatctggtacgagtgtgtgaaaacatccccattgtgttgtgtggcaacaaagtggatattaaggacaggaaagtgaaggcgaaatccattgtcttccaccgaaagaagaatcttcaggtgtgtaaaattaaaacttcctgagttatttctcttagcggagattatatgtaagaccatgaaattaaccagtgtctattatatatggaaatgatttttttttccccaagacggagtcttcctctgtcccccatgctggagtgcagtgtcgcaatcttggctcactgcgacctccgcctcccgggttcaagcagttttgtctcagctcccctagtagctggattacaggtgtgtaccaccacgcctggctaatttttgtacttttttttctagtagagacggggtttccaccatgttggtcaggctgatctccaactcctgacctcaagtgatccacttgccttggcctcctaaagggctgggattacaggcatgagccactgtgcccggccggaaataattttgtcttttttatactactgtttttaaagaatgatagagattgggtttcactgttggcccggttggtcagctgaaatgtttgtgtatttatatatttgttgttcga

SEQ ID NO: 1583 - DNA, 2225 bp, Homo sapiens
cagccttctgagtagctgggctcacaggcactcaccaccatgcccacctaatttgtttttttgtggagttggggtcttgctctgttgcccaggcctgatcgtgtactattggcctcaggcaatcccacctcagcccccgaaagtgctgggattacaggcatgagccaccatgccttgccaagaatcttaacattttcttatcttgcaatgtcctagaaaaatcgtcatcttaataatgaattttaaaaagtaattttacctttcttttaaacagtactacgacatttctgccaaaagtaactacaactttgaaaagcccttcctctggcttgctaggaagctcattggagaccctaacttggaatttgttgccatgcctgctctcgccccaccagaagttgtcatggacccagctttggcagcacagtatgagcacgacttagaggtattgtggccactttgctgttcagattgttcggtttggcttgtttattcctggcagttttgatctggagtgttaacgtttttccatctcttcgtctaggttgctcagacaactgctctcccggatgaggatgatgacctgtgagaatgaagctggagcccagcgtcagaagtctagttttataggcagctgtcctgtgatgtcagcggtgcagcgtgtgtgccacctcattattatctagctaagcggaacatgtgcttcatctgtgggatgctgaaggagatgagtgggcttcggagtgaatgtggcagtttaaaaaataacttcattgtttggacctgcatatttagctgttttggaacgcagttgattccttgagtttcatatataagactgctgcagtcacatcacaatattcagtggtgaaatcttgtttgttactgtcattcccattccttttcgtttagaatcagaataaagttgtatttcaaatatctaagcaagtgaactcatcccttgtttataaatagcatttggaaaccactaaagtagggaagttttatgccatgttaatatttgaattgccttgcttttatcacttaatttgaaatctattgggttaatttctccctatgtttatttttgtacatttgagccatgtcacacaaactgatgatgacaggtcagcagtattctatttggttagaagggttacatggtgtaaatattagtgcagttaagctaaagcagtgtttgctccaccttcatattggctaggtagggtcacctagggaagcacttgctcaaaatctgtgacctgtcagaataaaaatgtggtttgtacatatcaaatagatattttaagggtaatattttcttttatggcaaaagtaatcatgttttaatgtagaacctcaaacaggatggaacatcagtggatggcaggaggttgggaattcttgctgttaaaaataattacaaattttgcacttttttgtttgaatgttagatgcttagtgtgaagttgatacgcaaggaaaatggtccatgtttacccacagttttcaggtactcctagactttaaagatgtcttgaacatttaagttcttcagcagttcacactacaccgtttttttgtttttttttcccccccgggagggtttttttgtagggcagcacagcagagcaggacatggatgaaatactaggaatatgcacagtggggcagtgtgggggcttctcagtaatggagaacagttggtgaaacttttttttttttttaactaagcatttaatttatcttgcatattttccacatttaaaaatgaattaggtctattaggataattaggagtttgatcccatcaacactattcttgtagcagttaggaatcttgagctatttttttctcatacgattactatagtccagtttaccaaagttttctttagatgtctgataatcttgagatgattgcttaccttaaaaggtatagaaaggatcacttaaatatatggaaaaatgaaataagggtgaagctgaataaagttctacttactgtattaactggcaacagttgagtttcttaagatctgaattgctgtgtatgttacgctgtattcagaaccagtttctaaccagcctgtgagatgggaagttttttccccataattgggatgaaacctttcattcaggtattttgaattgaaggtgtatgtgttgtttgtaaccttgtggagattgcaagtggtgttgacattctggatcttctatgtaac

SEQ ID NO: 1584 - DNA, 1133 bp, Homo sapiens
ccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacgcccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcatcaccaggagatgcaggctctgaaggaggtcttcaaggagtatttgattgaactgtttttcttgcaacactttcaagggaacatgatggatttcttagctttcaaggagagactgtatggaccattacaagcatatcttaggcagaatgatttggacattgaagaagaggaagaggagcactttgaagtcattaatgatgaggtaacagttctttgttttggtgcttgtcatgggaggcagagctcagggcttatgctgcgtgcaggtgcaacgcagagcttaccatctcagagcatgcgttctaggcacttcactttaaagacacactgtggctgtgaatagtggtttaaagtccctcagagtctccccacatttacagagggtggttccagggatcccagcacatggctgaacccccagcagcatggaaactccagtggtgttcagtcaggcacctctgtggcaggtgctcacggcggcagcgtcctggcacctttcttggaatgccaccacatttgcctgctcctaaacggttgtgccgtgcaagatgagaaccccagagtccacccttgccagctgcctgcagtcagggctggctggtctcaaagccaagattccaagttcctgaacacacatctcaatgtcaagagtttctgaacaagttacagctctaacttagaatatacagagcaaaaatttatagaatttcatttt

SEQ ID NO: 1585 - DNA, 1197 bp, Homo sapiens
cggcccagcattggccgggaccctccgtgtgcccagcggggttttggggggcagagtgatggtggagatgttgcctctgctcccagcatccccctggctgcttccctctgccccagcgggctcctcaagtgaactggctcctgccccagggcctttgcaccagccacagctgtggcctctgccgcttttccctgtgttgccctggtttgaacgtcccgtccccgtccccccgggaggccttccctggtaccccgtgcgtggtagtcctgcacaggcgcccctccttccccactcttcatgctgtcccgcccgagccctctcagcactcccgctgcagcagggcagacagggcccgtcctcttgctgtgtcccaggcagcctgtcacaccgggtacgctccagagccctggcccccctccccgccctccttgggctcctggggcagggctgggcctaggtgctggcatcctgagctcatgcggccaccagaggccgctgcagccttgcccaggcctgcagcgcccgagctgccctgctaggtttcacctcgccggggtctgcagtatttcctgctcggattcagccagggcctccctcctgacatcacggagggtttgtgctgggctgttaggcggatctcggatgatgggcgaggccaggaggagagtgaaagcgcctccgagtcagccaggcttggattctgtcgtcagaggggctctgtgtctagcaacctccacgtaaccgtgttcggtcctctgctccctgtgttccccgcatgagccgggcatgaacagggacctccttcaccgcctgaggtcccctctccctggctggtgacccccatctctgagagcacggggacgtcccctgtgctgtggaggagcgtgtgctctccgagatccaggtgctgcccccgaggagcgcatgccctctgaaatacaggtgttgccgccatccccgagagcacggggacgtcccctgtgctgtggaggagcgcctgccctcccagatccaggtgctgcccaccaggcggtgttaggagtgcctcgtccgcaagggcgccatccttgttaatgggattcaggcctttgtaaaagtggattcttcacgtggtgctgagccggctgctctctggcctttggcctcctgtcaggttgggcgcagccaggaggccctcgctagaggctggtgccttca

SEQ ID NO: 1586 - DNA, 1220 bp, Homo sapiens
gtcgcgccttccccgctgccgcccccgccccgggctccgccgccctcttggagcccccggagcgcccctaccgcgaccgcgagccccacggctacagccccgagcgcctgcgcggggagctggagcgcgcgcgggccccgcacctgccgcccgccgcccccgccttggacggcgcgctgctgccctcgctgggagccctgcacttcccgcgcctctcgcccgccgcgctgcacaatgggctcctggcgcggaccccgcccgccgccgccgccctcggcgcaccgccccccctggtgacggcggccgggccccccacgccccccgggccgccgcggagccggactactccgctggggggcctcgggccgggcgaggcgcgcgactactccccgtcccgaaatcccccggaggtggaggcgcggtagccccggggccgcagacgcctctccgagcggagcgcaccgctgtccgtctctccatcagttcctagaactcaagcacagctcccgccgatcctggggcggcgccgcctctccacccgcagcctgcggaggcggggacttgggtgtcggcttttctgagggtgatcttttgttttccgagtttgggattcggctgttgggaaaaaaaaatcgcgtttgtaccttttccccccacagatgagaagtgtttgtaatggatttgtatttttcttaattttatgctctttagacgtttaaaagaaccaaaaaagaaacttttgcttcttcgttttcggttgggatttgcagtttaatggcctcagatccttctccagatccccagggtttctttgtcttatttatggagaaaaaccggtcactttgtccagcgcactgtgaggcccccactcaggccagccctggcccccccttggtacttggaaccgaagttacagattatattaaaataataatgtacaaaactttgtttttttgccttattatgcagaagtgtaatttcttttttggtttgtttttttaaaagcaaacgaaacgtgtaaatagtctgttgatataaatatatgacgttactaaattcttaatctagatagactttataaaaaccgtttccagaaacccctctggttgtttgtctaacatggtcacaaaaacccaggcgctgctggctgtaaacattatcagaagtttaatggcagcaactttccttcaactatgcaagcgcttcccggcggctctgct

SEQ ID NO: 1587 - DNA, 1100 bp, Homo sapiens
gtgcacagtttaataaaataaaagccaagccaggcgtggtggctcacgcctgtaatcccagcacttgggaggcctcggcgggcagaccacttgaggtcaggagttggaaaccagcctggccaacatggcaaaaccctttctctactaaaaatacaaaaattagctggatgtgatggcatgtgcctgtaatctcagctacttgggaggctgaggcacgagaatctcttgaacccaggaggggaggttttagtgagttgagattgcaccactgcactccagcctgggtgacagaatgagactctgtctcaaaaaaaatataaaagctaaagttttgtgtgtgtgtgtatgttttaaagtattgccacacaggcatattagagagctcttgaaattgcagccttctgcgtctcaggctagagaagggcatggcctagaggagcacagtccagggtgagctcagactctgccccttgatttctgcagtgttttacccattgtctttctctaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaagcccgagggctcccctgtcacggagaggtgagggctccccccatcacggagaggtgagggctcctcccatcacggacaggtgagggctccctccgtcacggagaggtgagggctcccctcatcacagagaggtgagggctgccctgtcacggagaggtaaggggttccttacagatttgggctgtgtttaacaccaagtttggggatggcataagtgtccatcaaccagaaatggataattgccattttgtagggaatgagatacactataccagagttcaaagggttgaattgcagctacaggttacaacactgacagtttgaaaccactttggagaaaaaagcaaaaatcaggttgaaggaagacccttatgcctccgtgtatgtaaaacttaaaaacatgg

SEQ ID NO: 1588 - DNA, 1177 bp, Homo sapiens
ggccgccaaggccaagctaggctatgatcccgtggagctagacccggaggacatgtgccggatggccacggagcagccccaggcacgtaagccacatcccggctgcccctgctgccgtgtgcacgcatccagatggccacggagcagccccaggcatgtgagccacatcccggctccccctgctgccgtgtgcacgcatgtatgccagcccgctccacccagcaggctgtgtctccgggacacacgtgttttgtcctgtgccggtctccttactgtgtgtgcggcaggctggtcaggccaggctttgctttctgtgcttcacacttgaccctgggctcttgatttttgatggccctgctctctggcgttctctcctcagactctggccacgtattctgtgtcagatgctgtcgccacttactacctgtacatgaagtacgtccacccattcatctttgctctgtgcaccattattcccatggagcccgacgaggtgagcattatctgtcctgtcggcaccctggcctcctcagcccttgccccattccaaatgcactggagctgaatggaggtggatgtcccaggagtgctggcaccagaggcggcagtagaattctggtgtgtgacgtcagggatgtcctttgggaattctctggccctggtgtgaggaagaaaccacaggaggcagaatttgcagccatttaccacgaggttttctctcctttcacactgaagttcagcttaggttcctggactttgcctgcaagtcagggcctttggtgttgcttttggctggaagccttggtttctcttgcaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatggtgtgcttcttccctgggattcagattcttcccactcttgtgctgtggtaggacccagaagctgcaggggctgaaataaagccccttctccccatcctgtcccacggcccctcaccgggtgtggcttctctggcccagcaccccccg

SEQ ID NO: 1589 - DNA, 1181 bp, Homo sapiens
atggtccagcaatcccacttctgggtacagacgcaaaacaatcaatgaaagagagatctgcacgcagcactgttcacgctagcgaggagatggcaacagggcaagcgtccagcaatgggtaagcggtggggtcggtgcacgcaggcgtccagcaatgggtaagcggtggggtcggtccacccagggagcgctggtccccctggaaggaaacccaggctctaacgcggtccctctgaggaccctgctaggcgaaacgcgccggccatagaaagactgtcccgcaggagagggcggtgttcggcccggggtttgaggggtcgggaccaggaggagggacagcccggccgaacctgaacgcacttcaggccgcttgaacagcacacgcaggaactgcgccgacggaaaactttacttcgtgttccgccaccaaaaaaatatcgtttaaacaaacctgcggcagcttcccagctcccttaaaccaggatcccaagttctccgcgtctccgcccctgcacccagcctccggcctcggcaggcgcttccggtgcggaaccttctggaaagtaccgcgccgccctcccggcgtccccacaaccccgcccgcacctgcgcgcaccggcgctcgcgagcacaagtgacgggactggagcgtggcgcggcaggtggctccacgaaaacgccccttcgcgcaaggctgccccgcgtcctgccgcgccccaggaggcgggacttccgcccccgccgcccggaagcggcagccgggggaagcgtgttcctcgcggagcgccgtcggggccgtgggcgcctgcgcgggccggcgcgggagcaagcggcatggcgttccggcaggcgctgcagctggcggcctgcgggctggccgggggctcggccgccgtgctcttctcggccgtggcggtagggaagccgcgcgcaggcggggacgcggagccacgcccggctgagccgccggcctgggcggggggcgcgcggccgggccccggtgtctgggaccccaactgggacaggtgcgcgcggggctgtttggggccggggtcgggatgggggtcagggcaggtgttaccgttgggatcgagatcgggaccaggtttaaggttgcgatcgggtcgggatctggggtcgccgtctgctttccccagcggaggagccgctttccggggccg

SEQ ID NO: 1590 - DNA, 1185 bp, Homo sapiens
ggactacaggtgcctgctatcacgcccagctaattttttgtatttttagtagagatggggtttcaccgtgttagctgggatggtctcgatctcctgaccttgtgatccacccgcctggcctcccaaagtgctgggattacaggtgtgagccaccatgcccggcctagctcagcccgttttaaggacagagccccctggctctaacgtgctctttctctctctctctctctccccagagcactgcagtttcctcctgaaggctggctccggctctccctcaataatggcagcatcacccacctggtgatccgacccaacggccgagttgcgctcaggaccctcggggacacggggttcatgcctcccgacaagatcactcgatcctgagggctccggcctctccttccctctgtcctccctgcacaggccgcacacacttaacgttttgttcccaaggagaccggcggaaagtagaaacctgcaatgctgcatctgggaactgacttgtgaccaggctgagaaggggagagttgggatcagacagcctgacttctctgcagggttttatacctgaccatgaacccccaggatggcgtggggtttaaggtgaaagcgtctcacgcacaagtcaggcctgttgtggggacttgaaagaggcctgacccagaccaccatgttcgcacccacagctgacccgtgctgagggtccaggctccattggcaaagccggtcaggcacgagggcgactgaggcacgtggatgaggagggcacccaggttctgttcacaactcacttcacttcatacatccttttaatttcttaaaaccctcttgtcccttaaatatttgtcaattaaagattttctggctgggcacagtggctcacacctgtattcccagctactcaggaggccagggtgggaggatcacttgagctcaggagttcaagaccagcctggacaaggcaacatagcgagaccctgtctctactaaaaatacagaacttagctgggtgtgtcgtgggcatctagagtcccagctacttgggaggctgaggtgggtggatcacttgggcccgggagctggaggctgcagtgagctgtgattgtgtcactgcactccagcctgggcaagcgagggagacttaaagcaattttttcttttgaaacggagtttcactcttgt

SEQ ID NO: 1591 - DNA, 1163 bp, Homo sapiens
gagcaccgatgtccctttgataacctgcactcaccaagatgaactatttgccgccctgtcttttcctgggttggggggtggcatctgatggtggcagagtgcctgttggttcgcccgtgggtctcatggttcagacagagggaggtggacggcagggatcagggagccaggagcgcgcctcagacttgcagcaaccattgtgatttgggttgttcggaatatttaaattactgatcagaagatgaaagtagcttttctcttgggaagtcttgcagcccgtgggagtgataccaggagcaacacagagctcagcagcggcgccaaggtgttccctgtttcctcagcacgtgagccttcaccgcctgcttcattcaggagccagtgcagcagtaatacagtctatacattgttctgttttcaaatttatcctgaggctttgttgagcataaatgattatacgataaaggtatccgttattttggaactcatttcagttgggatctcctgtatgcagagtgttgcatttagaggtttgagtcccatcttggtttcttgccgtgctgactgtagccttcaccttgacttgaatgaaggtctgtggttggaatgtgtgaggagccgctgaggtgttcaggaggtgctgcctggaggtcggtttcttcctgggtgttacgggcaactgctcacacagttgtttctctgtgaacatttccagtgtttaatccaaaatgaaaacccaccaatgcttttgctaacttcagtgccttttataaatcatttttaaatttcctgaacttgctttttgaggatatacagggatattaagtagacgcaggattgtttttgtttgtaaaaattctgaattgaaactttgttttaaaaaaaggcttctttctttcatatgacaagagataggtcaggaatattggaatcaagatttaaatgttaaaattcgattttgttacacagggtgtgttcatttgttttgtagcagacaagatctagatcccagacagaaacaacacatgctattctaaaaagccgcattttaaaaggcaccttggttctcaaaagaaatcagaatatggatattcgtagtgatgatctgttttctctaaaatcttaccatattgtctgtatatggttgtaaattcaaatggaaa

SEQ ID NO: 1592 - DNA, 1148 bp, Homo sapiens
cccagcactttgggaggtcgagacaggaggatcgcttgagcccaggaggtggagaccagcctgagcaatatggcgagacgctgtctgtgctaaaaatttaaaaaattagctgaacgtggtggcacacgccttgaggagggaggattacttgagcctgggaggtcaaggctgcagtgagcgaagattgcgccattgccctccagcctgggagagagagaccctgtctcaaaaataaataaataaacaagtacgtacatacatacataaaaaggtaattatgtaagtcctcgttacggagcctccatacatgaagggctttagagccgatttgttaaatggtcagctgtagtcagctgttgacacccagcgtccactctccattaagttattaagagctttttcttagttacagaagctctcagtgggctgtggagacgctgccgtctcctgaacacatccagcgaccacatgactaagcaaaggcagcggagagtggacggacggtgatggacgcggccacggagcccaagcgcccacaatgcgcattcctgtcttttctctccccgctcacctcagagcgggacggaaggtgggactgggagagctgttctcgggcaggtggacgctgtggattagcggagagggaaggcactttcgttctcggcaccgtgaggctgtcctggtcaatcctgttttcatgcttgagggtctctggtgcagcagctccaccagccttgacaccaggacttctgtggaatccaggtaagcagccagggtcctgatagggccatgccctcacccccatgtaatgcatccactcccagttaaatgagaaaggaacaatcacaggaaaacatggagaacaactccactgttcagaagccaaccctatattagctactgtttaggtagaaatgaaaaactttgagacgtaaactcctgcaggtagaagtagatttccggtgaatgaacaaaatgaagcttattagaatcaatggcctcttctgagagccgttctgaatttttttttttttgagacggagtcttgctatgtcgcccaggctggagtgcagtggcgcgatctcggctcactgcaagctccgccttccgggttcacgccattctcctgcctcagcctccccagtagc

SEQ ID NO: 1593 - DNA, 1329 bp, Homo sapiens
tatcatttgtacagggttaattttgaaataatacttgaaaatttcattataaatatatcctactttttatcttaagttgaagatgttatttactaaattgttcttgtaccattagaaaaaaaaatacggcaatttacgttcttatttattttggctgtactacccctttgttttaattttaaaatcaagaaatcgggccgggcgcggtggctcatgcctgtaatcccagcactttgggaggccgaggcgggtggatcacctgaggtcaagaggtccagaccatcctggccaacatggcaaaaccccgtctttactaaacatacaaaaattagccgggtgtcgtagtgcgcacctataatcccagctacttgggaggctgaggcaggagaatcacttgaacccaggaggcggagcttgcagtgagccgagatcgcgccactgccctccagcctgggcaacagagcgagactccgtctcaaaaataaataaatgattttaaaaaatctaaaatcgagaaatcacacattcagtggggagcgacttctccttgcttatgggaagtcctcaagtgagtgatgttcaccatgtatttttttttctcttaggacagactaattctgaaaataccgaaggaaaagtagctctatgttctcaccccggttttcctgcgtgtgtgcccttgggtgcgatgcctcccccagcgctctgtggtcgccggtgccagggccccctctggtttggcagggcctggctgcctttgctccctgcagtgagtcttttggtgttttcatgcacggcttgtgcttctggatctgaggcctctcgtgttcacgcggacacttccttccttaagaagacgcctaaaagaggaagttggaattttttttttttttttttgagacagagtctcgctctgtcgcccaggctggagtgcagtggcgtgatctctgctcactgcaagctccgccatctgggttcaagcgattctcctgcctcattctccccagtagctgggattacaggtgcccgccaccacaccagcctaatttttgtatttttagaggggtggagttccaccatgttggccaggctggtcttgaactcttgacctcaggtgatcctgagcctcagcctcccaaagtgctggaattataggcgtgaaccaccgcccccggctgcagttggatttttaaattgcttttttttattgttgaggtttttttatctccaagggactctcccggcacttctaccttccagagttacttcagtgcataaagtttgaattattttgttcttgtgggcagaagtgggaatgatggaatatcc

SEQ ID NO: 1594 - DNA, 1389 bp, Homo sapiens
ggggtggggtgattatatggaaccgaccgtgtgtgcctacgcgtgcagaccctcctggcccctcaggtaaaggaaccgacggtgtgtgcctgcgcgtgcagaccctcctggccccgcaggtaaagtgtctcgtctaccccctctgccatcactgtacctcacgtggcctccaccacagcacgtcatgtctgccattgcgtgtgtgcccattacatggcgagatccttgaagacagagactcattccccgtctgcctcccaccaccttgaacactcccaactcctaaagtgccaacacaggtttaatttgccgaattaaatcttcagttctgctgattctgctgagtacattcctctgctacaaagctaatggttccaaaacaaaatgattaagtatttgaatcctggagcatcaacactgccttttaaaatacagcaaagtctaaactagtccagctgaaacatctgtgagcttcagttccaatgagggagtccagggagttagaaactggaagagcaccttttttcagtggccgggaagatggcggacattcagactgagcgtgcctaccaaaagcagccgaccatctttcaaaacaagaagagggtcctgctgggagaaactggcaaggagaagctcctgcggtactacaagaacattggtctgggcttcaagacacccaaagaggctactgagggcacctacattgacaagaaatgccccttcactggtgatgtctccattcgagggcggatcctctctggcgtggtgaccaagatgaagacgcagaggaccactgtcatccgccgagactacctgcactacatccgcaagtacaaccacttcgagaagcaccacaagaacatgtctgtacacctgttcccctgcttcagggacgtccagatcggtgacatcgtcacagtgggcgagtgccggccttgccggcctctgagcaagacagtgcacctcaacgtgctccaggtcaccaaggctgccagcaccaagaagcagttccagaagttctgaggctggacatcagcccgctccccacaatgaaataaagttattttctcattctccaaaaaaaaaaaaaaaaaagaaactggaagagcagcatcacggccacggcccagacaggcaccaccacctgaacagaaggaaggatgggatgaccagcaggactggactcagccattacaggtggaacatgcagaggagaactgctgcagaggagaactgctgcagaggcccacagtgacgacgcctgggccttacactgaccaagaaggaacacagccaaagacgctcaggttccaccgagagggcacgccaacatggtgacagccaaccgcaccgagctgagtccagtgcaatcacagattctgctca

SEQ ID NO: 1595 - DNA, 1200 bp, Homo sapiens
attgtcatcaacaggttggttgttttctaatcttatctcaagtccagatctctctcttgagctcctcttggcccaaatatccgtttgggcattctgttatttccttttttcttttttcaattatggtaaataaaaaaaaagacataaaatttagcattttaaccactgcgcccggcctagctttaccatttttaagtatacagttcagcagtgctaagtatatgcacattgttgtataatagatccctagaacttttcatcttgaaaaaagaaactttattcctattaaatatcaactgccaaccgatgccgtggctcatgactgtaatcgcagcactttgggaggtcgaggcaggcggatcacttgaggccaggagttcaagaccagcctggctaacgtggtgaaaccctgtctctaccaaaaatataaaaattagctgggcatggtggcacgtcctgtaatcccagctactcggaggctgaggcaagagaatcgcttgaaccccggaggcagaggtctcagtgagccaagatcgcaccactgcactccagcctgggcgacagagcaagactgtctcaaaaaaaaaaaaaaaaaaaaaaaatctactgcccatctcttcctttctctcagccctggaaaccaccattctactttccatttcaatgggtttgactgcgttagatacttcatatgagtggggtcatgcagtatttgtattttgtggctgcattatttcactcagtgtagtgtcctagatgtccatccatgtgtaccaaatgtcagaatttcctatcttttcaaggctgtattatataacattgtatgtctgtttcacattctgtttatttgttcatttgtggacagacatttcatttgcttctacctcttggctattgtgaataatgctactatcaacgtgggtgtgtaaatatctctttgagatcctgctttgaattcttttgggtgttttgtttttggtttgttgttgttgttgttgttttgagacggagttgtcacccaggctggagtgcagaggcgtgatctcggcttactgcaacctccgcctcccgggttctagtgattctcctgcctcagcctcccaagtagctgggattaaaggcacgcaccaccacacctggctaatttttgtatttttagtagagatggggtttcgcaatgttggctaggctggtctcgaa

SEQ ID NO: 1596 - DNA, 1168 bp, Homo sapiens
tgttcataggttatatgcaaatagtacaccgttttgtatcagggacttgagcatctttgaagtttggtgtctgcaggacattctgaaactaattgcccgtggacatcaagggagattatacaagtgaaacaaaatttggcaatagctattgtctttgtctgttttctgttgcttataacagaatacctgaaaatgggtaatctataaacaaataaaatttatttcttacagttctagaggctggatccaaggttaagggaggggcatctagtgagggccttcttgctggtggggactctctccagagtctcaaggcagtgcaaggcatcacctggcaggaggcaacacgtgccagctgaggtttctcttccccccttacaaagccactagtcccactcccatggtaagccattaactcattaatccattaatccagaatggattaatccatttatgagggacacgccctcataattcaatcacctcttaaaggccctgcttcatgtgaaatgagtttgggaaagaaaaaacattcaaacagtaacatctatcgaaatttaaatcactactttctttcactcataaattctactaataagaatttcacttctagaaatttatcttacagaaatatagacacacacacatgcactatatatatcacagtttatacgtagcaccatatattatatatgtagcagttgtaaaacaatatgcaatagagcccattttaaagattatgttcacatggggtcaggcacagtggctcacgcctgtaatctcagcactttgagaggccgagacaggtgggtcacttgaggtcaggagtttcagaccagcctgggcaacatggcaaaacctcatctctacaaaaatacaaaaattagccaggcgtagtggcctgtgcctgtagtcccagctacccaggagactgaggtgggaggatcacttgagcccaggagttcaaggttgtactgagctatgaccataccactgcactccagcccgaatgaccaaaaaaaaaaaaaaaaagattatgtgtgtgttggtgcttctatgtgtataggctaaaaatttgtgatgtcatattacaaattggttatctttgatgaatgggaactttatttctaaaatatatatggtgtatatatgtatatagtattttagt

SEQ ID NO: 1597 - DNA, 1225 bp, Homo sapiens
tctgttgcccaggctggagtgcaatggcacaatctcagctcactgcaacctccgcctcctgggttcgagcgattcccctgcctcagcctcctgagtagctgggactacaggcgcctgccaccatgcccggctaattttttgtatttttagtagacataaggtttcaccgtgttggccaggctggtcttgaactcctgacctcaggtgatccacccaccttggcctcccaaattgctgggattacaggcatgagccaccgcacccggcccactttcaccagttctgttcatcattgaactggaagattctatctttggcagtttgcaaaacaaataaacttaaaactggagttaaagacatccagattagaaaggaacagtttaaaccatcttttttcagatgacatgatcttgtacatagaaaatcctaaggaatcaactttaaaactgttagaataaatgaggttgtagagtaaaaaaaaatcaatatacaaaaatcaatagtgtagtgcagaaatatattaatatcttctcagccgtgtggctgagatgaagtgtagtatttgtatatctgatgcttccgctatccaaggacaatctgttaaatggatttttggagcagggagattgaataggaccttgctccatctgctgtatgcattgacctggtagtgcagtaactccaggaactgtgcaccccctcaggaagaaaagaagaaatacactatacactacccatgaattatcccaaaaatgaaattaacatttataattgcataaaaattattaggaataaatttaatgaaagaaatgcaaaacctaaactctgaaaaccataaaacatgggaagaatataaagatactaaataaattatgtcgtatttttatggataggcacttaatgttattaaaatggcagtgctccccaaattaatgtacagattcagtgccacccttgtcaaaattccagcaacatttttacagaaagtgacaaattgatcctaaaactcatatggaaatggaagggaaccagaatggcccaaacagtgttgaaaaagaaaagcaaagttgggactcaaactagaaagcaacattgatgaagacactgtgaagacagaggcataaatgaatggaatggaattgagagacaaggaaaaaactcttacgtttatagccagtggaggtgccaggaaaatttaagagaagaaaggagagtcttttcaaca

SEQ ID NO: 1598 - DNA, 1204 bp, Homo sapiens
ctctgtaggttcaaagaaaacaaagcgcttttccgcgctacctacagaggggtccatagggcgttgttctggattccggtcgtaacttaaagggaaactttcacaatgtccggagcccttgatgtcctgcaaatgaaggaggaggatgtccttaagttccttgcagcaggaacccacttaggtggcaccaatcttgacttccagatggaacagtacatctataaaaggaaaagtgatggcatctatatcataaatctgaagaagacctgggagaagcttctgctggcagctcgtgctattgttgccattgaaaaccctgctgatgtcagtgttatatcctccaggaatactggccagagggctgtgctgaagtttgctgcggccactggagccactccaattgctggccgcttcactcctggaaccttcactaaccagatccaggcagccttccgggagccacggcttcttgtggttactgaccccagggctgacccaccagcctctcacggaggcgtcttatgttaacctacctaccattgctctgtgtaacagattctcctctgcgctatgtggacattgccatcccatgcaacaacaagggagctcgctcagtgggtttgatgtggtggatgctggctcgggaagttctgcgcatgcgtggcaccatttctcgtgaacacccatgggaggtcatgactgatctctacttctacagagatcctgaagagattgaaaaagaagagcaggctgctgctgaaaaggcggtgaccaaggaggaatttcagggtgaatggactgctccagctcctgagttcactgctactcagcctgaggttgcagactggtctgaaggtgtgcaggtgccctctgtgcctattcagcagttccctactgaagactggagcgctcagcctgccacggaagactggtctgcagctcccactgttcaggccactgaatgggtaggagcaaccactgactggtcttaagctgttcttgcataggctcttaagcagcatggaaaaatggttgatggaaaataaacatcagtttctaaaaaaaaaaaagaaaacaaagcaaatgaaagaaataagggaggccgtgcgcagtggctcacacctgtaatcccagcactttgggaggctgaggcaggtggattatctgaggtcaggagcttgagaccagcctgacaaacatggag

SEQ ID NO: 1599 - DNA, 1187 bp, Homo sapiens
cattttgccacgttctaaataatatttagctcaactgattcatacgtattaatgaccattctagcaaaggcctacaagtggtgtgggaatcagggaaaggctgcctctttggtatctcaactggtattgattattgctatcaactatttggggagaaaaaatcaaaatgaagccctgtcaaattttagaagtactatctttggtccttcaaacactttgtgatgacaccttaagaaaaataaagttgaagttcaggtcttgccattgccattacagacaaattaggagacttggtttacctgggaacaaatttacttgaatattcagtacctgaaactatgccaaaccaaagagcagctgcagtacattcgttattttaaatgaacaagtttacaaagtttattttcatctatacgtaaggatgatttttttaaaactttttacatattagtggttatgatccaatgtgtcatgagtgaatttaactgtaaggtggtttaaatcaaatatgcaatgtttacttgaattgtatttctattagcagattttgactatgtttacaggacggtttaaattaaggattatcaggcatgtgagatctttcagttatctttaaagtagatgtatattaagggcttagatttaggatctacatattctgggcattgaataggcagtaacttacaaataagttttgcttaccttttgttctagggactagcactgctatcaatggaaagtatttttaactaatctgttattaagaaagtcatatttttgcatttcagccaaaataaagaccgcctgtaataatctgttagaaacagataatacatgtctgaaatccatatgtttcatatgatctaaactgtattttccaatttaaattaaaaatgtaatatagattcagaaaggttcatatttttctaatgacttcattctatattattttgttaggttgcataaagaagcaaggaattgtacttgtattaaaagatgaagaaagctattaggtatatttgtacatgactgcaaatgagtctatgcccgtttaaaagaaaagatggacactattttaaagtgagctttaatatgcttttatataaacaaatttgaagtacagtttagtttggttgtgtttacctaacaagtaccataagccttgtgtttgttcttatttgtataat

SEQ ID NO: 1600 - DNA, 1176 bp, Homo sapiens
agtgatttaaaatgcaatttaaactaggcaaaaaaaactttagagtaagttttcctcctggctgtcagttggaaattctaacctgagtggtcattttacattcccagtctcttgagaagtggattctactcttagacgcacagtctgaagtctgacttcctaacggcaacccctttatgactagacacatttctcctttttccttttaaaatctaagcgacaggaggtgttgcattaactccaaggaaaagtacagaataaacaatgtagaaatgtcactcctcatttacaccttttagacagacagacacacacacacacacaccccccccaaaataattgattgcttccagtgagtgggtggagatgaatctcagcagcatctgtgagtactacaggttggagcttcctgtctgtaaaatgggactgcaggggagggggtgttgtgaataagttggactggatgacttctaacattctgtgatgcctaattttgcaaaatcacttttcattcacccaataaatttttttcttcttttttccacagagttttgctctgtctcccaggcaggagtgcagtggcgggatcttggctcgctgcaacctctgccttccaggttcaatagagtctcctgcctcagcctcccaagtagctgggattacaggctcatgccaccatgcccggctaattttcacatttttagaagagacgaggtttcaccatgttgaccaggctgatcactaactcctgacctcaaataatccacccacctcagcttcccaaagtgctgggattacaggcgtgagccaccacgccccgccccggtaaattttttggagtaccttctgtatgctaaataataaactaggaatagctctgtcatttcctagtacagcataaattttatggttgctactgtaggtttataatttgtttataatttggcctaatttccatcagccatactaatattggattttaaaaggaggcaactttttttctttttgaaccaaaggaatgagttagctttgaaaacataatttgggatattatagtatggattcttctacctttgtttcaactccttagtaatcttgattctagcaaactagaatgagatttaagagataccaattattgctgggtgtggtggctcatgcctgtaatcccagcac

SEQ ID NO: 1601 - DNA, 1151 bp, Homo sapiens
attcaaaatggccaaaactttttcttgttagcctgtattgaacaggggaatgaaatttaggtcactttttctgaacaatacagggaatgagttactcagatgtattcatcatttatggtgatggtaacttatttactttcagttgacagttccttggatgtaatgttcatagtaatagattctgttttaaataattttaagtcatttaaaatgagcttttggagaacttgaaatatagtgcgtgaagaaagtgttttagcttaaatcttcagcaatttaatacaatcaaatctcctcttaaatctcatcttataaaccagactgataatccttaaatataggaacagaatatttcttcatatctagtaatgtttcctcatgcaagtaaagtttatatatttgatgtttcagtacattttaatttaattgtttattggattcggcctcctgacccaattattgtgttttaatgtaatgctttttgctgttttcacctggattcaatgaactgttatttgtttttatttaccaggaaagaccgttgtttaccttgtggctttccatctgttctttgttatgtttgtatggtcctattggatgacaattttcacatctcccgcttccccctccaaagaggtaaatttaatgttggtaaattaccaaatgttttaactgattatggaattttttttcccttgtgttacctttgttaaaactttacataatgcatgtgttctgtttccattcataaaactgcttggttgctctgtactgtgaatgtgagtcatcagcctattctcagatacagtccactgacacagcatagtaaaagttcagcggtatagaaatgcttactatttttctgccatgctatgtgtctttaaagacatactttatattactggaataaaaagtctcaaggaacagaattgcgttaggaaagtagagtttatttttagaaactctcaacatttatattttctcaggcatgaacagatatgctgcaattaaagaaagttttgtgatggaaacaaattgtctaggctattgcttgctgcactttaatatgactagtgtttcttctaattggaggttccatttggaaaataatataggtaaacatttatgtggagtaggttttatgaccagtg

SEQ ID NO: 1602 - DNA, 1175 bp, Homo sapiens
ttcagtcagacaaatactcatttcagagattctatacttcatggaatcaagaagcaacgagccataaatctgaaagacagcaacagaacaaagaaaaatgccccccttcagccggacagacttactctcaaaggttctttgttcctcccactttcaagtcggttggcaatccagtggaagcacgcagatggctaagacaagccagagcaaacttctcagctgccaggaatgaccttcataaaaatgccaatgagtgggtgtgctttaaatgttacctttctaccaagttagctttgattgcagctgactatgctgtgaggggaaagtctgataaagatgtaaaaccaactgcacttgctcagaaaatagaggaatatagtcagcaacttgaaggactgacaaatgatgttcacacattggaagcttatggtgtagacagtttaaaaacaagataccctgatttgcttccctttcctcagatcccaaatgacaggttcacttctgaggttgctatgagggtgatggaatgtactgcctgtatcataataaaacttgaaaattttatgcaacaaaaagtgtgaagatatttaacgaaaaaaaaggtagatcttgaatgtgttgtagcacgaataaattgctgtacttcattaagcttcattgccaattagctaggaattgttaagcacattgcagattgttcttggagaattctggagttgttatgaacatgaataccaacggaaaaccttaactgaatctaaaagaaaactattttgaagatggtggtgagctgcaaaatagctggatggatttgaatgattgggatgatacatcattgaactgcactttatataaccaaagcttagcagtttgttagataagagtctatgtatgtctctggttaggatgaagttaattttatgtttttaacatggtatttttgaaggagctaatgaaacactggacatataattggtttaaacataaggggaattaagtctttgtagtctgtcatttttttaagtggatcctcttggatgcgttattttctcatcagctggctctgatcatgaatttgttgtaattttatgttgtactcagtgcatttaagaaatggtagagtattttaatcctattacttgactaagagtgtgaaggtagtactttttagagtg

SEQ ID NO: 1603 - DNA, 1128 bp, Homo sapiens
cggagttttgttcttgttgcccaggctggagtaaagtggcgtgatcttggctgtctgcagcctctgcctcctgggttcaagggattctcctgccttagcctcctgaatagctcggattataggcttctgccaccatgcccagctaatttttgtatttttagtagagacggggtttcaccatgttggccaggctggtctcgaattcctgacctcaggtaatcttcccacctcggcctcccaaagtgcttggattacaggcgtgagccaccatgtctggccaggatgtttgttcctttcttatcttacttttagaaccaagaacacatcgttttgatcagagtagatacaggccattttaaaattgatcttggtaatagaggcagagagtgaaccaatgagactgagttgattacagcaaaggcagaatactgcttctctcctaattccaggatgaatatgatcagaattataccttgattaaaaacattaaatgataactagattcttcctgcccccgacttctcgttttctttactgaggagggctgtctgtatgctctgcctggttctgccactgagcagccagggtgtaaggaaagctccagatcccagaccccgggacagttgcactcctaggggtaattttcaccatgtttcctcttcccaggagttgcactgacgttgtagggtgagagacagcagttctgacagtcaaaaaaccttggagggtgggggctcacgcctgtaatcccagcactttgggaggctgaggcaggtggatcacctgaggtcaggagttcaagaccagactgaccaatatggtgaaaccccacctgtactaaaaatacaaaaattagctgggtgtggtggtgtgcgattgtggtcccagctacttgggaggctgagacagaagaattgcttgaacccgggaggcggaggtgcaatgagctgagatagcatcactgcactccagcctgggcaacaagagtgaaacattgtctcaaaaaaaaaaaaaaaaaagtaccttggagagtggggatctgaggggaattttattttcatgcaaaacacttacttatttgcattttttaagagaagggctatgattttggaatttaacaaatgcttc

SEQ ID NO: 1604 - DNA, 1178 bp, Homo sapiens
aaaagtgtcgagagtccagatattaggactcattcccatttggttctagggcactacaggattgccggggttgtctacaccattcttttccaaatgctgttattagttcttgacttagttgctgctgccagagccatagtcataaggaagatttagggaaatgggccttgcagatttacaaactgtttactagcttcccagatacagccactaggaaacagattaatcccattaaactcagcgatgtgtagagtagcatgtcagtctgttaatttatggaaggagctgtgtctagcaaagtaactactgttagtcatctgcacagtcatctgcacaccttgacctggtaggtaggcttatttgggaaaccagataataggtaagaatttagtttggtgactatagaaacagaaaaataaaaaacaaaatgtgttgccaaaagctaattcagtaaaagtgaatatgactttaaactgttatctgtagatatttgtatatagcttatggatacaattattctgcagatatttgtgaaatgcccaatctcctcatgaagtccctgctttggtgaatggtgccaccattcaccctgctgctctggtcaggacctatacttaatccagaccagtggttctcaaagtgtggttcctggaccagaagcagtagcatcacatgggagcctgttagaaatgcaaattcttgagccccacctcagacccactgaatcaaaaactggggtgagctccacaatctgtgtttcaacaagcaccccaggcactgcacactcccctcccccataatcatttgttaggtcctgcagattctccctccctgtgaactcttgtgtcttctcctgtgcccattgccatagcctgggctatgatcccaatcattattctcacccagatggtaactgggattgcctaactggtttctagccttttgtttttgctccactcgaagccgtcttggattcagacagtttagccatgtatttagcccagtgttaggcatagaattggttgtcaacacttatttgaactatgaatgaataatgaatgaatgaattgccaccagagggatttgtctaaaaagcagatctgatcttgtcactctgttgtttaaaattattcagtagctcctggttattctccagtttcccttcctactaccctgct

SEQ ID NO: 1605 - DNA, 1179 bp, Homo sapiens
acaaaaaaatataaaattagctgggcatggtggcacacacctgtagttgcagctactcagtaggctaaggtgggatgatcccttgagcccaggagctctaggctgcagtgagccatattcataccactgcactccagcctgagtgacagaacctgtctctgtcctgcgccctgggagtctgtctctctctctcacacacacacaaatatatatacgtaaatgcttatttttcgctcactttctcttgccagggaaactccagaatagacacaattgtcgtgggttttaagggacatgaaggagaaagttacccaagtccaacatctactgaggagcaatctgtcagccccacaggtcagagcagagtgtggcagtcataagtccaagatctgcttgtgagtccctccatttcccattaagttaatgctgtgaaaaactgtttcattggccttaggctgtaccccacctccagctacccctcccccagactcaatcatgggtcacagccgcaaaggctccccatggctcctgcccccatgacttcatcctggagaggaagtccctgtagcaagtgagggcagagaagtgagtggaattccagcaggatcttgcaacagactgggagtggaggaagatgctttctcatcacttctagaatgcatcagaaaggaagatgcaagactctcgcctgtttgatacagggctcctggctcccctgctctattcgtacctccccaagaaccacagggcccaagccaggagcagagccaaaggcagctgctctcagctgcagggaaaagcataggcaatagggaacatttgaaatccacattccagagtgggcccccttttgccttccattcgtcttttccttactcttccagttaattgaccagaagtttaatgagcacctattgtcaacaacagcactaggcttcctgtgtccttctgcctcctggttcctttttgctccttcaaagcgcaactttccttgggctgccctcctccttattcctcacctccaaaatgaactcttgcctccttcctgctcctgagcaacaaaaacgtccatcccttgaatcttgacaatctcacctaagtcaaggaagaattccttggctagtaattctcactaggtgaactgagaactctgcttaattctccctcgctccttaaacc

SEQ ID NO: 1606 - DNA, 2328 bp, Homo sapiens
ttttcttttggtatttcctaattatttttttttccatttcaaataagaagaaaagatagtgttgaatgatacctagatattttcattccagcggtttttttcctagtctcacctacacaggttccagtgagctcaggagtttaccttcatgtccgtggcacagcccataattacccttctctgtccagggatgtatatttgcatctttccttcaacttatgaagtgaatggaggggaaatgtacagttttaattgagtttgaagtagctttcatctgaccagccctgtgctggagcgtgcctcttcttctgtgagcagaggggctactgcgtgggaaatggctaaaccgcctgctttgtctttcactgcagcccgtggccacccaggagcccgatgtgcaaggcaggtgtgagtgccaggacggcattcctggagatgaaggcctggagctgcggtctgcggactcggcagtgcccgtggccatgacccaggctgccgtgcggccctgggcaccctgcctggagaacatgaccactgccccaaacggcctcgggccaggccccgcagccccctgtgcaggctcggacctgaaagacgccaagatggtgacctcccttgcgtgtggaaatggagtctgtggctgcagccctggtggcgacacggacacccaggaagccaaactcagcccagccaagcttgtgcgcctcttttccaccagtcggaagaggacgggtgcccaccccgagcggccccactccatggtcctggtggggaactcctccacatggaacaccctcgcctccttccggaaaatgggatcctttaagaaactgaagtcctcagtcctgaaaggaattcagagccgagaggggtcaaatgcctgttcaaagggagaggcttcggagcatggcctgggaaagtccatcccaaatggcgctgtcccaggagcccaggcaagcaggggctcccccttagcaccgggaccagcatgtggtgccctcaggccagcagagtggggcacattggatggctccgacctcgaggacacggacgatgccttccagcggagcacacaccgctcccgcagcctccgcagagcctacggcctgggccgcatctgcctgctggatgcgccccagaaccatgcgacacccacgatagccactggccaggtgcccgccgtgtgtgagattctcgtgagggaccctgaaaacaacagcatgggctacaggaggagcaagagcacggacaatcttgcctttctgaagaagagctcctttaagcggaagtccacctccaatcttgcagacctcaggacggcccatgacgcacgggtaccacagaggaccctgagcagttcctccactgactcccaaaagcttgggtcaggaaggaccaaacgctggaggagcccgataagggccaaggactttgacagagtcttcaaacttgtgagcaatgtgactgaggctgcctggaggagggagagtcctaggagtggggccccatcccctggagaggccagcctgagacttcaggcacacagccggctgcatgacgactactcccgccgcgtctccaggagcactgagcaggacagcaggcggggcggggcggtcatgcatgggaccactgcaacctgcaccgtggcccccggtttcggctcagccacctctaaggggccccacctagacgctgacactgccgtatttcctcttgaaaccaaaagttcctgggcggtggaaagcgacagttcctgcacttgcagctctttgccaagcccgattgtccaggatgtgttgagcaaagactcctgtgacccaaacgctggcagccagttgacatttgaccctgagcagcctcccacccctctaaggcccaccacacccaagccccagagccctcagagcccccagagccccggggcaggaagtgccagctgtcacagcaatcacagtgccctgtccgcgaattcagaggaaagtgaaggaagggcagaagagcctgctcagagagagccagggcctgtgtccttgcaggatcccctggaagccacacatggtgatgagggcagcaaggaccttctggtgaacattggtgtggcagccggcccagaagaaaaggagaaggaggaggtaagggcagcggcgaggtccctcatgtgggcgaccctcctgcgggaagggagcttgcacaggtgttgcccttggtccctaacctgtcaaggtcagtggccctctgctgaccttgttgcccttacagtattagtgggaatgggagttgtcaagttgctgtttaccaagttcagaagtaatctctatctccttt

SEQ ID NO: 1607 - DNA, 1160 bp, Homo sapiens
ataggtgcccaccaccatggctggctaattaatttttagttctactagcaattcttagagtgttttttgttctctacctgataggtaagaggtttaaaattgattttaaacttaattgaatttcttttaaacaatctgagttatagttacaaatttagtatggctgtttttagtgaacaagacatatacttgaaccagtagttataacaaattctgctatcagaaaacttcactaaattaaaaaccatagcctaaaatacatgatgggtttgtcatttcatttttctttctggatctcctaggattagagataaccttgctgtgttatgaaaatcttaccagatccaaagggaaaaaataaataacctccttagaccacacaaggttgtgagattgattgctttttttccttctctttctcatagctctgatcctgactacttcttccaaggattcaaaccagagcaaacacacttctttttgttgttgtactttgttagatgaataacgtgggttttcttttcttgcaacttgatgcctttccctcacaagatgtgtcctctgattctcaggctctgcagtccaggctgctagctcttatccctgtgtggctatttccatttaaattaattagaggtaaattgaaaattcagtttctcattcccattagctacatttccaggacttagtagtagccacctgtggctggctggtggctgccacactgcaccatgcaggactgggcacatcctcactgctggcagctctgggctgtgcccattcaaggggcttgttgggtggcaaggggctgggctggtgagttgccgtccctcttcaggaactcattcttgaactctcgcctttgttcgtttatatgacttctggtgttgattgaagtttggaccctgttcgtacttggttatcatgtgtaaccctgggtattcattatttcttgctggttttggtgcagttccttttcttccttacaccatttggcttattcatagttccccgtatttacctttctttttacttctgtgcaaaaatatactttaaaaacagatatatacttaatagaaaacaaacctatgtttattgatactctattaaatcatcaaaaaattaaggagagggcatatttaaccttcctttacattaca

SEQ ID NO: 1608 - DNA, 1264 bp, Homo sapiens
agcggctcctccaactacgcgtatgtgaacttccagcatacgaaggacgcggagcatgctctggacaccatgaattttgatgttataaagggcaagccagtacgcatcatgtggtctcagcgtgatccatcacttcgaaaaagtggagtgggcaacatattcgttaaaaatctggataagtccattaataataaagcactgtatgatacagtttctgcttttggtaacatcctttcgtgtaacgtggtttgtgatgaaaatggttccaagggttatggatttgtacactttgagacacacgaagcagctgaaagagctattaaaaaaatgaacggaatgctcctaaatggtcgcaaagtatttgttggacaatttaagtctcgtaaagaacgagaagctgaacttggagctagggcaaaagagttccccaatgtttacatcaagaattttggagaagacatggatgatgagcgccttaaggatctctttggcaagttcgggcccgccttaagtgtgaaagtaatgaccgatgaaagtggaaaatccaaaggatttggatttgtaagctttgaaaggcatgaagatgcacagaaagctgtagatgagatgaatggaaaggagctcaatggaaaacaaatttacgttggtcgagctcagaaaaaagtggaacggcagacggaacttaagcgcacatttgaacagatgaagcaagataggatcaccagataccaggttgttaatctttatgtgaaaaatcttgatgatggtattgatgatgaacgtctccggaaagcgttttctccatttggtacaatcactagtgcaaaggttatgatggaaggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggcttacctcactaacgagtatatgcagagaatggcaagtgtacgagctgtgcccaaccagcgagcacctccttcaggttacttcatgacagctgtcccacagactcagaaccatgctgcatactatcctcctagccaaattgctcgactaagaccaagtcctcgctggactgctcagggtgccagacctcatccattccaaaataagcccagtgctatccgcccaggtgctcctagagtaccatttagtactatgagaccagcttcttcacaggttccacgag

SEQ ID NO: 1609 - DNA, 1148 bp, Homo sapiens
ttagcatcatgaacggtgggacagcccattgtttttgcctttcatggggtgcagtaagaaaaaaaaaaatcaccggtatagttgtcccaccaaaaatatttaatttaaacctaatcatgatggaataatcagacagatctagaatttgtgctgttttaaatgaccactggcctagtctcttcaagaaagtatcatgaaaagctttgtggtagtggcgtagggattcaattaaaaaaagactaaggagacttaccaaccaaattcagtggattaataaaaattaagttcagtaaatttggatttaataaaaactcatacaaaagacatttttggaacaatttgtaacatttgagtatgaattataaaacagatgagtttatgaaaatgttattttgggggtgttatataaatgatattttgattatataggaaaatgtccttattctcagaagaggtatttcagaatgaagtggcatgatgtctagaaattacttttgttttcttctgacatcaccacattgatcgtatgctaaaaattactttcaagtggttcagaagaaaattgtgtgtgtgtgtgtgtgtgtatgtgtgtgtaaagatacggtaaaatgttaacaatatagatgaaggatatatagatgtttattatacatccttcaatttcttattaggtttaaacattttaaaatattacatttttcaaaacatgatttttaatgactacattgtaattccacatggctgtgtatgacaatttgttaaataattacgtgtaaaattttcagcgagaatacttaggggctattttataaatggtggctaagaaacttaaataaactttcaaatattcatttaaacctatactgtaactgaaatagcacgaaaagtaaccttgtgtgactttataaccttattaaacattttgcccatttgcctctggagtcaagatcttaatctcattcagaagactgagtggacaaggatttggtatgcatagatggaggcactggcaaccggagaggtcccagggctgcataacactaagtagctcatagtgactcaacattggaacttggtataacttgtctatgattaaagccattccagtgataccacagtgatatagtggtaccacaaagtagttttag

SEQ ID NO: 1610 - DNA, 1205 bp, Homo sapiens
gggccctcacctaataagatggtgtccatctatgtacgttacttggaggtggatctttccactttagtctactgtttcaaatgccagtctcttctggaaacaccttcaccgaaatacccagaaataatgctttgccagctatctgggtattctttagtcaagttgacaccttaaatcaaccgtcacagtctatatcaaattttcatatggtcattaatgttttccttgttttaaaatatgtgatatccaaaatttcattttaatagttaccttaatgattttatcatagtagtagttaacttggaactagcaggcacacagtgtgtattgtagtcctgttttactaaatggcatataatgttgagtgagatatactataacttttcattgtagtttttttttttttttaattttcaagttcaattacaagattgtatagaaatttggagtatttctcacgcctgtaatcccagcactttgggaggctgaggtgagtggatcacgaggtcaagagatcgagaccatcctggctaacacggtgaaaccccatctctgctaaaaaaaaaaaaatggaaaaattagccaggtgcggtgacaggagcctgtagtcccagctacttgggaggctgaggcaggagaatggcgtgaacctgggaggtggagctggcagtgagccgagatcgcaccactgcactccagcctgggtgacagagcaagactccatctcaaaaaaaaaaaaaagaaatttggagtatttcaactattgcagccatcgtcggttggccactcctgctcttaactaattcaaaatagtgatttttaatgtcatagtaaaactttctagaaaatctctagatttggggagtgtttcagtagaggtatgctactcacttcaaagcttattttggaaaaaataagcttttttttgtttgtttgtttttggtagagatgaggtcttgctgtgttgcccaggctggtctcaaactcttgggctcttgggctcaagcagttcttctgccttggcctcccaaagtgctgggattacaggcacaaacaaccttgcccagcctgatttattattactttttaaatctgatagtgttgctgtcctgcagtttattttaattatactgggtaatttggaatcactaagtgggacttcatgtgtccttggtgaaggatatgttggtttcctagcaactgtt

SEQ ID NO: 1611 - DNA, 1189 bp, Homo sapiens
ttctccctgtctctactcctaagtgccaaggacaagtcaagcaagttatcttgctgtttcttgtggtatgggattattactggttcccttatgcattgaagagaaaccctttagagatctcggcttcatgctcatctctcctgttgtcctccctgtcttgagtggaccctaagttttagcatctgtttcctgcataccgttccattcagctgttagaagagaatttaaaggtcactagggtcaggaaataccagcagtgggaagtctttggtgtttgcttatctctcgtagttcccccatcacttttgttttttgatttctgcagattattttatcactagctcagttaattattattttttaaatttcacccatcttttggttgttttcatcagaagggcctgagtatctcattacttcttcatgatgaattctatagtaagggtactaagtctaatcttttgcctaagttacaaaaatggggacagaagtcagaaaaaaatgtcttcttccatttgtgtatgtcatgtgctcagacaaaaataaattaattctgatacctatgaaggctccagagcagaacttttttttttttttttagatggagttttgctcttgttgcctaggctggagtgcagtggcgcaatcttgactcactgcagcctcagcctcctgaatagctggaattacaggcgcccacgaccacccctgactaattttttgtatttttaatagagatggggtttcaccatgttggccaggctggtctcgaactcctgatcttaggagatccacctgcctcatcgtctcaaagtgttgggattacaggcgtgagctactgtgcctggcctggagcagaacttaactcaccatcacgccttctctttatcccagtaaagaatcactgatttcataaaagctattgttagttttgatagggtcgtacttctcaaatgtgggaatggagctattattattgaatgtttactttttctaggctcactttaaatttttgggtgattatgtgaccattatgtgatgtaatagaatttgtcagccttcaacaaaatccttcaggaatgtcttaaagatggtaacaatcatacagtaaaattttgactttccagttggtttttcaccagttatatctaactttggtgttgaaaacactgttaaatttaaaaacaac

SEQ ID NO: 1612 - DNA, 2396 bp, Homo sapiens
tgcagttctcacttcgctactgaaatgtgaacatttgaaattacaggggtttggggcaaatgccagttttcagtcgtatttgactgttctgctttctggtttcagtaattcgccaaaatgacgaacacaaagggaaagaggagaggcacccgatatatgttctctaggccttttagaaaacatggtaagtaggtttaccttccttgagagaagcatggcacacatttgtgttctgttgtgttcaacatgtgttgtagttcatagaatgtgtatcaatagaattaaataactagcgtctacccagcttatttcgtgataaggtaaataaattaccaaaattatatggtgattttgtgactaagtattgatgcaagattaaactttggagagaggttgtgatttagtaggctgattgtgctgtcaggagaaattgtccattgggaagataataagcatgtaaccatcaaaaatgatatatgtgttaaaagctagtaaaattgcatttcttttactctagatttttagccttaatactcactataccaaatttatttttgtaggagttgttcctttggccacatatatgcgaatctataagaaaggtgatattgtagacatcaaggtaaacataaaattgggaaaataacactacagaagatagaaaagttggatttaatctagtgtaggaattcaaatactagtgtatgttgcatctgtaagagtatagaatggatttttttttttttttttttggagacggagtttcactcttgttgctcaggctggagtgcaatggcatgatctcacctcaacctccgcctccctcccggattcaagcagttctcctgcctcagcctcccaaatagctgggattacaggcgtgcaccatgatacctggctaattttgtatttttagtagagaagtggtttctccatgttggtcaggctggtcttgaacacctcgggtgatctgctggactcagcctcccaatgtgctgggattacaggcatgcaccatgattcctggctaattttgtatttttagtagagaaggggtttctccatgttggtcaggctggtcttgaacacctcgggtgatccgccggactcagcctcccaatgtgctgggattattacaggtgtgaaccaccgtgcccggcctagaatggattttttaaagtgctattcttagcagaatttaaattttcctcattacccgcttggagttaacagctagtggaaattgggtggtagggtgggaaattatgagtttatcaagttggaaaggaacgccttagtgcaaagtttaattattgatgaagattactattactatgattaaaaaccctcctagtgaaagctgtgttcttctgtgacctggatttaaatgtatcttggcactcgagcttaatgatgactgttttttttgattgcttgaagcaatgtgaaaaacacatttcaccggctctgaaagctcttgagttgccatttgaaagaaatcttagaatactttgcagttacttaaagtcagaattttaaaggaaggggaaatgctggtatataacattggtttctttaatagggaatgggtactgttcaaaaaggaatgccccacaagtgttaccatggcaaaactggaagagtctacaatgttacccagcatgctgttggcattgttgtaaacaaacaagttaagtaagtagtgttgtagttctttgtggctaaccagtattccctcatatacccccttttcactttgccagttggacttatgtctttattggtcattcaagtggggcaaaggaaatatccttttaaaactcaggcaaactgggtgtttgtctgtatcctgtcagaggaaacaaattgaaatagatttactggaaagtcttacacagttagttactaagcggtttgtttgttttgtttcgagacggagtcttgctctgtcgccctggctggagtgcagtggtgggatctctgctctctgcaagctccacctcctgggttcacgccattctcctgcctcagcctctggggtagctaggactacaggcgcccaccaccatgcccagctaaattttttgtattcttagtagagacagggtttcactgtgtcagccaggatggtctcaatctcctgacctcgtgatctgcctgcctcggcctcccaaagtgctgggattacaggcatgagccaccgcgcctggcccagcagtttttatagaataaaaagagaagtttagtaaacttttaaattttattagcagtctggttttagattactagagtttaagagaccatcatctcatcaaagagagttaaaagtagggatgttctctgcaaggcctcttctgatatgattaattgattgtaaattaagtaatcaaggcata

SEQ ID NO: 1613 - DNA, 2396 bp, Homo sapiens; identical to SEQ ID NO: 1612

SEQ ID NO: 1614 - DNA, 2396 bp, Homo sapiens; identical to SEQ ID NO: 1612

SEQ ID NO: 1615 - DNA, 2396 bp, Homo sapiens; identical to SEQ ID NO: 1612

SEQ ID NO: 1616 - DNA, 1190 bp, Homo sapiens
tcctgcttatttgggtcttacactcttgtccaaagaggcactgtatatgtctgtttttccactaccgtatcattgctgttcacatgtaatgtgttgtttgttcacaacaagcgcctggttacacattacactgacgaatgtgctgatgctccagccatggctttgatgcttctgtcatttttaacctcttctattaatatttactgcctgtgccattcttttccttgttggccattcacaaggcttggataatcgtgtgacattttgagagccatcagatgttacgtttctcaaaaaaaaaaaaaaaagacttgattatattaactatttgaatctatgatctgtttccttgagggatttttgctaatctgtatttcaatttcccaggtcctagaatttatgatttttttttttttaagaggttagtagctaacagtgagaggcagcctcattgtttttagtttctagttgggtggaactcagccctagtgttgtatacttattaatcccattttagtgctttgcacatatccattgttattcagtgtttttctctgggtccttccagtttattttcttccttagctgtactcttttaaaaaaaaaaaacaaaaaaaaacttttttttttttttttgtgataaagttaaaatataatgtaccctactttttttgtgcagtatgacacttacaagatggccagactagaggaagccagaggtgggcatggtaacactactgaaaagttggtggtgtgccatggacaagggaccgactgcagagtatgtttgctgaggaaaatagaggcgaggatagagcaggcaggggaagggaaataagacatggagataggaggttaaagcagttgggagtccatacacagcctacccaacttcctgagaactcttagagaggaaaaggcatccttaggcatccttcctgtgaagtttgcctattccgtgatcacgctgagaagatgggaactctgaagtttgcttcacaggaaggtaaaatccttaaagggaggcaccttgctgtgccactgttcagttttactataacatcaatctttttttagtttttattcccacctcaagaggctgagttgaatactattaggcggggaatggaaaattatataggcacctaagtttcctttctagttatggtcagtgtttacactgagtattc

SEQ ID NO: 1617 - DNA, 1207 bp, Homo sapiens
ttttctttgactttacctggcacattattttgttttgtgtatacctggaagacattagtacgtgaaatctaatctatgtggttagctaactggccaaccaattcatcccatagtgcttctttcatgcctaccgtaggcacagctcttgtcagccaggatacagaggcaacaagacacactggtctccaggcttctggaatatgtcccggctgagaaccgacatacaagtaaatacatacaagaagcaacatagacacagatattttcaagaagaaaataactcctaatggggtttgagagactattgagaatggggcagaattattccttagacattttgtcctgcttaatgagcatttattaagtacttgttgtgttaagcatctggcatacacagactgagaaaaacatagtacctgtccttaacagcagcaataacaatagttaggaaatcaagttccaagtgggttgacccgtggacctggctaaattatcagggaaaatgtcctgcggtgatgatgacattaaagtgttaataacagccagacgcggctgtagtcccagctactcgggaggctaaggcaggtggatcactggagtccaggagttccgggctgtagtgcgctctgccgatcaggtgactgcaccaagttcggcatcaatctgatgtcctccaggaagaccggagccaccagattgcccagggagcggtgaactggcccaggttggaaagagaacaggtcaaaactccactgctgatcagtagtgggattgtgcctatgaatagccactgcactccagcttggacaacctaggcagaacctatctcaaataataacaatataataattacctgtaattccagcactttgcgaggccgaggcaggtggattacttgaggtcaggagttcgagaccagcctggccaacatggtgaaaccctgtttctactaaaacaaacaaacaaacaaacaaacaaaaccaaaaacataaacttagctggatgtggtggcaaatgcctgtaatcccagctactcaggaggctgagataggcaaatcgctggaacccagggggtggaggttgtagtgagctgagattgcaccactgtgctccagcctgggtgacagagctagacaccaaaaaaaaaaaaaaaaaaaaaaaagcctaacaacatgaaaaacaaatctggctctaatgcttagagtga

SEQ ID NO: 1618 - DNA, 1233 bp, Homo sapiens
cgcgtccggaaccccaccgagagccgccggtccaaccgccgatagctcgcggatgcccccgggggcccgacgccggccaggcttcccctagcgctcccgctacccataagccctcgcgtctcagcgcgcacgcgcagcggcgacggccgtctcaggaagaggaaaatggaataaacaactcggaggaaccagagcgcgagagagcgagtggaggcagaatttaaaaataaaccggcccctccgccttccccacccgcttgccgctgccgctccctcttcccctgcccgcgccctcgaagtccccgtctgggcccgcgcgctcaccccgtcgtcccgcgcggcccctttaagaaaagagaacgagagagtgagtgagagaatcccaactctccccctaccctccctccttctaccccctcctccctcccctctcccctcccccttctccccgggcggctccggctcccgcagcgggacagacccacccgcccaggcttttatccggcaccggcagcgtcttcctttcctcccccgtctatggtggtggcggcggcggctcctcgggcggcggcggaagacgaggctgcggcgttgccatgaacagtggcggcggcctcccgcccccctcggccgccgcctccccttcctcctcctcgctggcggcggcggtggcggtggtggccccgccgggggtcgggggtgtccccggcggggcggcggtaggagtgaagctgaagtactgccgctactacgctaaggataagacttgcttctacggggaggagtgtcagttcctgcatgaggaccctgccgccggggctgccccgggcctcggcctccatagcaacagcgtccccctggctctggctggtgcacccgtggccggctttccgccgggagccgtcgcgggcgggggagctgggccgccccccgggcccaagaagccggacctgggggacccggggaccggagccgcagccggcggaggaggcagtagcgggggactcgatggaccgcggctggcaagtgagtgtttttcgggcggggcgggccgcggcggcggagggcaggcctgggccggatgaggccctgctgccgacgggagctgagcacggcccgcgggctccccccctcacctcccaaggcggtctgagaggcctaggccgggcctgagccctccttccttcttcctgcttcccctccccactgccttcggcaagtcggagagcgcgg

SEQ ID NO: 1619 - DNA, 1589 bp, Homo sapiens
ggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggatgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgagcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggttttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgagaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaag

SEQ ID NO: 1620 - DNA, 1143 bp, Homo sapiens
accatcatctctgcagccaaggggttcctagaaaagaggcttcctaagcagcattcctccagactgccagctgcaccccaggagtgcattatgaaatcaatttttcatgagttgtcatcaatgtttactttttttaatgaaacaaagtaggtagcattaaatattatcagagtgcctctcaggtggtaagggtaacactcgttttgcgaactttttattcggatatatatatttgatagaatacacctgtgtatattgggtaggatgtgaagtgcattcctctgtaggccctagaagccttctcgcacttagcactagtcgaccgtcacttctggctcagcatacactgtggtctggctgctgctgccagattccagtgcaccgtcggtgactcctgcaatgatgttatcaacatggagctccactacaaatacctggctaacagttgtcctcacatctcctctgttgtgtgtgctttgtggcaggtacttcaagcgtagcgagggcctggagcgccaccttcgacgagctgataggcagacccatcggggagttctcacggacacacatgactctgaacgcccccggcgtgctggctgaaaaccccgacatattcgcagtgatcataattctcatcttgacaggtaaagcccacacttaaaaagagatcgggtcagagtgatgggcaaaggtttggtgagaggctcctgttaagttcctttctttacttatctctttaaccataacccccatttctttttgttttgtttttgtactgcatgcaggcatctttatttgttcctgtcttcattgcttcttatagattcagatagggccggcctgcttcatagctgttgaattgtgtgccatttcattaaaagagaatcttaggtgtttagcctagctgtttgtggaataagattttgtctgcactgcaggctttttgtgtgagtgtcctgggaataaaagttcttttgactcagtggatgaccatttggaaagcaaaactgtcattcatcagccaggaaaatgtggaggaatgagctccgtctggaacactaatgtgtgcctggggcgtctgaagatgacttggatggtttttacacctaacaaccatcaaaacaccctttcagtaaataagtt

SEQ ID NO: 1621 - DNA, 1282 bp, Homo sapiens
cattgttattgccattcagggcctctgagttttaataatttaataatttaatttagtaatgaaattaagatatggtttggtttgctttctattacagcatacttgaactaacaccttgtttttcctggtgtattatctgatgactgagtgtaggaacaatgtcattaatgtgtgtttcctctactgcataatttccacccatggaagagtctccattaagaggacctgctacaaatgtggaagctcagagacctcgaaatgaagtcatctgtatctgttggcctgctgggttaattctgtatgtgctggtgaaactggagaagtctgcgtgcttctgacaattgatggtggaattctacgaattaaagcgttttagcaggaaatgattatgaaggacctgatcactgtctgtgtttccataatgtgataagattagagtaatgggtgaaatgaggagcaatcaggaaacatctttgttctttttcaacagctctgaacagcaacatggggtgcaaagtcctgctcaacattgggcagcagatgctgcggcggaaggtggtggactgtagccgggaggagacgcggctgtctcgctgcctgaacacttttgatctggtggccctcggggtgggcagcacactgggtgctggtgtctacgtcctggctggagctgtggcccgtgagaatgcaggccctgccattgtcatctccttcctgatcgctgcgctggcctcagtgctggctggcctgtgctatggcgagtttggtgctcgggtccccaagacgggctcagcttacctctacagctatgtcaccgttggagagctctgggccttcatcaccggctggaacttaatcctctcctacatcatcggtaggtcccaggggtccggagctcgtgccctctaccacttttctgtttgttcccacctccaaagtgtgggtggatgccccacagggaggtcattcttgttaacacgagaggcacagaattaataggatgtttctgattcatttagaggtatttagtttcttttagtaggtttttaaattactagagtaaatgcatcactgatagagaaaaattgggaaaataaagaaaagcatgaagaagaaagtagaaataccctgcctgacaacatggagaaactaattctctcattcattcattcattcttttaataaatgttcattgagtacctgctctgggctgggcattgtgctagatactagggatcccatgaaggcataagacactctgtgttcagaagtttactgtcta

SEQ ID NO: 1622 - DNA, 1145 bp, Homo sapiens
aagtgaatttcatttaaagctcgtcaaagctgtgtgaatcttggcagaaccccatagaaaccatagcataaaatttcttttaaaacaactatattattaaatgaagaatttggggtaaagcatattgctttaatggtcttaatactatttaaaaagatccttccacattaatattcaaaatgttttctagtagtggtggaaatcctctgcgtctaccagttcaaaggtaggctttcccagtcttttgggatctagcaaggatcagtttagtcttacctgcatgcaactgttcctgcaagaatgtagatttgaagtttttaataaagttgaccagttcatgtatttctgatgaattaaatagaggagaatggcatttgagtaatcagaaaatactaccttaaaataataaaaattatttagaaagtgatggcattataatgttttcaaagcgtaatgatgttaactaaattatccattactgactagtactttttttttatacctatccccagggaaggaagaatatgcaagatggtgcaagtgatggtgaaatgccaaaatttgatggtgctggttatgataaggatctggtggaagcccttgaaagagacattgtatccaggaatcctagcattcattggttagagtctttcaaattattgaattaaagtagaggagaacacaaattataggttgtcttggtgtgtgagttttctcttgttattcattaatctgattatgaccacatctataatatgaaagtatagaattgacgagacagttctgtcgaatgtaaccaaggacattttacatgttaatttgaagttgatgtgtaactgacaagttgttaattcaatgacatgtcctcattaataactaatgttttcactgatctttttatgcagtaagaattagaataatgttcttactatgagaataatttcataagtaaaaaaaaattaaaagaattagttttgaccataaatcaaagatccctgagtaaacattatgaaagtttgctgttctttcaaagggatgacatagcagatctggaagaagctaagaagttgctaagggaagctgttgttcttccaatgtggatgcctgactttttcaaagggattagaaggccatggaaggtgaga

SEQ ID NO: 1623 - DNA, 1180 bp, Homo sapiens
gactcctcacagaaactgaagactggctgtatgaagaaggagaggaccaagctaaacaagcatatgttgacaagttggaagaattaatggtaggtcgttttctcccccaaaaggtggtacttgtgttttaaactatagactttaaaataaaattatgataactattaatttattacattttattttagaaaattggcactccagttaaagttcggtttcaggaagctgaagaacggccaaaaatgtttgaagaactaggacagaggctgcagcattatgccaagatagcagctgacttcagaaataaggtgagtcagtctttttgtacatagggaggaagttaacctagattttaataagctaacacttaagctgggaatcatcatgaatagtcttaactttgaaattttggtatttgaggttagaggtagatttgaacttgagcttcctggaaagttgagtcaaatgagatactattgttcaataaattctacagaatgaccgtgttatttttgttcaggatgagaaatacaaccatattgatgagtctgaaatgaaaaaagtggagaagtctgttaatgaagtgatggaatggatgaataatgtcatgaatgctcaggctaaaaagagtcttgatcaggatccagttgtacgtgctcaggaaattaaaacaaaaatcaaggtgagtgttactgtctcgtgtttactgctgggttcacttacggactcaagttgcaatcatttgaaccttcaacatagccatttttcctgtaaatcttttacctcatcctaactgaaaccagcttttcttagtctattattctgtcacaaaatacagaagacctcataagtttgttgaatttccacttctccatttattcattcatttcaacaagtgtatttgttgagcacctgtcatgtaccagtccttgttctcaggattaaacaagtgtgcaaagtgtagtctctgcccttatggaactcatcttgtaatgggagggagaccaacagtaaacaagcctgtgtcatctatcagagatgttaagtgctatagggaaacaaagtaaggaaaaaggggttaggaaattctaggtcttgttgtatgtgaggctggaaggaaactgggaaaagtgttcttctggagtaatgttcaaacacagtgaaggtcaaggaaaagtga

SEQ ID NO: 1624 - DNA, 1499 bp, Homo sapiens
aaagatctcacacatataaagagagtatgtttaactttagtctttttgtgaatgggagaaataaggcatgcttagctgtttttattaatgatttttaaattactgattatttttgtttagggccttctctcagaactgttacataattgtgatggacaactgaaaggggaggtggcacaaatggcagcttactatgagcatcgtctacagctgggtagcaaagccatttatcacttggaagcgtttgtggccaaattcatggcactttataagaagttcatggaggatggattggaaggcatgatgttctgacttctgtcagttattcttgcaaagatttctcagtatcagtatttacatacagcttatattaaaagagctgtgggtaaattaactgaacttaatcatgtcgtatttgcgtttttttggtaataacttctctgtgaactattaatcatcctctgagttaaataattgctcctatactattgaagtatgtagttttgtacataacttagagactttagagtctaagaaaatgatcttaatttactttaagcattggttattcaagtattcattgttgatcctcctattctcttccgtctaatctctcacctgctaaaggagatttacacattagaaagcaaagattattttcatttatccagatgaccattttctgccacaggtaacatgattgtttgacacaccattatatttaattctagtttctctcaatgaataattgtatttttgtaggaaatgtaagatttcattctgaaacataattattggtatggacaaaattgcagataccatttctgttgaggctgcagatttccaacttttatttcagtggttcagattagtattaggtcggtactaagaaataagcatgttttcactaatttaagtacttgagactcttgaagaaaattcagaatgaagttctggagaaaggtatgttactgtagtaattactctttgaacaggttttgtgttttgtcattagctctgccctttttaattaaatattttggttcatggaccaaagggtttacttgacaaatttgtgtgacagactccgaacaattcctttactacgaagtataatttataaaataaaatatacccattttaagggtacagtttgatttttgaccagtgaaactatgatcccaatcaaggtatagatgccgtcaccccaaaaagttccctccatatccctttgcagtcagttcatccctaccctggcccagatgatcactgatcttgtcattatagatgagttttgccagttcaagaatttaatggaatcagatattgtaagcattcttgtgtaatacttcattctctctcattattgagattcatccatattgttgaatgtttcactagttaatgtttattgttcaatatttttgtatatacttttaaagcctattcacttgctgatggatctttggtttgtttccaggtttggttattatgaataa

SEQ ID NO: 1625 - DNA, 1408 bp, Homo sapiens
cctttacttaggtttattgacacagggagggggtcatccatctgcagctgggcccaaaaaatgccaggaatagccacaaaaggctggagaccatgactggcagtttgaatgtcatccttgctcctggctgtagtgtggctggtgcatagttgggggtgaggatattaacacgaaaactagtggattcagaacaagtgggatggcctggttcccaggggtcttcaggccacatggtcacttgcaggattgaatgaagaggtgatattgactagggctgatgccctgtgattctggggattttgaacatagggcttgaataacaactcaaattatagatggggttgtaaatgggaaagacaaccacaggaggaggtgaggcaggctgatgcaatgacgagaggccaggaaccagggtctgtggatagctggctctatcactcctagttggtattcacatccttttaaaatctgaaggtgctttaatctttcctggcccattctacaccaaggagagctttctaagccccaaggtgtcccaggctgccagagaaagtttagttccatgtgtctgtggtacacattaggaaaagtagagaaagtcacttgtgggactccttggttttccttcgggttagagctggagttatctctgaaggcttgatggaagctgatttcccaagatccaaaagctttctttgtcagggctggcaccagggctcagcgctttcttagacttctggttcagccctgacaaggttttgaaaatcaaattaaaaagagactaaatataacttgtagaaaacctaggaggaagtgtgcttacagacctaaactctaaaagatgcaatcaagtcctctgaaaaccagataattgactttaaaagacaagtgtagatgtattaggtggaagcatattagttcacttattctttttttcacttatttatttttatacaaacatcaccggttttctatgaatggaaggtggcaaattatctgtgtaagaagattcaggtataatcttccttctcaatgagtttctgttcttgatcagggttggcaaactatgcctggcaggtcaaatcctacctgctgactgtgtttgtaaattgagctttactggaaaacagccatgcccatttacttaccgctattatagctgttttcctgctataatgacaaagtagagtagttgtaataggtatggtatagcttgcaaggcctgaaacatttactgtttggccctatatataaaaagtttgcttcatcagcaagatgaacagataaagaaatgattatatatatatatgtaaatatatatacacaccatcatttattgatattatatatcaatgtgtgtgtatatatatatattatatatatatgtataccatcattgtgtgtatgt

SEQ ID NO: 1626 - DNA, 1175 bp, Homo sapiens
ggagatgatggcccttttctccagcctccaataaaaactcaagaacaacctgtgtggcattcttgcttgggccactccttgaaaatcatgagggacaggatttcactcctcccaaagtatcctcctaggcaaattcttagaaaggtttttttttcctatcacaatttaattcctatcagaatatctttgtaatttccagcccttggttgcagatctgttcgcagaagctacctagaagatatttcattcctttgtatggggagacattcaaatatttgaaatcacaaatctgctcttataaaaaattggctaagtaaattcttctttgactgtgtagaataaacatgcatacagttgtctttgaagtcgttagctcacattgaaaagaaaaagtttagaagaaattaaatatataattttgggggaaaatttatctataattttagctcatagtttacaattcctatatgactgtttggaaggtatttattttagaatggatggatgttccgtattaacctgtaggaagggtttgtgaatattctgttgctctgaattattagcggtctagatctaggctggactttgagaaatatgaaataaaaaaatacctctttggagtgtggtgttgctctttaaaaaaaaaaaaaaaaaaaagcccagtgaataaaaggaaaacccagtcatttctcctggaagcctttcaatagtgactcaatggcaatgttgtggttgaaattgttgctcctagataatgagaaaagttaaagccatcttctcaacagtgagtagaaaaatcttttaaattttagagatgtcataaatatagtcttaagaaaactattgggaaaacagtttcttgttttatttgcttatttcctaaggaacaaaaatgattgccattttacaactttatccctataaagttgtagccttcatgatgacataattcccaaagtcagctagaattccgagaatcaaagaagaaactgaaatctaattacagagaacaaatgcaacaggccagttatatttccagacgtttttggtttgcccagttccctaatttttcatacttctctttagtctgttcattttttgcttaaaaattgaatggaattttgatgcgacattttagaataaattttaaagaagcataaaactaaaaacctact

SEQ ID NO: 1627 - DNA, 1188 bp, Homo sapiens
tggaatcttgtcagattctaaggcatttttgttgaaatcattgaagatggaacattattaggctagtgagataaatttcttgacacttgctgcgatttttgttttagaagcttgctttttggtttagatatttttatttatatatcatcacattttctaaaacaaaatgttctactcaaaaaatgtttggaaaattatgtaaatatatgttaaaaaggtttagaaatttgaattctgaccgcctttttctctgtaaatatcctttttttataacaacatatatttttgtttttcataagtgaagagtaaattggtttacagtgatattgttctatattatatgcacactcaaattgtatgcattagattgtggagcattttctgatatttgtgctcacaagtaggttagtgtcatttgtcagtaataaggcttgcctgtgtagttggaaagtgccattgccctagagtgctgtattttgaagtcatctgtcatggatacattgtagagagagaagactatttatgtttatggcattttaagtaactgagttaaaaaccctttggaatatagagaagtggcttgtttactgtcatcactgttcacttaatcctacgaccttgacatgatagcattcccataaatctccctgtgggtagatcaataaaacagatgaacatcaaaatgtaatgattgtttcagctttaggaattaactatgtaatggaataaatataagccagtaagcagtattacagaaacattctattataccaacccctttttctaacagataacacttactagaacataaggagttattatatattatattttctgataatgtttgcagtatctaacagattattatatattaaaaaaagaaaatagatacaagtaatatgcatattatgactggatttttaaatagcagtttaaaatttttggtatacctatgattataaaaataatgaagttagggttttttttgcaatgatgttttaatatagctttattttacattgtgtttttattgtattatatctccattgttaattttctctagttcattcattttaattttataattataattcctcaaacataaatttttaactacagtacgttcctctttcccccaatgtaagcagctactcaggtattcaggaaaaaaaaaactgaggaaattgg

SEQ ID NO: 1628 - DNA, 1181 bp, Homo sapiens
aggaatagtatatgagaccttactgactggttcttgggagtgattgttaacatgggttgcaatccacttttatttttttatttttatttatttatttttttgagatgacatcttgctctgtcacccaggctggagttcagtggcgctaccttggctcactgcaacctctgcctcccaggttcaagcaattctcctgcctgagcctcccgagtagctgggattacaggtgcccaccaccatgcctggttaatttttgtatttttagtagagaaggggtttcactgtgttggccaggctagtcttgaactcccgacctcaaatgatctgcccacgtcgggcttccaaagtgctgggattacaggcgtgagccaccgcacccagctgcgatccacttttaaatggatttgtggaaaaagcacagattatcattaaactaagcggcatttaggtcacacatctcattcatctgatcagtgatctgacaacctgatgggagagtcacatctcctagggtttcaggaatcagtgggagaggcacgctatgaaagggcatgtgaaggaaggctgtgtttttgtgtctgcaggtgtgcacttgtactacgtcgggggagaggtgtatgccgagtgcgtgagtgacagcagcatctttgtgcagagccggaactgcaactatcaacacggcttccacccagctaccgtctgcaagatccccagcggctgcagcctcaaggtcttcaacaaccagctcttcgctcagctcctggcccagtcagttcaccacggctttgaagtcgtgtatgaactgaccaagatgtgtactatccggatgagttttgttaaggtaaggagtgcttgctatcacgttataaaatgttcagtgaaaaacaaaacaaaaaagcaccctgactgatgtggcaggcagttgtgcggtcaattctgatagacaaaaccaatttattattattattattttttgagacggagtttcactctgtcacacaggctggagtgcagtggcatgatcttggctcactgcaacctctgcctcccgggttcaagcgattttcctacctcagcctcccgggtagctgggactacaggcacgcaccaccacgcttggctgatttctgtatttttagtagagacagggtttcaccatattggccagagtggtcttgaac

SEQ ID NO: 1629 - DNA, 1179 bp, Homo sapiens
tctttcacatgtttctgaaagaagaggtgacctgccagcttcctttgagctgtgcttgctttagggccgacagtttttttatgttcatctgttcatgtcatgttttccctggccccttcatgaccaatacacatttataaatgctctagccatggaagatgaacaaggaccatgggctctacatctcaggtgtgctagtgaaatgagccggccccaaacagctcccatgagagctacaggttctaaaagattgcagagcggcatgcttggtcttgcagccgactttctggtgaaaagcattaactaagtttcctggtggaatcatgaactacacagcccaggtatgacagtagccatgtgttctctggtttgttttcttccagactttcgaccagtttgttacgaggagccccagcactggtgctcggtcgcctactatgaactgaacaaccgagttggggagacattccaggcttcctcccgaagtgtgctcatagatgggttcaccgacccttcaaataacaggaacagattctgtcttggacttctttctaatgtaaacagaaactcaacgatagaaaataccaggagacatataggaaagggtaagagcaaagatgttattcctttagtcatctagccgaaatgtagatggtcatgtgtgtagaagtgcacgtgaccaccctcacatgttggtcatgtgcccctgtggaaggaccccagggctggtgagctctgagatagctctgacattaccactggggaaagcacataggttgtcaggatcttagtccctcttcctctaatgtcatcatgccactttctaggggtggcatggagtggggattgtgaagacaagcaagatgataaatatgaagaaagccggatgaaattattaaatagaagtgttatgcattatttttcatttccctaaaacttacaaactaggatcatttctgaagaacaggaattctgactagatgattatttgtatcaggtgaagttccctttggagacttagcagctaggtagttagaaagaatgactgatttatgtctggaagcctttggcatgtgattggggctctcctgtgtgcaggctgattgggtacaagtcatactggtctcttttctgaccagtgatgcttttgaagcccatctcattggtctgagtgatggt

SEQ ID NO: 1630 - DNA, 1172 bp, Homo sapiens
gaccttttgaaaaatagaacttaaaagcgaggaacacagtaacttgccatggttagcacatctttgatgtcaactgactgtcccttgcagagagggatcttttatcattcattctctgtcctttttgcagcttacagttttccttctgagcttacacagaaggaagcttcctttaactgctttaaagatttctttttgacagttcgatggctgcatctttttagtagctcttcaataaatgaatacatttgatataaatcaaatgctgaagggttttttgtaaagtagaattttccccattgaatgattttagagctgtttgagaaagctctagctttttgcccctaagtatgtctgtcactcttaacatgttaagttgaattgattttaatttggctatattttcattgtgtgtgtatgtgtgtgtgcgtatgtatgtgttttttcctaggttacacttaaaagtacttcagattgtctgacagcaggaactgagagaagcagtccaaagatgtctttcaccaactcccttttagttttcttggttaaaaaaaaaaacaaaaaaaaaaaccctccttttttcctttcgtcagacttggcagcaaagacatttttcctgtacaggatgtttgcccaatgtgtgcaggttatgtgctgctgtagataaggactgtgccattggaaatttcattacaatgaagtgccaaactcactacaccatataattgcagaaaagattttcagatcctggtgtgctttcaagttttgtatataagcagtagatacagattgtatttgtgtgtgtttttggtttttctaaatatccaattggtccaaggaaagtttatactctttttgtaatactgtgatgggcctcatgtcttgataagttaaacttttgtttgtactacctgttttctgcggaactgacggatcacaaagaactgaatctccattctgcatctccattgaacagccttggacctgttcacgttgccacagaattcacatgagaaccaagtagcctgttatcaatctgctaaattaatggacttgttaaacttttggaaaaaaaaagattaaatgccagctttgtacaggtcttttctatttttttttgtttattttgttatttgcaaatttgtacaaacatttaaatggttctaatttcc

SEQ ID NO: 1631 - DNA, 1115 bp, Homo sapiens
ctctctgttttagctataaatataattcttcccctccttgtcccagaggtagccactaattccagagtttgtgtgttgaagggcacctttcctgccagaagcccgtaccctggctgtgctgatagatggggtccacaaattctttgtaggatcccctttttaaaaaaagctttacataaatgttatcatttaaggtaaacaccattctgtaacttgattttctttaataaaagtcagcatgatatttttgagatgtattgttcttacatgaccagatatggccccatacttaatagttaaatcaggaaattgaagccagacagcttgaaaaccttcttaatggaaaaaaatgcaagaagtgggtgggatagagtttctgttgaatttttgtatagaacattgtcatttgtgggaaactagttgatttgaattctgtgttattttgaatagcctaataacagcttaatgaggattaattgcatgttgtatggaaagttaattgttttaatttactatgggtgtagttactgcagtttggttcaaacaggtgaaagttaagatttgtagcataaaacaggaagcagatgggggctaattaaagttctgttgatgataaaaggatgactgatcaaggagcgagcagctggtttctcaatttaaacacaatttgtactattgtatgaagacagccctctgcaagttctcatgagtatctttcaaaggtgaaggcatgtgttccagcaacaagtgtgaaggctgttgtggccctgtttgtgctcgctccccttttttgccttcaagcagtgtcacttcaggtttttccaaaaaagggggttaagggatcacaaaacctggccagattttcagtgatgctctctggacacctgttgtgtcccagaaaagtctaaagctctttctgtctccaagaaaagtgcccaagcatttcatttccttttgtagtttttcttacttatctcaactccgtctcttggcaggctttccaatgttgttgccctgaccataacccaagaaggcccacatctagctagcggaagcgccgggtatttaagtgtgtaggcgaaggctaagcagtgctgtagatactttcctggagc

SEQ ID NO: 1632 - DNA, 1155 bp, Homo sapiens
ggctacgatgggcggggactgggagcgcaggtcccgggccgggttgcgggctgggaggactcggtcctccactgtcccagccggccacgcgcccgcgtgtcgcctcccgtcccgctagcagcacgctgcgtggctgctcgttggctgcttaagacggaagctcggttgatgtttctgcagaagttttcccccttggtcggtggcggagctgctgagcgcgatagtagcagctccggcggcagcaacattgactacgaggaatggcggcggctgccgcaggacctgcagcatcccagaggtgcgtgtttttccttccctttgctatttattttatacccctttccttggttagtgggccctgctgaagtcgttgttttcctgacaggtttttccagagcttctcagatgctctaatcgaccaggacccccaggcggcgttagaggtgggagagccttttctgcttcctccactcccggctgacccgcctccttccagcaccgcctgattaggactcaggctctagtgatgctgcgtctcagccccagtattgagattctcggtctcctttctctctctcacggtagccgcgttacctcagactcctgtcttgccctttccacttccagactcttgcattcctgaagcttctgagaaaaacttcctctatttattgggagcatggttggcatctgcagttgggctgaaaggatttttttttttaatgactagaagagaaaagtggactctgggctcgatgaaaattaattttttcttttgacaatcattgttgccattcttatgtaaaagtgtcggtatgaagtcagtctactggaacaaaaacctcttccctcacgtcccggaaactttccagatgtcttgtcatagttcattattcactcatttgtttatttatcaaaaaattttttaggagttgctgtgtgcaaaggcgctcattgctatgggttagtcttagttatatacttagctaacctagagatcactgcttgtaggtgtgcagtgaagacaaactataaagctgtaaaggaatgtaaaagagcaagagttgataagagttgaagaagagactaagctaaagataaatgatgctgtgggtcacagaattttaacaggagatcttttttgttttttgtttt

SEQ ID NO: 1633 - DNA, 1155 bp, Homo sapiens; identical to SEQ ID NO: 1632

SEQ ID NO: 1634 - DNA, 1138 bp, Homo sapiens
tttttatatctatatattatatataatttatatgtatattatacaatatagatataaagcaccataaacgaaattgaaaaaagaaagcagccaggtgcggtggctcacgcctgtaatcccagcactttgggaggccgaggcaggcagatcacgaggtcaggagatcaagaccatcctggctaacacggtgaaaccctgtctctaccaaaaatgcaaaaaattagccgggcgtggtggcaggcacctgtagtcccagctactcgggaggctgaggcaagagaatggcgttaacccaggaggcggagcttgcagtgagccgagatcgcgccactgcactccagcctgggcgatagagtaagactccgcctcaaaaaaaaaaaaaaaaaaaaaaaaaaagtgacgtactggaaaaatatctgcagcatgtgttggatgcaaaaggttaatttgcctttttacaaatagggaacgtcaataactttagtacttatttagctgctatttgatacagaaaaccaagagaaagtaataggaatattaattgtgctggagtgtagatctcttcccagccctaaagaacccgcatgacctacttacaggtgtcttatttttcaagatacaaaagagcaatgtaatttcctctgtggctattgtgaacaaccttaatcttgttctgttattatattgtgtcataattcaaattaaaaagtgtggaaggtaaataatatatttttaattctgaagctatccatagctttaaaggtaatggttaagaacaagtcaatgtaaaatgttccctagaagtgtacagttattttaggaagcctttgtatatttacattagcaagtatcaatttaaatattaaattataagccaactctacatagtataataggtaaaaaaatatttgagttgaattattaaaaactctgaaatgttggtcagttgcttagttttgctcaggtggactatttcaagttttcagtatcagtgacctaaatggttatataatttacttataaccacagatttaattttgggttatatcaaatcgattgataattgtttattataatagatatttatattctataaagatatctttatagttaactttcttatttaaccttgattgta

SEQ ID NO: 1635 - DNA, 1204 bp, Homo sapiens
atttgtaataatgatcatcagatctattaaatgaaaaaatagttgctgctctattgaaatatcaaaaacagtaaagaattaaattgagcaagctattagttggaggcttttaagtggcagttatatactttaagttactgatattttgagaaaaacatgcatgttttacacacacacacacacatatacacacacacacgcgcacacacacacacatatatatatatatatatttttttttttgggacagagtctcgctctgttgcccaggctgcagtgcagtggcgcaatcttggctcactgcaacctccgcctcctgggttcaagcgattctcctacctcagccccctgagtagttgggatcacagttgcgcaccaccatgcccagctaatttttttgtatttttgtagagatggggtttcaccatattggccaggctggtctcgaactactaacctcaagtgatctgcctgccttggcctcccaaagtgttgggattataggcgtgagccaccacatctggccatgttatattgacctctctttaattataggtgccagccgggaccaggctattaagtcaaccttgtgcgtcagaccgtttcatacagactttgagccataagcagctacaggctgaaatgatgcagtctcacatggttaaagatatatgtttaattggaggaaaggtaagaatgacagtctcactgcagacttttagtttcctggcttttggttattttgacttacctcttgaataattttttccatttgtagggttgtggaaaaacagtgatcgctaagaactttgccgataccttaggatacaacatagaacctattatgctctatcaggtacagtgttcatttttagctgcacttggactataagcatatatgcttaggccatcagcagaatttatggatatcttcttgttatgacctgtgtttttttatataggtaaagaaccaaaatagtaataaaattattcaaattaaagtgcaattataattctttggagcttttgaaagtacattctaggatatctgatgtgcacaacataccaggggctgtttttcaaagatatttattttccagaggcctggaagggtagggggaaaggaggagtgaagagaggttgattaatagttataaaaatacaggtaggtgggagaaataagacctactgtttgataaataag

SEQ ID NO: 1636 - DNA, 1127 bp, Homo sapiens
agtgatagtttcccccatcctttcattgacattatttgccaatgctgccagtcattctggcatgaaaggtgtgtgtgtgtgtgtgtgtgtgtgtgtgtgtgtgtgtgtgtgtaagggagtactttaaccttgccagtttgttccctcttttattttactgttttctttttagaaacccactgttaaaatttaaaaaggtgctttaaaataaaacgcctataaagattgtgcagtaagaatttttattgacaataattaaaattttttttgacaattttgggttcccaacttatcttacaagtgaaaacttaaattgtaaaacatgttgaaattttaaaaattaatgttaatatggaaatgcatttagagaagcccagtagtttttattgttggatttttgaaaaaacctctaccaagaatgtggtgttttttttgtttgtttgtttgtttgttttagaaaaattgggatttccccccaccccgccccacccagataaactatatctacactgtctcgtcaagttctctgacacgatctttctgggctctacatttcctactagtttgtgtccagaaactgcaagttgacatgaatagaggacaaaggttgtgtcttgcttttgtctctctcttccctccctgcaactctctctcccctcctcccactctcttccccctcccccctcctcccactgtctctcacctcccccaccccccactctctctcatctctcgctgtgtcctgtgtatgtgtgggtgtgtgtgtatttgggtgtgtaaatgttggttcttccactactggattttgtaatctaggataaatcactttttttggggactttgattttgctccattacgttttcattttttctgagcactgactgttctgaaagctgcacaaaacgtagaaagaagacatagcgcctgccagggaataggaaatgagggcacttacacattaatgtgaattagtaattgtggtatagaaatgttttatagtgaaagattcaaatttgcttttcaagaaaaatgccaaaagctatttaaataattcgaggttacatcgtaggttttgatttttctcaatttaagatacagaaatacagcaagccttaatataaagttt

SEQ ID NO: 1637 - DNA, 1186 bp, Homo sapiens
ttcttaccattgaccctatgaccctatgaaagaatgttaattgagggccatgatacatgttaaaagagcagttaactcttcttgagaaagaaaaattttaatgttcaattaatctgtatggagaacaacgaacataaagtctaatacataagagacctgcacgttgtgcacatgtaccctagaacttaaagtataataaaaaaaagaaataaaatgttcattggtatgtttttctgctgactggaggatgaaagaaaaaggacaagagtatgttttttataaggagattagagttagataatcaaggaggaagaagaaaacaggagacaccaaagaaaaagaaaatgtaaataattcgttctacctgctattactctacaaacttctattcattcaatatctatacctcatttgggtcccggtttcccttctcacttaacagcctcttaaaatctggtacattaagctccttctgatctaggtatgccgctttccctccctaaggcaccatctctccctagctgtgggttcaccccaagggagccctggtgtctctgaggcatctgagatccacagcactgtccttccagatctccacccgcctctctgataaactgcctgagcctttcacttctgacaaccttcttagcgcatgcttagacatgggctgagagaagccctggaaaatcttggtcttggagtgaaagctgtggtgatgcaaaggtatggcaactggaggctgttcatcacccatgctccttgcagcagagtctcttgaaggaaaatgggagccaggaatctccctgctgcctcatgcaccatctcccaataagtattggttcaacttcggtcgtgaggtttggagttaggcctgggtttgaatgttggctttgctaatagttagctatgagcccatgagacattaagtaagttctctccctctttgtttctttcacttacaaaatggagataataatacctctttcccagggttgttgtgaaaattcagtgagataataaagggagggctacacagcgcctgatatatcctaaccacctatatataaaccaaagatagttactttgggttccatgtcagcctcagcccctcttcctcagcttaaacaaaataactaattagccttttgaactgaagtgctaagtaaacaaaagaataattcaggaa

SEQ ID NO: 1638 - DNA, 1198 bp, Homo sapiens
aaccattagcagtcctctttgcccttacatcagagtatgttgcaaatcaaaccttttttttttctttcttttttttagatggagtcttgctctgtcgcacaggctggagtgcaatggcgtgatcttggctcactgcaacctccactgccagaattcaagcaattcacctgcctcagcctcctgagtagctgggattacagacgcacaccaccatgcccagctaattttgtatttttagtagagacagggtttcaccatgttgcccaggctggtcccgaactcctgacctcgggtgatccgcccacctcggcctcccaaagtgctgggattacaggcgtgagccaccacacctggcccacaccattttttatcagctttctaatgcatatcccctgttgctgatctctcttgtctattgtccacaagctgacagttttttgtttgtttgtttggtaattcatatcatgtctgtcctgacccacaacctcccaatgactgcctgttgtaattaaaatccaaactcctgctggatgtggtggtgcatgcctgtagtcccaggtactcaggaagctgaggcaagaggatcgcttgagtccaggagttctgggctgtagtgcgctatgcattctggtatccacactaagttcaacatcagtatggtgacctccgggagtgaaggaccaccagattgccctaaggaggggtgaaccagcccaggtcggaaacaaagcatgtgaaaactctggtgctgatcagcagtgggatcgcacctgtgaaaagccactgcacttcaacctggacaacacagtgagatctcgcctcttagggaaagggaacagaaaagggaaagggaaagagaagtccaaactccttattgtagcctgtactagcatttattgagcacttgctatatgccaaagactttgttaggtgttttgcatatattaactgatataatcttcacaacagtcctgtgaggttgaaactattattaacctcattttacaaagcaagagtgtaataggaaggttaagtaacttatccaaatcacacagctagtaagtggccaacctggaattcaaagcacagagtctgcctccaaagcaagagtctggcccctttataccatccaacttgatgtcgtcattttgcttttctttagccacactggcctttttattcctcaagcacatcaggc

SEQ ID NO: 1639 - DNA, 1226 bp, Homo sapiens
atttaaaggataagcatggatttatatgtaactggaataatttaaatatttacatttccatacagaaatgagtatactgaatttggggatcttggtaaaaacaaaacctatggcatttttagatttcaaattgaaaaggcaattggtaaatatcttatatcttctcagcaatttgatagtatatacctgaaaataagcagaagtaaatagagaattatcttcatccaaggaattaaataataggaatgttatacagacaccttttatacttaattctgcttttgaaggaatttaaaatggaaattgtttttaatttctattttattgaaccaaagaatttaaagtcccattcaaataaaataatacataatgttaaacttgtattattttttaatagccagcatttttgtggttttcaaatgaaccatccaaggaattatagtatttcttctctttttaagaaagtgtacttcttcaggttataaaagtagtaaatacttattgcagaacatttagaaaacaaacttaaaatgcatccagtctgatctcttccttcccatctttcatgttagtttcaccatttaaaaaaactgccttttttttttaattaaaggcaattttctaacatcgttttcaatttttttgctgtaaccattgcatctcactgcttcctattggattcattttccttcttactgaaataaattcttgagtagtttctcagtgaggatctataaataataaacataagcttttgtccaaaaatgcttatgttttacacttactcttcaattgtaatctaactagatatgttaggcaattttcttaaaaaactgcaatcttatattttgatatcttgctgatgagtttaaaaggtacagtgataacttttgcatcattaaaaatagttggcttagaaagctgtacttttccttccttaaaacagttttttaaatttactgtgctgatataccaagtgaattaattttctaaataagtaaatgattataagccttgctatacttaatataaaacaaaatatcctaagatagctacttaaatatacatgtactagtcagctattgttttataatatactatacatggtggcatatattttcaaaagcagtgttttgagttatattttattttctgagacatggtctctctctgttgcccaggctggagtgcagtggcacagtcacagctcactgtggcctcgacct

SEQ ID NO: 1640 - DNA, 1765 bp, Homo sapiens
actgcactctatcctgggtgacagagtgaggtgctgtctcaaaaaaatacagtagagtttaaatgctgaaggagatcagagaacaccattgatcttcctctagatatggcctcactttcacttcataatcatattttgctgtatacgtatggatcagtatcagtggttttcactttggtttactgataatgggcagctgatcattgaaaagcctagtgcagtactagcttagtaaatagagctgactgctgaactggtatgcaaattgttttactaataataaataacttggtgtcttctatggaaggaactgctggaagctgtacagaaacaaaggcattcattatcctagttttcataggcttctgtataaggaagaagaaaaacataaagctatactgaacaagattagagtcaacagtagacagaaattacttagaacagtataagatgacttaccaaaggggttattcagacagtatctgaggtttttgttggtagagcagggtgtgggtggtacatgccacagccttctgaaaaatgagctaccgctgatttggtaagggtgttctgcatccactgatagaccttgaacaatttactgttgttcttttggtttgcactaggatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaagcaactttgtctcagcttatttcacataaagagagcgaagtcttttgggatgaatgttaattaaactccctggtaactagaacagggactggcaaactagcctatctgaccacctgttttgtacactttaaggtggttggttgcctttttaaatggttgaggggaaaagaataccttgtgggatatggaatttaagttcgagtccagttttattggaacgtggctatgcttattcatttatggattgactgtggctgttgtcagtgcatgagcagagttgtgtctaacagactagagcctgcaagtttgccagcccctgatttaaaagatgaaggtacacagaatgtgggctggctggtgggcaaaggggtaaaaatgttctctatattgtatctgaaaagatggggtgtctgaataagaaaatgcatctatttgacagacctggagcagttgct

SEQ ID NO: 1641 - DNA, 1765 bp, Homo sapiens; identical to SEQ ID NO: 1640

SEQ ID NO: 1642 - DNA, 1229 bp, Homo sapiens
aggcccctcctctcatgaagcttacagttaggtgggagtagggggagaatggcggtaatgaactaaaaaatagcaggaagtgagcacctctgtgacgaaaactaaatgtttatggtgatgtgagaggtaatgatgggggaactaccttaagcagaaaggtggttaggaaagatatctttgaggaagtaatttataaatcaaggcatttatgacaggaaggagccagatgtgtcatcatctgggggaggagcatttcagaaagaggaaacataaaacagcattcctagggttagaaggagcctatagggttcaataacttgcagtgtggttggggcttatggatgctggatgaagataagtgagagaggtttacagggacagcatcatgtcaggccttgagggcaaggtaaggagtctggattttattccagatttgatgggaagcctttgggggatttcgattagggcaatgacatgatctgatttaggtttataaaagatctcttgaatacctcttgattataaatgggcaagagtaatcgcttctcggccttttggctaagatcaagtgtagtatctgttcttatcagttaatatctgatatgtcctctatccgaggacaatatattaaatggatttttggagcagggacatggactaggagcttgctccgtccactccatgcatcaacttggtattgctgtacccctaggaacggcgcacccctctgggtgttaaaacacggtgttactggccgggcacggtggatcccacctgtaatcccagcactttgggagtctgaggcaggtggatcacaaggtcaggagttcaagatcagcctggccaacatggtgaaaccccgtctctgttaaaaatacaaaaattagctgggtgtggtggcatgcacctgtaatcccagctacttgggaggctgaggcagagaactgcttgaacctgggaggcagaggttggagtgagccgagattgtgccactgcactccagcctgggcaagagtaacagcagagaaatctattgggaagctatggctgcacgtccaggtgtgagaagacggtaactcagactaagacagcagctatagctataaacttgctgatggaatgaagttggagagctaaggaaagataggatcagaaatgactcctaagtttcaggcttgggcaattggaagagggaaaagcagggaaggagcaggtttcaggagaagtga

SEQ ID NO: 1643 - DNA, 1196 bp, Homo sapiens
cttgtttccatagtttcctgactggaagtatctttttgatcaagatttcctttgaagtctattttaacaggattttcatgttagtattaaggtataatttcttagtgggagaatgggggctgtatctcctaaatgtctaattaaatttaaatttagtatatctgactaagaagggtgaggatggtggcttgaatgccctcttcccttttaaacctttcttcacttaagggacatgaaagagtgaggcttatccatccgaccaacactactctttccttctttccagtggatgtgggattggagaagaataagataaataagttacagtaaatttgttgctaacaatctgtgtaaattattgatttctttgtaagtgtatgaacactttcattaggttaaattgttgatattttaaagtttttgacctcagtggcagtttcatatggtttgacctattgcattatgaaactatggctataatcactgccctgtatataaaaatgttatggcacttaaacaaaaatacattataacttatttaaatagcataaatttgtgcgtgctttggcagcacatatactaaaattggaacgatgcagagaagattagcatggcccctgtgcaaggatgacacacaaattcatgaagcgttctgtatttttcagactctaaaccaacaaagataaaaaaagacaaagaagggcattacataatagtaaagggctgaatgcaacaagaagagctaactctcataaatatgtatgtgcccaatacaggagcacccagatttataaagcaagtttttagagacctacaaagaagcttagactcccacacagtaatagtgggagacttttaacaccccactgtcagtattagatcaacgagacaggaaattaacaaggatattaaggacttgaactcagctctggatcaagtggacttaacagacatctacagaactctccaccccaaagcataaattcataaacagtacatcactgatgaaatgtcaacatccaagccaaattggaatgttcatgaatacacctactttagcaacaggtaaagccaaaaatattgttactgcagatatgtatcattatacattaaagggttaaacaaccttctccagaatctaaattgcatatgagaatgataaaagccataatatagtaatttataatttaaaagct

SEQ ID NO: 1644 - DNA, 1216 bp, Homo sapiens
ctcaaccaaattagaggaggactgaggtaaagaactcttattttcagaaagtctattccacttaatgggctttcaaggaatatcttactctatgacacaaataaggcagactagagagcagttataaggttacttctttgttatatgaattctaagcaaggtgtttattccatgagagggtatctttatctcttgtgagcagacagaacagcattagtgttcagctgattactttgtaatagctgacagactgttttatctgttgtcaaattagtcttaactacactaaacattctttctgtaagcaagtggattggtttggttgtacacttgccatctttcgaacaaaacaacacatagctgccagaaaaaaggtagtcttcccatttcctgctcttgccatgtgttctatatatacatatatatgtatatatatgtatgtgtacatatgtgtgtgtgtgtgtgtatatatatatatatattttttttttttttttttttttttttttttttggtagagactgggtcttgctatgtttacgaagctggtttcgaactggaactcctagcctcaaataatcctcccacatcactgtcctagaatgctgagattatagacatgagccaccctgcccagccagctgatccttttttttaacctatctatgcttttgcttgcatagccacttaacatttctagttgatcatctttggtgaaaactacaaaaacaaaggagaaaagggcagattgaaagctccactctcctaaaaatgtaaacttatcacaagaaaatgccaggttttgtatgtaccattcacattttggtgataattaactctctgtagaaaattttggaaatctaattaattagtaccttcaatacctttagttgtctcccacacacgcgtgtgtgtgtgaaatcttctacaatatcttcccttttttagaccatgttcactgtcaaaaaggtgctttaagagcagtctttggctgggcacggtggctcacacctgtaatcccagcactttgggaggccgaggcaggcggatcacgaggtcaggagatcaagaccatcttggctaacaggatggtcttaagggacagtgaaaccctgtctcaactaaaaatacaaaaaattagctgggcgtggtggcacgcgcctgtaatcccagctactcaggaggctaaggcaggataatcacttgaacctgggag

SEQ ID NO: 1645 - DNA, 1170 bp, Homo sapiens
aacgtcttacagccagtgtctaaactccaaacaacggaatgtatcaatgagaccttgtatatggatacacgtgcatttaaaaccgccctgccggcttgtagagcttttgccgttctccagcgctttacaggggttatcgcacttaagcctcggaacaactttaccaggtaggaactattactgttctcgttttgaagaccaggaaacctaggctcagagacgttaagtaatttgcccaagacagcacaggtggcacagaagtggatgaatccacatctgtcagattcagcagccctggagttctctaccacgctgtacgattcaacctgagcccacacaggaggcgtggtctccttcttcaacggtgtgtgtgtgtgtgcgcgcgcgcctgcctagagttaatgattaagtttgctgaagcccttcttcccggtcctaagctgcctgttgcgaaggcgctttcattgaattcagtttctcttaccgtcttaacttgttcataaactttttgagataggaatgggcagtttttctgtgtcacttaggatgatttttttttttaatggcgtgataagtgaactgaatccagcaaagacgagtttctgttgtgcaacacgttggtatactgacagctaccacgtattgactgtgtactgtgtgctgggcactgtgctaaataaatgatttacgaattaatcgtgtttattgctcacaacagccttatgaagtaggtattatcttcactttacagatgaggacacctgaggttcagattaagaaatctgccccaaagtcttagaactggtaagtagaagcaccatatctaggcaaacctgtctaccttcaaaaaaaatgggcactctgataggacaattaacgataataaagttgtaatttttttttttttttgagacggagcctcgctctgtcgccaggctggagtgcagtggcgcgatctcggctcactgcagcctccgcctcccgggttcaagcaattctcctgcctcagcctcccgagtagctgggactacaggcaagtgccaccacgcccagctaatttttgtacttttaatagagacggggtttcaccatgttggccagaagggtctcgatctcttgacctcgcgatccgcccgcctcggcctcccaaagtgttgggattacaggcgt

SEQ ID NO: 1646 - DNA, 1220 bp, Homo sapiens
tatatctatatagatgtagatatatatctcacagtttctttatccactctttgattgatgggcatttgggttctttccacaattttgcaactgcaaattgtgttgctataaacatgcatgtgcaagtatcttttttgtataatgacttcttttcctctgtgtagatacccagtagggggattgctggatcaaatggaagttctacttttacttctttaaggcatctccacactgttttccatagtggctgtactagtttgcattcctaccagcatgtagacatgttccctgatcactgcatccatgccaacatctactgttttttgatttttttttattatggccattcttgcaggagtaaggtggtatcacattgtggttttgatttgcattttcctgatcattagtaatgttgagcattttttcatacatttgtttggccatttgtatatcttcttttgagaattggctattcatgtctttagctcacttttggatgggattgtttgttttatttcttactgatttgagttcgttgtagattctggatattagtcctctgtcagatgtatagattgtgaagattttctccaactctgtgggttgtctgtttactctgactgttccttttgccatgcaaaagctctttagtttaattaagtcccaactatttatctttgtttttattgcatttgcttttgggttcttggtcatgaaatgcttgcctaagccaatgtctaaaagggttttttcagtgttatcttctagaatttttatagtttcaggtcttagatttaagtccttaatccatcttgagttgatttttgtataatgtgagagatgaggaaccagtttcattctcctatatgtggctagccaattatcccagccccatttgttgaaaagagtatcttttccccattttatgtttttgtttgctttgttgaagatcaattggctataagtacttggatttatttctaggttctctattctattccattggtctatgtgcctatttttatgccagtaccatgctgttttggtgactatagccttatagtatagtttgaaatcaggtagtgtgatgcctccagatatgttccttttgcttagtcttgctttggctatgcgggctcttttttggttccatatgaattttagaatttttttttctaattcggtgaagaatgatggtgatattttggtggagattgtgt

SEQ ID NO: 1647 - DNA, 1195 bp, Homo sapiens
taaaaaaatttcagtgaatatatacatgcaggatagttgtcctgactaagagatcagaaagtaaatatagcaagggcagagaaaggaattgaggattaagtgctcagcttcctggaagccaaatcagaaagaaaaatgaactttttgttatttaattaaaacaaaaatccagatctgaaaacaaacttttctgggtgctaaatctcattaggtccttttaggagaatcattcaaaataacagtaaatggccttccattatgactttttgaaggtgcataaatgtttttcatgtggccaaggacaaagtcaagggtgactgatgcctttagtagctatacccattggtactctaggccagtggtgctgtcttgcttgctctcgaatggttttaatgcccatgattgctatttgtccaactttggaagaggaaataaataagaattggctttaaataaaatcttatagtcactggatgaaagcagccacttgggttgacccccaaggcaccccctctccctgccagttgtccatgtttccattatcctgtaggattcctcaaaacctgacccttcaccttgtacatcctcggaaactcaaaccctgcctgtctgtcagcccctctgcatcagtccctcctcagtggcctgtgctttgagatctctcttaactgaaacttaagacagcttcaaagttgcatacacctgccagatgtagtggcatacacctgtagtcccagtaacttgggaggctgaggcaggaagatcacttgcgcccaggagttccaggccgcagtgctctatgatcgcgtccgtgaatagccactgcactccagcctggacaacacagcaagaccatatctctttaaaaaaaaaaaaattgcatacactgtttatcttccacagcagtggcttccatttatttatttgaaattctagtttatggattttatggattcataatagctgtacatattttcacagtacttgtggccatctgatacactcatataaccaaatcagagtaactgagatgtccatcacatttactaagcacatatttgcacctgtcatggttcagacattgtgtgtatatcatctttaagctttgatgctaagaatcatttttcctgttttgtatattagtaaaacaatgatccaaagactggtctctgagccagggtttgcatttgtatcc

SEQ ID NO: 1648 - DNA, 1561 bp, Homo sapiens
acatgttattgctacagcctccagtatgttcgcattatctcaaactcagggaccccacaggacaggagacaccctttctgaaactgagttggaagtgaaagggtggtgatggttttggccaagcctgcgggagggaaagtattgtattgggagcacccttgggaccaggaagagggatgcccaggttcacactctgggacccctaagacattgtcagtgggtaaggtggagggccactgccagaggctgctgcagtgccctctgggaagtgccagggaccctcagctgcagacccaggggatcccaatcccttatctctgcctgaaaagtggctattgctgcttcgtatcctccagtgtcacaggaatgctgtgcctgagacatcccactttagtttttgttttccaaacctgtcactgactcttcattgtggtgacagatcctctggttcccccattgctcagcctcaggtttattttgagggtaactcagtgtctgactgcccaagtcttttaggggttagttggaccattgtgtaagcttgtttgtatgtctcacctctttctggttggtacttactgtctcacactgctctggcaaacttgtacacacacacacactctctctctctctcacctggctaaggcttttaaaattatgaagataaataatctgtttcaccagctggagtgagttgcaaggaagattgctggagctactcaatctagcgctaatggtttggattcattactgcaaacctacataatttaacatatttgtttactttagtgtgacaactgatgaaaaaaaatggagcaatctgaattgtataaaataacttaagaaggaagaaaagtgatatataaatatattttgcaaatgtcacattaatttaaaaatgagtatgattgattttatttttaaagtgggcattcttcactgtttcgagacctttgtatgtatttgtgtatttttatctttttttttcaggccattattataaggtgttattttggccctctaatgtagaagttatgtttaaatacaaccaatcaggccctaagtgcaaaaaagttctgtcttggtgcttatcactggtataattattatttttttgttttcctaactttgctcttaggagcatgagcctctttgtagctttatggtaatgcaatatttctggtcatttactgtcaaaaaatttttttacattgtgttagtgaagactgtgttttcagggttaaatgattggtatcaatgtatatagagtaaaattattgcaaaatttaaaaatgatttttcttggcattctttttaaatactctgaaacatatatgcaaatgagaaacctttaatcatactaaagccagttatgttaagaatttttcctttggattttataattaagagttgcttataaatacttatgacattgagctcttactgttttagttgtcttaaaacaatgggacatgtcatgaactggtttctttttttaaaaaattcttgatgtgaattccactgttacctgaccatgtatattcagatgaatgtactcttt

SEQ ID NO: 1649 - DNA, 1198 bp, Homo sapiens
ctccagcctggagagagagagagactaaaaaaaaaaaataataataataataaaaagaagtccaaatatgctgagatgccatgctgtgaggaagtgcaacccagccaggtacaaaagtcatggggcaagctggcgcagtgtctcacgcctgtaatcccacactttgggaggctgaggcaggtggatcacctgaggtcaggagtttgagaccagcctggacaacatggtgaaactcccgtctctactaaaaaaatacaaaaagtagccaggtgtggtgtcgtatgctaatctggaggctgctaatctccagctaatctggaggctgaggcaggaggatagcttgaacctgggaggcagaggttgtagtgagtcaagatcacgacactgtgcttcagcctgggcaacagagtgagacttcatctcaaaaaaaaaaaaaaaaaaaaaaaaaaaaaagcacggggcaaaggtgtggagagagattcagctagcccctgtttcttccagttactccagctgaggcatcagatgtgtgggtgaagaaaccaccagacgcggtggctcacgcctctaataccagcactttgggaggccgaggcgggcggatcacgaggtcaggagtttgagaccagcctggccaacatgctgaaaccccgtctctactaaaagtacaaaaaagaaaaaaaaaatagccgggcgtggtggcgcacgcctgtaatcctagctactcaggagactgaggcaggagaactggttgaacacgggaggcggaggttgcagtgagctaagatcgcgccactgcgctccagcctgggcgacagagggagagtcagtctcagaaaaacaacaacataaaaacagactgatcatctgtagtttttgcacaactgatcacgccctccactatcttgttcggcggtctcggcggtctggaatcctcctaggccagcgaaccttactgaacactggcgaggactccgcctctaggaatagaatcgcggggtaggtggggtcgtctggaggtagctggctccgcccggcccgcgggcgagtccggaatacagttacccacctcagttgcccaccggaaagcaaagggagaggaacccgccagaccagaaacggaagagagcgcgggggatgtgtttggcgtggggcgcactgttcagttgctctcctggatggctttatgtctccgcgg

SEQ ID NO: 1650 - DNA, 1346 bp, Homo sapiens
catattttaggtatgttagattcatgacataattccttttattagttttcttctaaaaattatctccatttctactcctgaattttaactttgaatgacccattctattctttcctgtataactgaacttaaccatattccctcagggatgttctgggatcatgtgcaaacatgcagtaaccattatacttctccaaagttcattctgacctccaccttgcccacttcaagtctttttttgttcttgccttgcctgtactagttccgcccttcttataccacaaaccagctcctgttctctctttagtcacatttaactattcagtttgaatttgctgttttgacttcagcattgccaccctttttgcctattgagttagtagttgagggcactgagtgagatataatatgctttggttctccctttttgtgttgcacttggaggaaaagacatgtactgaggtaatgtgtcatttaggcaaaataaatccttaaaagagtattacttttgtgaattcttcattattcacattgatggggatcttggaggctcacaaacttgattggtcaacatacaaagactcagttttcatttcatgagcaggtatacaatctgttttaatggagactgatgtttaaaaatccaaatgtcactttagtaatttacaatcagaaatattattcttaagaagactcttgtagtctcttctctccttataggctagtctacacaggaagccaaatgatagagagttgcttacttggtttgttggatgatccactgtggagataatggggcgtatatttagactaagatcctgccactgtgcgtgcacccagcatcatgtgctttctttaatgtgataaactagaagctccacgaaggcagagaaatcttgctgcagcaaaaactagataattgtgtttatgtgtctgaatactccctttcctggggagttgcagtggtattttgcagcactttaggtctctggacatgtttgcaggtaccatgcagactgcctcctcctgtaacacatattcacttctcttagagtactctgaaattgataaagtcatactttcttatggcaactaaaataaatttgttttattttgaggtcataaattaattttattctgatattggtgcaactgtgtgtgcgtgtaatctcctgggtcattttactgggaggctcatattatctcatattttgattttccttaatttaatctgaagttaattataatttaagatttgggaatatcttatagttggcaaaatgtatctctcctaaagtatacttcttgtctggttatgttttagagaagttagatgagaactagtg

SEQ ID NO: 1651 - DNA, 1207 bp, Homo sapiens
ttctatggggtagacactgagcttgttcctttatctgacaatgaacactgcagtaacatgtatatagtgtttctctccagggaagccctctgaagactaatacccaaggcctttattgggctgcccgcaaaggtaccagaatttcagatccctcccagaaaacagatgtccaccataaatcatattgtttatatgaataatccatgcagtgaattacatttttagttagggagtggtccaagtgcaaagtccctagctgccagcctagggctaaccttgtaagctggcctttctaaagatagctgcctcagatctgctatgtaacttttaggcttagctttttatgttgaaaaggaatgtttttaatttttgctttttaaattggggagtaagaatattaagaaatgacattgaaatccagcatgtaagttttacgttcaaatactggaattattcagaaaaatatttaatgatagaccagtcttaaattactgatcactatccattagtaaaaatttaaaaacaaattatatttttatttcttttaagattttgtataatataaaatgattcaccaagtagatattatcttgcatttacttaagtaaatagggattttatgtgtgtgtgtgtgtgtgtgtatttatgtgtgcatatgtatgtgtgcgtgggtaggtagatgctttgaaaattatttttaaagttttacaggctaaaagttttcctgtattattattttttgttgttcaatataacagcattcttggacccagtcatcgtcctagcaatcctgatacaatggcatctgaataataaagttgtctttatagtgtgaatttagggcatttaaagatttggtagatcattttcatcttgctaaaaatacatcaaaataacatttgtatatttaaggacacatactatatatatgtatggcactttagaaattatgtaaactttgagcgtgtagtctttttttagcctgacaacaactttgtgagataggattggtggtgtttttccattttatagaggagtaaattaactgggtttagagaattagtgacagtgtcctagatcatatgattctttaattaccgttgggatggatcaaagtttaggatttttgtctagtgctcatttactttacagtgatggctcattttcacttgaattaaatttcataattattgatgaaaaccagaaa

SEQ ID NO: 1652 - DNA, 1170 bp, Homo sapiens
tctaagctcttttacttacattaattcatttaagtataggagctgcttatggatactgcagccatttcaggatagctctttctgtctgttgagagtagaaagtattatggataattcgtgtttgacagtaagaactatagcatataaattatatctactttgttttactaatttcattatgtatttaaaatgcgagtgagatggaaagcctttccttttggtctacttatataaacctttaagagtttaatgtggtcagtctaattctcttctttagcctctgtatccactgggatatgtggaaagagcatgaattttagagtccacataccttgggaaagatatagaatattttttaactttagttttgttttcttctatggaaaatacctataaaaacatgtaacctcacaggattattgtgaggaacataataattattcagtaaacattttgttaggtcattgaatgtttgaaatgcttggcacacaggttgttaattaatgctggttccatttctcttgttttcctttaaggctttggaaagaacagtctcttttattgttcacctcctgaaagtaatgcttgttgccccttaattgcagcagcagccactgattgaaatttccagatcaggagttgagtatccattccaaattacctctctaggaagtaaacccaaactgcttctttgcactacccttttctttagactaattccttttccttttattttttctgttaaaattttcttttctgtttcaatgtgtattagtccgttttcacactgctgtcaacataaagatactacctgagactgcgtaatttattttaagaagaggtttaattgactcacagttctgcatagctggagaggcctcaggaaacttacaatatggtaaaaggtgaaggagaaacaagcaccttcttcatgaggcagcaggaaagacagtgaatgaggaactgcaaacacttttaaaaccatcagttcccctgagaactcacttgctatcatgagaacagcatgggggaaactgtccccatgattcagtcatgtcccgccaggtctctccctcgacatgtggggattacgatttgagatgagatttgagtggggacacagagccaaaccatatctttccaccctggcttctcccaaatctcatatcc

SEQ ID NO: 1653 - DNA, 1187 bp, Homo sapiens
tctgttactcccaaatgtttctacctttagtttatcttaacttctctcagattatcttaatttctctctcctgcccagttgtgattctgggagatatgacaaatggtaatagcctgtcctagaaagactgttggccagtagcggactcggtcaacctcctccagtttgctcttggttggagaaataattatgtcacatatttagaccaaccaataaatagcctgtgattattttgaggtcactattttatttctgtacaagctataaaactgtccaactgagctcttgaagctatggtcagggattatagatgccttgttattccaccaataagcaccagtctctgaaatcctttatcttggctaaatcctgaagactgaacgctgagcccagtaattattacaaacaaatgattttgttttttgaattaaaactttgtactgatgttcacagtccaaagccaccaccaggtgagacctacctcttttgacacatttagtattcagctataatagatagtcctttgtttggctggtctgagtgcaatagtgtttatagctaattggtcccaaccagttacagattttcttgttcctgctccactcccactgcttcacttgaccagccttaagaaatttgttgtaaaaagtaaattaaataaaatagccctttgtttaaacataataaatctcttcctttttatatgacaggtggttgggattattttagattttgatattcttctaataggaatctcaagcctgcatggtctggaaaggaggaagtagatgcaattcctagatttggatctattcccttgacattcagacctaaagaagatttaccagctgcagtgatgagcaggagctggggtagaagctgggagctgagtgaaagtggtgggttttagtgaatttccaagctttgaatttaatggagctctagagtatattagaattgtttgtgtcagtcaccagcatgccaaaaccattcttaggaattgcccaacagaccctggctgctagtgacttgctctttgcaaaacaaaaaaatcaaacacccaaactgcagagaatccagggttgcaatggagcaggtgctgggtggtggtaatgctttgtgtctctgggcctcgactctgagtctgttttcttgaattctagggcacttaatccctttgctgtcta

SEQ ID NO: 1654 - DNA, 1176 bp, Homo sapiens
ggtccatacagtgttgttctggattcctatcgtaacttaaagggaaactatcacaatgtctggagcccttgatgtcctgcaaatgaaggaggatgatgtccttacgttccttgcagcaggaacccacttaggtggcaccaatcttgacttccagatggaacagtacatctataaaaggaaaagtgatggcatctacatcataaatctgaagaggacctgggagaagcttccgctggcagctcatgccattgttgccattgaaaaccctgtagatgtcagtgtcatatcctccaggaatactggccagagggccatgctgaagtttgctgctgccactggagcaaactccaattgctggccacttcattcctggaagcttcactaaccagatccaggcagccttccaggagccatggcttcttgtggttactgaccccagggctgaccgccagcctctcacagaggcatcttatgttaacctacctaccattgctctgtgtaacacagattctcccctgcgctatgtggacattgacatcccatgcaacaacaagggagctcactcagtgggtttaatgtggtggatgctggctcgggaaattctgcacatgtgtggcaccatttcccatgaacacccatggaggtcatgcctgatctctacttctacagagatcctgaagagattgaaaaagaagagcaggctgttgctgaaaaggctgtgactgaggaggaatttcagggtgaatgtactgctccagctcctgagttcactgctacttagcctgagattgcagactggtctgaaagcgtgcaggtgacctctgtgcctactgaagattggagtgctcagcctgccacggaagaccgctctgcagctcccactgctcaggccactgaatgggtaggagcaaccactgaaaggtcttaagctgttgttcttgcacaggctcttaagcaacatggaaataaataaggttgatggaaaataaacaacagtttcaaaaaaaaaagaaatgttgagcacctttacaaatacctattggtcatttgcgtgtcttccttggagaaatatttgtttagttccttcacccattttttaattgggttatttgttattgagtcatagggattccttatacacgcaaatattaacctcttatcagacacggtttgcaa

SEQ ID NO: 1655 - DNA, 1147 bp, Homo sapiens
aaaattactttctactttcttttttatatgcttcataaaaaatgtgactgttccagaatttccctttaataactttttcttctttggcagattaatttagaccatgttgacattttgtaaataaagttttcttgggaatatgaacaaaattaaaacaccaacaaattaaagcaaatgaaaaagaaagatgggaaaaagtgaaatagtattctgatttaggactgcagtatttagaacactgaaggatttaagtgtcatttctaagatttttaattttaatttttattttgtgtgctttcattaagaaagaggcagccaggctcagtggctcacgtctgtaatcccagcacttagggaggcagaggtgggcagatcacctgaggtcgggagttcgagaccagcctgaccaacatggagaaaccctgtctctcctgaaaaatacaaaattagccgggcatggtggcgggcacctgtaatcccagctactcgggaggctgaggcaggagaatcgcttgaacctgggaggcagaggttgcggtgagccgagatccctacattgcactcaagcctagacaaaaagagtaaaactctgtttcaaaaaaaaaaaaaaattaaaaaaaaaaagagacatcaccaatgtcagcctgctatgctttcatgaaggttttgctaagtgatgtcttgatttctgtattcaagtgattgggagaaaatcttacacacagagtaattaacagtaaaaataatgtaataacatggcatagcattatgatatgtgtatcaaatgagtggggcagtcattgagggctgaaaagttctgaagttctaatcatcacagctgtagccatcagggaaggtttcttgcagaaagttgaagaaacaagttgctttcaatgatttcaaatgagcaatctggaaattttctagttttacatcttcagcttttctctgaagttgactaaactatgttagaggttacacatcacaaaaaagttaatgctgccatgtagattagaatcataagtctgtacaacatgcaaagtaagagatgttctttaatgaaagataaacctccaacttttcctttaagcctgcctttcttcattccccacctatctctgtaccaaataaacattttatcattttt

SEQ ID NO: 1656 - DNA, 1141 bp, Homo sapiens
cacttgccggcttggtgaacagagacaccgaagatactttaaatttggtctttcatttttaaagtacgatcattttctgtatttcaatcactgtgccttctcagacattctacttttgttctttcctatatgttttgaacccagaaaccaggacttctgtcaagctaagcattatatcgaaaaaagaccttaaacagccatgttctaaagaagaatgaggaaatggaggctcattaggagcataaactggattagaaaggggatgttaggctgggcccggggttcaggcctacaatcccagcacttggagagcctgaggcaggaggattgcttgaagctaggagttccagaccagcctgggcaacatagcaaggtttagtctctaccaaaaatcaaaacaatttggctgtgtgtggtggcctgtgcctgtagtcccagctactggggtggttgaggcaggaggatcacttgaacctgggagatccaggtttgtggtgagctatgattgtaccactgcattcaagcctgggcaacagaaagagaccctgtctgaaagaaaaaaaagaaagaaggaaagagagagaaaggaagaaaaaaagaaggaaggaaggaagaagggagggagggagggaggcagggagcgagttagtttagtgccctgtagacctcagcaaactgctttagaacagggtgtgtgagccagctcactactattttgcttactttcaactttcaaacattagtccaaagattttaggttgccagaagtttgactattgcacatgaatggcgttaccttcatatattcagtatgatttctctttttatgtaaaatttttctagatgcagaagtttagattttagggaatacagagtaatgccttcatatactggggaacatatctttactgtcttaaaacattaactggaaatctaatgatcctaaatacattttataattctcaagaagtatataacatctttctcccacaacagtctaccgaatgctttagtgtatttggggaatatgactaaatatgatcatatagacttttaaatttgcaggactttatttatgtacttttgtattctgagaagtaacatttgaaaacgataaaaagatgtaaatatatcttcaagg

SEQ ID NO: 1657 - DNA, 1110 bp, Homo sapiens
ccgcccgcctcggcctcccaaagtgctgggattacaggcgtgagccaccgcgcccggcctctgagcttattttaagacctgacaaaaatgttaaccttcttttatgttgacatagtctgtagttcaaggttatgcatgttgagcattcagtattatacctgtcacgtgaaattttgcttatatcatttattgagttttaattacttgggaaattgttaaactgttttcctaaaaaaggacttgaaaaatcactcaaatcagtgttccaaaaacagttcatatattccttatcactctactcttcaatacctttttcaattattttaaattctgaaatgcccagttgtctttctttttataaatggctttaaatgctattaccaccttgtttgaaaatgtgttatttcacagtctgcatctatatgtaagaaaaagtgcttcaccaagttaagaaacagtgttattttaggcaatggtaataatgaataacactgtgcttgacgcctggctctcgctcagctactccccccgcccacccccttttttaagaacaacatgaatactttcaaacccacacctagaaaacagtctgtggtggtttttacttgggcagctttgtttgctccaaggaatatttggacattagcataaaggttgcacatgttatacaaagtgtaattaaagaagctttgatccccaaatgtcaactagcttgctaagtgtcataacaaagtgtcaagcatctggtatacagttaatttgtagtcattaactccatattgttgatgtgacagtttgttagcaaagcaagcttgacggttgcattttgttcttgattgacacctacagacctccccacccgtttagtttacattcctgttgaggtttcctcaggttgcatttttactgcttaatttcccccaacttgttagttgaagtgctggcaaacttttaaaatcatatgctatgttagtacagaatttcaaactccttctctaaaatgttctaagtttgcaataatgctggaaatgaaaaaaagcttcatgatctttcttcagaatttaaagatttcttcaagtaatgtgacaacacatgcattatcctgatgca

SEQ ID NO: 1658 - DNA, 1180 bp, Homo sapiens
ccgtgcgccggagtgaaccttccccagataactctggatttgtttggtttgccgccaggagtcagtgtgctgttctcgctttgtgtacataagcgcatctcttgcccaaatacaattcagtttcttcttgggcataaacaccgtcaattttgagaagaatgagctccctttggttctggagacccactccgcttataactagcaaaaaaaaatggccttcgaccacagccttccagacgtattttcttttagaagtcctgttcccagcaggccccataggctccaagacggcgggaaaagactgaaaaatgttaacgagttcgttatcatcatagggactcttatcacacaacaagcagtaccgataaggtcataatttgcttataagataaaatttaaaattgtagtgttaatttattaatctaatttatatcttcagatagtggtcctcagtggggagaaagtaatacataaggatactggattatggtctattataattccagtcctttcttgacaaattctagttcactctccatacttatttcacaattccatctcgttaatactgtcagagtaagctattttgattatggcttgtaaagcctactgtaggcagtttgtaataaagtttctttccagtttttaaactgatatgtaactatggcaagtttgggagtaggaacttttcctttacatgctgtaatctagaatcagcttcatcatcccatgtcaatgacccacttgtataagttcttccatccagttagtttgccattttttgatgtctttagattattattatttatttttcacagcaaaaaagtattatagtttggtatttggcatcctcatattccatatgaataacttgtttttcatattggcacactttcatgatgtgcaaattccttagtggggtagttcttaactttgcccatctgtgttcattcactttatttataataacatttttagaaaattgacatataacaattgcacatatttatgggatacataatgatgttgtgatacatgtgatcagatcagggtaattaccatatccatcatctcaaacatttatcatttcttggtgttgggaacactaaataatcttccttctagctatttgaacctatatcacatattattaactataggtaccctacagtgctataga

SEQ ID NO: 1659 - DNA, 1174 bp, Homo sapiens
ataaatcttgaatggttatttaataaattattagatgggtgatgtgtttcaaaagatacttgctattttttgaagaaataaggatttccagtcattaaacaaaactaaacaatcttattagatgggtgatgtgtttcaaaggatacttgctattttttgaagaaataaggatttccagtcattaaacaaaactaaacaatcaaatgttctatattaggaatctcaagtatggctttttttaaaaaacctttttaacatcttgatgtcaaggattataagtatggcttttcagaattgttttgtttgtcattattcttgcctttaaaattttaactcatcaaagtgaagattagaaataaattttagaaaatgtagaatagtattgattctgttcctgtaatagaatctcagtggagtttttttgcaaaactaatatggatttcatctgattttattatttcttaaattttagattttattgagtaccatttatatgattgtacaagcattcactctttactagcattttttgtttttcagacaagctgaagtggttttattaagatttggtaatatttaaatagcaaccttctctgcctttttttttttttaatatagaattttgaccattttgactttttaaatgcctggcatctttaccaaccaagtaaactggaagatctgttactggtagaacaggttgaggagacagtaggaatttgtaaaaagtcatttgatttataatcaacactacaaatactatgtgttatttataaaatcataaagaacacttttgtcagactccaaaatttgtatatacttccaggccataagagttgatagtattatttatgactttgtagattaagttatttatgtatgaaacaaagcaggaaaatatattgagaagggatcgtgtttacagaggacttctttaaagtgtcacatttttaaaatgtaaacatatttttaatgcatacttaagtaatatttaagaaactaaacaaaataatgatacaattgcagtgttgtgcttgttgtcaatgacaaaaataaaaccattttggtggtattggcctgtacttttgttttaatatatgcttttgttaattcaacttgtgtttctataggacaaaagatacagaacataaaatttaccattttaacctttttt

SEQ ID NO: 1660 - DNA, 1153 bp, Homo sapiens
cctgactgctcccattcaccaggggcgagcgggcaggcaagtcaggagctgggaaaagaaacctctccattcagacaggaggaaaggccagggaccacaaagagcgtacctaccggtgcgtacaaaacgaagcccccagtaccgactccagggagctccgggggccaggccagcttccacgacaggcatagactctttaactccccgcttccgcgctgtcttgggccaaccagggcacggggcttgtgagcgactagccaatcgtgtcgtcccgccatccgcgaaccagccaatcgcacggaggccgcgtaggaaattcgaatggcaactcctcgctccacgttccgcgcagaggaacgtggctccaaattcaaatcaacgcagcctcacgccggcggcgagcgcgaggggcggagcctgcccggcgtgggccgagacgcgctgtgtgattgcctcggagagaggaaggcgctccagttccgggtcaggcccttctcccgcctccctcggccttagccatggcgagtagcagcggtgctggggcggcggcggcggccgcggcggcgaatctgaatgcggtgcgggagaccatggacggtgagtttccgttgcgctccctttaccttgcgtgccttcccagagccaaggcccccaggcgggaatgagcctggggaggacttcaggtccccttagtgccccaaacggcatcttccaagatctttggtagggacctgccagggccgcagggctgatggccctatcccttgagagttgtctccgccgctgcgtagtttgtcgcgcgcgctaggcgttgcggcccctagtcagccggttgcgcaccgcgtccctctcgcgcgaatgccgcgccccctctatcccgcatcccaggtccgccctacccgcccgatctcctgcggtgacagcgtcacgcccaccccacccagtacacccgttccctcctgcgtgccgcgtcccacccgattcccgcccggggcgcttcgggggtccccaaggttgggatcccggcggggacaggggccaggtgtttggtcaccgctatgcctcctgttcttcgcacttaagtaggcacctttaatatccggcgaatgaacaagttcccctttggtcataattatcctagtttcctcttgaa

SEQ ID NO: 1661 - DNA, 1226 bp, Homo sapiens
aaaaccaaacccctcatgttctcacttataagtgggagctaaatgatgagagcatgtggacatatagaggggaacagcacacactggggcctggtggagggtgagaggagggagatcaggaaaaataactgatggattctagacttaatacctggatgattaaataatctgtacaacaaaccccagtgacacaagttacctgtgtaacctgcatttgtacccctgaacttaaaataaaagttaaagaaaaaattctgagacaaaataattttaaattgtaaaaaaaaatatgtcttaccaatttactgatggaaggcaaggattctttcctgtaatggaataaagaagtggtcctagaaagctaactgctgagtccttggcaagtatatgctttgtgcttggacccaaaattttatattaaatcttgtagctgagaagtttatataacagtaattgcagattgtatcaaagtgaaaaaaaaattcatttggaaaaaatgttatattgtcagtgttttatttcagagttaatatttttgactgtttagaactgtgaactatcctcatctattttacagtaaaagttgattctaaaattattgccatgataaacttgttataattgaagagaaaaactttggacaatttttagatgtatgttgaattaaatacttcttaatttgtattaagggacaaagtttatcaaatttatattgttaaaagcaatttaatatcaatgtaagtcttttgaaataaagtatcattgcattcaaactttgaatggaaaagagggaggtaagcctaacagctaactgctgaatttcagaatactgcctaaatgttactaaatgttacaagataccactagtattaattataaagtgagcttaacatttgccagttttcaatgaagggagattatttatttgaaaggttattttttaaaatgttcaataagcttaagtaatagcatggttatttttcttctttatctttgtatagaatagataaagatgtggaagacaaaagacaaaaagccattgaagaggtaacttaaactgttactgatcattaaatcagttaaggatcaattctgcatgtacatcacttcttttaggaagactttcttcaattccttcactgtcctatctcccctccaagcccttcacagtcccatctatataaagcacccttctgtactgtcctaagaccaataatttccagcta

SEQ ID NO: 1662 - DNA, 1148 bp, Homo sapiens
tgttcagtgtcattggtcagtcctttctgttgtcttaagaaaatgcgaagaaagtgtcataaggaaatatgaacttcttttcatctatcttaaatgaactataatgttcaaggtgactcatagtctctatgactgattttaactctcaaactccagtttcattgccatattcttgtcataactaattatatctttttcagtaaattcatgaagataataattgagattattcactctttaaagcctttatctgctaaataaggcagtcttgtttctttaaaattcagataaagaaggaatttcttttctttttttttttaactgtggttacacactttatttttaacttgaaataaattaatgcaactgtgcatttaaaaccttgagcctcccttagctaagtcagctctaacaaggtagtcgaatgagccttctgggttgcttgaagttttgttataaatttcatataaaagatgagtattcagactacttaaaaatagtcaatgtattgtaaatggtaaaaaaaaaaaaagcaaaatatttgaggtgaagcattttctataaacagtgcaggggctgttggttctgatcatagatatattttcaagattatatttttccccaatcagcattatactcatgaaaacttacatactgttgaaaatttaacattctttcaccatcagcaattttgcaaaataacattattttcatagacatcatcatcaaaacccttaatggatgtcgttttatgaagttagaagatagatgtagagacagttatgtctttccattgacattgcatgtctatgctaaatttgctcttctcctctcaaattttatttgccatagtagcttctgacttctatactgacataaatatatataaatagagattttgccttaatcttctttggattattgcccttgggtatattcacatttctatgcagtgtttttgagctgtagaaatgtgtctgagagctatgtaaaacatttttctgtttaaattcaggtataataaaatgtatgaattcagcaagaataagtgaaattgtatacataatacttagcatagtacacaatatgtcaagtaatcaaaaagtaactgccattgcatttgttgttaatctgcatttctcctgagt

SEQ ID NO: 1663 - DNA, 1167 bp, Homo sapiens
ccccagagtcacgtaatttacccatgtagcaaacctgcacatggaccccttcaacctaaaataaaaattgaaaaagaaaaagaaaaaggtgttgcaggaggaatgagcagagggagtactgtgctcagccaggagaggcccagcattgctcagtggctatgctcctgacggattctgatgatcgatgtagaccttcggagatcactgatacctagccacttaatctcgttcctcacagccagagaatatacgtaagtaaattgcagaagtgttggactcaggagaggccagttagttttggggcacctctcttacagagctctttgggtggaaagaagaagtggtgaaatgacctatgcttctgtttcatcatgacagggaaatctggaaggggaattcagtctagtgaatttacttaaatattagctgcagaaactaagttacagggaaagcggctttgtgacatttttaagtgtagaagatcagatgagaatgtgaattctacagaaacttgggtagtctgggttactgctaaggaatgcctctcactgtgttcttctctgcagatggattggacaggaacgagctgctgccactgtcccccctctctccaaccatggaggaggaaccgctggttgtattcctgtctggggaggatgacccagaaaagattgaagaaagaaagaaatcaaaagaactgaggagcttgtggagaaaagctatacaccaacaaatcttgttacttcgaatggaaaaagaaaaccagaaacttgaaggttagccattttaacagactaaatgctatgatgctatgattgaagggtgtatgttaaacctacctttctctccccatacatactatccgcactcagttttggactgtatgcacactttaagaagaatacctactgattataattgttgatttccattttgtgaggtggttataacatgggaaaggtcagcttaagatatttgtggttttgttttaaatgggtttgcattttaaatagatttaagacttaagaaactcttagagtatatttaggtaaaatagaatgtagataatatggaatcaatgtatttgatgtgtctgaaagttcattatcttagtgtcacttctaaaaaatccttaaatatgagaaagcaaattttcttttctttgaa

SEQ ID NO: 1664 - DNA, 1177 bp, Homo sapiens
ggtaaatgtaaattgtctcaaaactttcaactagaatcagggttttaattttttcccccaggttcctgatgttattagcagcataaggcaattatctaaagcggccatgaaagaggatgccaaacccagcaaagataatgaggacgccttttacaactctcagaagttcgaagtcctgtactgtggaaaggtgaccgtgacccacaagaaggccccctcaagcctcatcgatgactgcatggagaagttcagcctgcacgaacagcagcgcctgaagatccaaggggagcagcgcggtccggacccaggagaggacctggctgacttggaggtggtggtgcccgggtcccccggagactgcctgccggaggaggctgacggcaccgacacccaccttggcttacctgccggggccagccagcctgccctgaccagctctcgggtctgcttccctgagcggattttggaagattctggctttgatgagcagcaggagtttcggtctcggtgcagcagtgtcaccggcgtgcaacggagagttcacgagggcagccagaaatcccagccgcgacggagacacgcgagcgcacccagtcacgtccagccctcggactcggagaagaacaggaccatgctcttccaggtacacctgatcggacgctgtctgcccttgccccaaaaggtgccagatggaagtagctgggcatccagttcctcccagctccacctctatataacgaataatctaacttttatttgttttccccttcaaagcagataaggcaggtggaggaagagtgcagaggaaagtagggaaggggggagaggcagacgtggagtgtggagtataagaattaagggagtagggaaggaagaggaggaggaagcaattcgtagaacgtcctggacacctggtagagagaataagaatctataaccagcatttgccttggggtgattctcaaataaatgcttaaaaaaaaattgtaggcccggcgcgggggctcacgcctgtaattccggcaccttgggaggccaaggtacgcggattacttgaggtcaggagttccagatcagcctggccaacatggcaaaaccccgtctctattaaaaaacaaaaattagccggatgtggtgggggcgtgcctgtaatcccagctaatcaggtgctgaggcg

SEQ ID NO: 1665 - DNA, 1148 bp, Homo sapiens
tcatttttggtaaataggataaactatgttgattttctgataaaatatttatttactataacttaaatgcctctccttaaaaaccaagtgctggaaatgagtttaacatatcaaccaagccaacttatatgtatttgatgaagtccaggcttattaaattcaattccaaagaaatggagtttgaaaaaagaggttttatttcacatgttatgaatgttaaatgtttgttatgtgctataaataaattgctatctcttctcaccctattcatagaaaatctgctttactaccattctgcccccctagttttactgaagtataattgacaaaaattgaacatatttagagtgtgcattgtgatgttttgatatgtgctgctttactgcattcctactgaatgtcagttacatttgtattttatccctttataggtattagatacagagtacatatttgttgatcatttcccttttaacactatgtatagtatactagttttcttttaccaactaatgttccattgttttttttttctttctttcttttaccagtttcttaaacaattaggtctacatcctaactggcaattcgttgatgtatatggaatggatcctgaactccttagcatggtaccaagaccagtctgtgcagtcttacttctctttcctattacagaaaaggtaattgttatgtaaaatagaaagtttctggtaaatacaatttttgttttattctgtcttattttttgaggcagtatctcgctctgttgcctaggctggagtgcagaggtgtaatcatggcttactgcagtctcaacctcccaggctcaagcgatcctcccaccttagcctttcgagtagctgggaccacaggcatgttccaccacacctagctgatgcttgtgttttatttttgtagagacagggcctcaccgtgttgcctggtctggtctccaactcgggctcaagtgatcctcccgcatcggtctcccaaagtgctgggcttataggcatgagccactgttcccagcccaatttctttttcttctttttttaatttacaaagtttttgataaatacaatctttaagaacaaatgatccccttcttgcataaaattaggcaatctagtcagtaaagaaatcttaaa

SEQ ID NO: 1666 - DNA, 1223 bp, Homo sapiens
gtagctatttcatcagtgtaataaaggccacataaactaggctatatatataatataggttatatttaattcagatgatagtgattttaccacttcatataactgttctgaaatggtttttaaaatttattgcttttggaatcaatttttcttttgaaatcttttgaccttttaataacattattaaatagattgtaagttctttgaaattaggcgtataatctacaaattatttggttagaacaatgccttatgtagaatttgtgcctgataaattaattggtttgattatgttgttatgcattccaatatactttgagaattttaaattgtttttttctttaaaaaaaaactggagacttcataaaacatctttattatacataaaaataaacatgaaaatcagtactcttactaatgagaggtagataaacattaatattttttagggagtgtatatatatatacacaattttttaaacaagaatttgatcatactgtaatactgttttataacttgcttttttcacttatcagaaacgtattacataccagtaagtatatatttgatattatttaatggctgcatagctttccattatgtagtattgtatttcaccaataaattattgttagaaatttaatagtttttcttctttttcactattttaataaatactgcaaggtacatcattgtagctaaatctttgtaaatatccttaattatatataattatgtacaattatatgtaaatatataaactcctagaagagaagttgctggataaaatagtttgcatgtttttaaggcttggatatttatttattgccaaattgctatttataaagattgtactttcacctgtaatttactattgtgcccatttctctggatgtttgcaaatagtgggtactataagagtggtttttttttagttcaggaaactaaattctgtagcttctgataaatgcatgagttgtgctccacatttctcaattgctgactgaaactgcatgattaaacataaatacagccagagctgcagaggagcatggaacctggagaaacagatgagataagcttctttagtctctatctgtgaaatgcttactttattctagtctcaattgaataaagtgttaagtgttagttctaacaactgaataagttaaatggcccctacttagagcctggaaattacaaataatcagatattcaattt

SEQ ID NO: 1667 - DNA, 1158 bp, Homo sapiens
ttttaagaacacttacggccaggcgtagtggctcacggctataatcccagcactttgggaggccgaggcgggtggatcacctgaggtcaggagttcgagaccagcctgaccaatatggtgaaaccccatctctactaaaaatatagaaattagctgggtgtggtggtatgtgactgtagtcccagctactagggaggctgagataggagatttgcttgaacccggaaggcagaggttgcagtgggccgagattgcaccactgcactccagcctgggtgacagagggcaagactctgtctcaaaaaacaaacaaacaaacaaaaacttactgtatcttatacttttgtacaaagcaaattagggcacccatgttcacttttctggtgttctttatttctcatttggaaaaggaagtttgcagtgtaaaattagtatgaattagaaaaatatgaaatgtttatcatttgtaagtaaaacacttttacactgaaaaatcatacttttttttttcctccataggatgccatagaagtttgcaagaagtttatggagcgcgaccctgatgaactaagatttaatgcgattgctctttctgcagcatagcttgtcaataatggaaacaccaaaaactgtattatttgcaactaaattttctctgccatacactaactcaaaaattttgatattttcattaacttgatgattaaactttatgtgagttaaactttgccttaacctgtgttttatgttatttttgctccaggttaaaggtgcaatgctttcctcctcttttcttgtgaaggatttatcttgtttgaaaactagcaatagctttcttattctttttagattttacaggaaattttgtattgggatactaggcacaatttccatctgcataacatgaatatatattatctatgttaacatgtttatttagaaaacatttgtgaagcgtctacttgtaacgagatggatgccattctgggttcagaagttaaagcatagaacgctgttgaaaaatgtgatagtcatggagcttatgttattgtgagaagagataagtaacaaacacatcaagataaataccaatgatagatgctgtgtggagaattaaaataggatttgtgttagggaatgaccgagcagctactttag

SEQ ID NO: 1668 - DNA, 1153 bp, Homo sapiens
aggatgaaggtaaataattccagtgatttgctttgcactatgactagcacatagtgaccactcaaaacatgatggctattgttattagccagggatcctgccctcaaagatagaagatcaagtaggaaaagatagtaaaattcacatccaatgcaaagtaaaataaggtaaaagcataaacaatgaggaaattcagaaaaggaagcaatctcatttacaatggcagatagaagaggacgtaatgaagaatggtgcaaagagaatggagaagaccacaaaaaacagagtggaaagaacatgttcatccttgtctgcccattgtagttggacaggggtggtgatttgactcagccattgagaccaaaccactcctagaagttggaactctagtgttctcagcattcaaaatcctgcagcaggactagaatggaggagagaaagtaattcacttacggtttaatctgagaaagcttttggaaagtttgctagttggtattatactagtattcaataaaatcatagtatttgtttctcaagaaagggagtaggatttccttcccggttctgtaaaattattcccttttggagcactgtttccaatgatcacttttgaaaatgacttcaggtatttatgaactatcctagttaatgctatatctttaatctttgagagaagattgatttttttcttaactgaaatccttctgaaccaaatattgatcatatcaaccactatgatatttttggttaataactaagtgtttctctaataaaatataatcttcttattcatttttttttttttacaacttgtacattatctctcaagtcattatgttcgtttggaccgtgcatattttagtatgctaattaactcacctaatgccattactttatcatcttattttttatatatgcctatggtgagaaattgatagacatgacataattatcagagaatgaatatatgtagaatgatacatctcacgattgttacatgggacttctttgtgattcagaaaatttttgcccaaaccatgaaagatcccctacttgctacaaagagataatgaccagattttatcaccaccaatttgacccagcatctgcatcttctatgtaccttctcattgttcctgttctgtccatcttc

SEQ ID NO: 1669 - DNA, 1244 bp, Homo sapiens
gcgcggtgactgtccctccaaggagctgtcttccgaagccgccaagtctcgggcgggtcctcttcggaagagggagaaagttgggcgggaccacggggcggggctggtgggtggggagcgggtgggagtccgggcgcccccagcgctcgcgagccggggtggagccagcagccccgcgtggcgtccgcgtttaagatgcaaatcgagtccccgctccccacctcccctcgcccggtaagcgaggctccgccgccgcccacgcctcctgcgcgccacggcaccagagcaggcggctctacttaagcagcgcgcgggccgcgacccggcactcgcctggagcgcgcgggcaaggcgggcggagcgcactggaactcaagggggcgcacagcggcgcgctcgcaccgctcggctccgcgcggctctaggaggtggcggcggtggcggtggcggcggtggcggcggcggcggcggcggggcgcagggctgagcgagcgtccgggttccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggggccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatc

SEQ ID NO: 1670 - DNA, 1196 bp, Homo sapiens
attgagtagttatttttgacatacttagtgatatcttggtattttttcttataagtttaataagctgcttatatgctattagcaattagacttgatcatttgatagaatctttagtttgtaaatgttttctttcattacctaattcatagttttatatggttctatcttactctgtttttattaggattaggttttgaacttcaaaaaatgtcctttggcctccgtcacagtggtcctgtaattacctaacctataagtttagtgttagtaataactttttaaaaatatggcactgtctgtgcattactggaatgccctaaccttagtgatggtgtattttttaaatgacagagttaactgagttttatttctttttaatagatgggatttagaattggtttcattttcttgtagacaaaattagtaatagattttaaatgtttgttacttcccttctaattcaactatgcacattttaaattatatagttttgtggtaagggaactgtgacaaacttttgtgggacatgtacttgattgaatttttcaacagataaacttttacaaaaacttgcaaataattttttttttctttcaaggtatcctttgtgtggctgatcagtgtcacggcttaagagaactagccctgaactaccacttattgagtgatgagttgttacttgcattgtcttctgaaaaacatgttcgattagaacatttgcgcattgatgtagtcagtgagaatcctggacagacacacttccatactattcagaagagtagctgggatgctttcatcagacattcacccaaagtgaacttagtgatgtatttttttttatatgaagaagaatttgaccccttctttcgctatgaaatacctgccacccatctgtactttgggagatcagtaagcaaagatgtgcttggccgtgtgggaatgacatgccctagactggttgaactagtagtgtgtgcaaatggattacggccacttgatgaagagttaattcgcattgcagaacgttgcaaaaatttgtcagctattggactaggggaatgtgaagtctcatgtagtgcctttgttgagtttgtgaagatgtgtggtggccgcctatctcaattatccattatggaagaagtactaattcctgaccaaaagtatagtttggagcagattcactgggaagtgtcca

SEQ ID NO: 1671 - DNA, 1176 bp, Homo sapiens
catctttccattaataacattaatgatgaatcccaggttgtgatacacgtgaacattttgagtaaatacttagtttttattgcataccatagacactgtatttacatctattatgtgatccactaccaaatacataattattttttaaagactataaattgatttactccattagtttatacagtcactttggaataaatcagtgtaaaagccaacattaaatatgtctcttatcataatgaaagctaggtcttgtcttgacaattgcccttatactttttcagagagacttagaaaaggccaagttggaggtgagggtggagggtggatgattgaaagaatattctttaagttataatgcaataaactagtaatgatacttctataaaatgaatatgtgtacagagaaatataaatatatacatgagtaatcttgaagtctgggtatttggggaaaaaagtaaaaaaataataaaatattcatgagtaaacggtgtttcttttctaaggtggacagcagcaaggaatcagctgaagcagcttgtgatatactatcgcaacttgtgaattgctctttaaaaacacttggacttatttcaactgctcgaccaagctttatggatttaccaaaggtatctgctgtttttgttttattatctattactgagaaattcagtgaaagtctaatcttttttttttgtattgacagtgtgagtataaggaaagttatatatatacataatggaaaaccagttactatttaggatgaaaataaatagtatttttttaagcttttttttttttttttttaaatcaccatacttctaaattggtatggttaaagaaatttacagaggcgtctataggaagtattaaaagaaattcagtaagtaaaatagagtcaagcatattagaaaaaaagggacacatagatactcattttggggcttccagagcaggttggtgaagttagaatcaaagaaaagtagagtgccaatattgagagcaggtatagcttctaaaatcttttggcaaatgttctggaaagatttaatcatgaccaaagttagtctcagcacagtttagattaatttacagacttaaagacatcctttctttgggtgaaaagttaacatatattcttatatatattctaacatgatcctgcatataatc

SEQ ID NO: 1672 - DNA, 1128 bp, Homo sapiens
ggctggaatagttatgatagtatatgataagaccaggtgcaatggctcatgcctgtaatcccagcactttaggaggctgaggtaagtggattgctagagcataggagttgaagacaagtctggccaacatggtgaaatcctgtgtctacaaaaaatacaaaaattagccaggcatggtggcacactcctgtagtcccagctacttggaggctgaggtggaaggattgctcaaaccctggaggcagaggttgctttgattgtgccagtgcaatccatggtgaaaccctgtctctgcaaaaaatacaaaaattagccaagcatggtggcacacacctgtagtcccagcttcttggaggctgaggtgggaggattgctcaaaccctagaggcggaggttgctgtgattgtgccactgcaaccagcttgggcaacagagcaagaccctatctcaaaaaaaaattaactaattaaattaaatttattatagttgttaattgattatttttgttgctttttgtttttaggatgaaaagggaaaaaaatatgctggcctgcatgattttactagtaaaaaaaaaatcccaacttttttctggttttaattttaaaattgcagagattactctttagtttttaaaaatcacaaaatagtgattggagaggaatgtcaaatcacttaagtcagcctcactactatactatgcagacgtttttatgtaatgcatggtagaattacttattactcagctcacaggacaacttgaatgtgtagatcacagaatgaattcaggaatgaacatcacaaattacacaacattgatgcattttaggtggaaagcaaggtaatgaggaagatagttgagaaactgtgaaaaaaagatgggcagtacaccttgaacctggctgctgtcaggcaagtagagggccatttctacccctgcttttacagagacactgctttttccaggcttgcaggatggcagagtaaggtggagctccttcagagagaatgagcctgctcaggacttcaaattatgcacaacctacattcgtgttcttggtgattttaaattagccatagttaaaatttcaagtttcctggttttaaaaagtatttttatactgtatt

SEQ ID NO: 1673 - DNA, 1504 bp, Homo sapiens
gaagcgggaccgcgaggccggcgcgcggcgctctgcgcggtcagagggagcgcctggcagcagcaggagcagcagcagcagcccgcggcggggccgccgccagccgccgcgaccgccgcggctgcagcctccgaagggaggccgggtgagccggcgtacgcactttcccgcggactttcggagtgtttgtggatatacatgccaagccgccacgatgatgtccatgaacagcaagcagcctcactttgccatgcatcccaccctccctgagcacaagtacccgtcgctgcactccagctccgaggccatccggcgggcctgcctgcccacgccgccggtaagcgccccacgcccgcggccccggcccgcgcgcccgcccctccccgtctccgaaacgctgcatgtcgggggctggtgtgtgcaggtcccggtgcggggaactgcgggcagggggtgtagagcagtcccgcagcgaggcacgttttgtccggcggcccttaatgtcgtgttcctgtctgcctctgcctccgcgtcaggcgcctgcgatcggagtagggagcgctggggccaggactctcgacttccctctactttctctgttaatttcacgcctcagaaaggcagtctctgtgcgtgctcgggtgtgtgacacgggtccccagctgcgagttacatttccatttcttcttttccctctttttcgtctcccacgcccgtttccggaatgtgttcttgtgtccccctttctccctacttctgtccccctctccacgctcccatcccttctcgtctgccccctccctggtcgtcaatgtgccccctctccgtctttcccgctctccactgcccccaaacccgttgttattttggttgctttgtgtttgcccttcgcatgctgtgctttccggcctgtgtgtgtgtttcttctgttgttttgttttgctcttttggttttgtggtttttttggtttggtttgtgtcgcctgcagctgcagagcaacctcttcgccagcctggacgagacgctgctggcgcgggccgaggcgctggcggccgtggacatcgccgtgtcccagggcaagagccatcctttcaagccggacgccacgtaccacacgatgaacagcgtgccgtgcacgtccacttccacggtgcctctggcgcaccaccaccaccaccaccaccaccaccaggcgctcgaacccggcgatctgctggaccacatctcctcgccgtcgctcgcgctcatggccggcgcgggcggcgcgggcgcggcggccggcggcggcggcgcccacgacggcccggggggcggtggcggcccgggcggcggcggcggcccgggcggcggccccgggggaggcggcggtggcggcccggggggcggcggcggcggcccgggcggcgggctcctgggcggctccgcgcaccctcacccgcatatgcacagcctgggccacctgtcgcaccccgcggcggcggccgccatgaacatgccgtccgg

SEQ ID NO: 1674 - DNA, 1183 bp, Homo sapiens
ataagacacttgagtttaagcttttcccagggtggaaattattttacctgtccctttttatttatgtttagtgatggcctagtttttctgcagggccatgatggagaaatagcactctagccttagtccaatattgatttactttctttttttaggttttatgtatatgtttgcattttttagcattgtgttttgtccagttttgtgaaaatgttctgctagtatgaaagaaaacattttctatatgaagacatttgttttatgttaggtagcttacattttctcctctgcgtgtgtgtgtatgtgtgtaaaatcagaaatttagcatactatggaaagaaggcatggagcacttgggtttagaggaacctaaaacatcatagcttcattgttccagatgtaacaggtttgaaagagctcatcgccaagttcttgatccacttgcattccaggggagttttcttttgagtagtatgtttcttgtttgcatgttcctgttctttgtggaaactatgcatggtagcatttttgcttgctgtgttttccatacttaagaaaaagaggtttcagttggctgatagaatatcttttatgtaggacaaaacttttctgtgaagagtgttgagggggtgaagataggtaagaggtaagcacaatttttaatttaggctctgaaaaagtgtattgttctaaacgtatttggtatgcctatataggtctttaaaaatgggtatgtatgctgtttaatgtgcactgaacattttacattaatattgtactgttttacattaatactgcatgcttttctatgtgaattgaataaagaatgtcataagcactgtgttccttgatgtcgatgatgattctttgtctcgtatattgaattagcctataaagaccaggaaaaactacttttttttttttttgagacggagtctcaatcttgtcgcctaggctggagtgcagtggcgcgatctctgctcactgcaacctctgcctctcaggttcaagcaattctcctgcctcagcctcctgagtagctgggattacaggcacctgccaccacacccagctaatctttgtactttactaatagagacagggtttcgccatgttggccaggttggtctcgaactcctgacctcaggtgattctccttccttggcttcccaaagtgctggga

SEQ ID NO: 1675 - DNA, 1290 bp, Homo sapiens
gggagtatgatgcagagaggttttggtaaaatcattttagcccaaagctttgtgtaattttcctgcaactttgattttgatttctttctcaaatagacttttttaatgtttagaaaagttggaggtcaatttatgatgtgattcaagttttagatttatttgctattttcaaagttttttttaatagtcttctctttttccagcagagagagatcatcattgcctgaatttagctttgtgactgcaagagcaagaccagttcctgtctggagacgactgttacaataatatcatcctattattttatgttcactctttatcaatttgaacagatgtttacatgtactataattagcattttatctctacagttctctaagagtacatctgagtccaaagtgtatctgaatgtgtgctctgaccttattcttaaatgttttctccccatactttatagccatttattttttaaacaccttaagaaggaacgaaaaagttctcttggatgacgtatattcaagtctgagccaaattgaggattgtgtctaggaaatctgtaaagccatactactgtgttcattagcatgagcaatttaaaatgaaaatgaattaaaaagttaaacatgagtttggttttaattttggggggatcttaagatatatttctgggagtaggatagccactgaaaataattttgaatagatgataaagtacttttttatgtactgtaatagcttgtgcatttcttctgaatatactttctgatgttgccaaggtcatttacccaaatatttttttaaaaattcttagcccttcaaaaccaacaaagaaaataattttcttccaagtgacaaatgatgatctgtggattataaatattttaaaaattatatgtcttaacataattttttcacatttttttgactttcaatcaagacatcgaagacgacctttaaagcaagaggaaatagtgttgtgtgcctaacattggtaaagactagtttttaaccattttaagaagtgtatgtccaaattatttataagcagtatgacttaatatggcttagaattacttataaagaatctgattaaatctcatcctaaatatgtagccacaatatcttttttataatgggactataagaaatgtttgcacttagtttctgagtattccttcatagattctcaggaggcatttaaaaagttggaagctatacttggtagtaactatattagaaaagtccaattgacactgatttttattcacccttgttttatttttatccagc

SEQ ID NO: 1676 - DNA, 1223 bp, Homo sapiens
tcctggtatgctgcctttcccagcacagcctcctgttgttgaaggaccacctcctcctggactccccccacctccaccaattcttacacccccacctgtgaatctcaggcccccagtaccaccgccaggtccattgccacccagtctcccacctgttacaggtaagtaaatctgtttgtttccctgtatttatctagccattcttagtctatttttaaaacttaatagattcttaaattaaaagtatctaaaggaatcccaaaaatgcctgatagaaattaatagcagtatacttccatttggaatacacctccactttgtagcctgtgccaagccagttactatggtttggagtgaccctgtgaattaagtatatcactggtaaaacccagctgcctgcaggccttcatagcttaaggcaaacctgctttggaatgtattaaaaggatattttaccctggatatctaattcagttgtaagggcttggtgtttgtagatattatagtttgataaatgagaagattatgttcggatgtgcaataacttgttttatttgtttgctttcagatgatatttcttattctttggttttgacaggaccaccacctccacttcctcctttgcagccatctggcatggatgctcctccaaactctgcaaccagttctgttcctactgtagtaacaactggcattcatcaccagcctcctcctgctccaccctctctttttactgcaggtgcagttttggccctttttatattcgtaatgtaacacagttttagatgaagaattttaaaatgtctagagagaattgctctgtgaggactacttttctcactaaaattatgtagccgtggtgaatgaacattaaataagccctcagttttgaatgttttcaaaaaaacattttctttttaataacttttttaaataaagttattttctttttgatacatatagagcatgttatatgttaatatgttatattgtttactttttctcttatcaatattaaaaaattaccaagtggagttttataattgttttttaattacagtttttgtattaccagatacatatgacacagatggctacaatcctgaagccccaagcataacaaacacttccagacctatgtatagacacagagtgcatgcacaaaggcccaacttgataggactaacatcaggggatatggatttgccacccagaggtactat

SEQ ID NO: 1677 - DNA, 1270 bp, Homo sapiens
ctagtaatttttgattttattctggatcttctgaatattttgctgtggtcctttggagaatgttggttgttttgttttagcaggcaatcaactcccatagattcagattgtaagctgggtctcttatgctgtgtgcagtgattcaaatcttggctcaggtccttaggcctttactggtatcggttttggatcagtcctacatgtgcatggcttaagggttaatggtttccccttactttctagtttgcatgggctccattccatgcttcctctggctagaatagggtttctagtggagttttagcatcctatgcctctgttcctctccattactgtggctttaccttagaataaagctgcaaaaagaaaaggaaacttacctggtgcaggttacttttacaagtttcagcttcctgctacatccctgcctgtcttttttaatattcagaatgcccaggtagttgtgtttttttatttttttaaattctttttgtatttttgtcctaagttcatagttgctctccgttgggaaggttggactgtagggggttactgccatgctgaaactagagccaactgtagatttctgagtttttttttttttttttctattccttgcattaactctctccctagtatttttgttttgtttttctttcatgttggaagttttctttaaatttgggtgttccttccatgcccatttaaatcctttatctgtggggggtgtgtgtgtgtgtgtgtgtgtgtgtgtgtgtgtatgtgtgtacttgttgatcttggtttcaaagttttatcatgtcttggtgaaccagccttttctgtgggggccttccaaatgtcaatgtctgcaatttagttaggaagctatggcagtagtttaggtaaaggataatagtggcttggattagggtagtggcactgaagagaagtgggtggatggattcaaagatgtgtgtgtatgcgtgtgtttgagtgtgtgcattcaaatcagcattacaaatactcataaaggtgaatttgtgctgagagggaggggcagggtagattactacctgtgaatttttattggaggcatcttaaaatagaaagagcttgaatttagagacagtaaaacctaggtgtgaatctttttgtcttgttcattttagttcccattgcagacaaatgaagtaatgaaattcaagtttttacatttttactaggaaatgctagtcatgttgttttctttaaaaacctcagtatggcagtgtttttaaattttctagtg

SEQ ID NO: 1678 - DNA, 1230 bp, Homo sapiens
tcgcccaggctggagtgcagtgatgtgatctcagctcactgttatgttaggttttatcaataattcttatagcaaacccattaaaataatgcatataatgcatcagattgcacttgggcataattatagacttctaaagttttgtgtctgttatctatttcagtattacagaatcgatttaatgtctgattttaatctaatcataggaagatgtatatacctttggcaaaccctcctctttccctctataattaatttcagtcaactaattgggaaatatatactcaatacataaaagaaggggtgacatttatctttatcttaacctataataattacagcattttgttaatatatttattgaatttagctgtgtctggaactatgttcaagacattctattgggtcttataagaaaagtctgttcttaatgatgttttcattgtgagggcatcttcaagatttattttaaagttctttgaatgaaaaatgaaagtccagtagatagtttgacagttattttttaaaaacaaccaatcaacaattattcatagaaatatgtacctaactctgtgtttggtacaatagggcaccaaaaatatatgacactctgatccactgattgcatgaagaaaatattacctaatgaaatttatcccatcttggacttaggtttttctcacaaagcatagaagtggatgcttaaaatatctgatattgttagacataagattagagataaaataagggagaagggcagaagctaagaggtcgtgaatgagatagggcagggatccccaacccctgggccgtggacccctaccagtccgtggcctgttaggaaccgggccacatagtaagagatgagcggcaggtgagcaagtgaagcttcatctgtgtttacagctgctccccatcacctgagctccacctcctgtcagattagtggtggtatttgattctcataggagtgcgaatcctattgtaaactctgcatacgagggatctcggttgccctctgttacgagaatctaaagcccaatgatctgtcactgtctcccatcacccccagatgggactgtctagttgcaggaaaacaagctcagggctcccactgattctacattatggtgagttgtataattatttcattatatattacagtgcaataataatagaaataaagtatacaataaatgtaatgcacttaaatcatcctgaaaccatccc

SEQ ID NO: 1679 - DNA, 1178 bp, Homo sapiens
gtaatcccagcactttgggaggccgaggcgggcggatcacgaggtcaggagatcgagaccacggtgaaaccccgtctctactaaaaatacaaaaaattagctgggcgcagtggcaggcgcctgtagtcccagctactcgggaggctgaggcaggagaatggcgtgaacccggaaggcggagcttgcagtgagcggagatcgcgccacagcactcccgcctgggcgacagaacgagactccgtctcaaaaaaaaaaaaaaaaaaaaaaaaaaagaatattgttttaaatgagaacacatggacacagggaggggaacattacacatacggggcttgtcggtgggtggggggcaaggggagggagagcattaggacaaatacataatgcatgcagggcttaaaacctagatgacaggttgacaggtgcagcaaaccaccatggcacatgtatacctatgtaacaaacctgcacgttctgcgcatgtatcctagaacttaaagtaaaaaatatatatatattgttttagtaagttagcatgagttttcatttcaagaagcttgtcttgtcatttttactatctaaattttgtggaagtctggagctgtgttcacatgaaaatctggtaaaagggaatgggccttccttaagtactgaagactccaaactgtgtaaaaccccaccaaaaaaatatgattgtatgaaaaggactctaggatacaatatcttaaaataggaaggagaaagatttgggttatgttcatgtatcaatgactgttgtattgttttcttctctttttgaagtgatttgtgtgactttattgaaatgggcacattttataaactttaatttgtaggcatcagagaccccaactctacaaggcctttcctttactgtcagacctggcgaattgttagctgtggtcggccccgtgggagcagggaaggtgagttagaatggcttttggcagcttgttgcaaccccacttatcatattaacttcgtgggtttgagcccaaggctacgtgtaacacaattttgaactgggtacacttggcacggcatttctcagtgcatggaacattcgttttgcaagaagggtcacatgaccaaataaatgtggacaatgcatatcatgtttcccttggttcttcaagttgagcaattgggaactcctagaa

SEQ ID NO: 1680 - DNA, 1172 bp, Homo sapiens
ggcaagatggatcaggaagtacccgaatccgaaaagtgtggccatttggggactctgtgagaggagcatccctgtccaccccgggtcattgacactgggtaagagccatattgttgtgaggaatttgcatcgtgaaggtgatgaactgcggtttgcatcttttgttttatttatttatttttttaatttttgagaaggagtctcactgtcaccctggctggagtggcgcaatcttggctcactgcaacccctgcctctcgggttcaagcgattctcctgcctcagcctccccagtagctgggattgcaggggtgtgcgccaccatgcccagctaatttttgtatttttagtagagacggggtttcaccatgttggccaggctggtctcgaactcctgatctaaggtgatccgccctccctggcctcccaaagtgctaggattacaggcatgagccaccgtgcccagccgcatcttctgttttaaaaggactattagagaggggggaaagacatctgttaaaatgaagattggattaatgcatttaatccaaaaagggatattcatctcaccagtctggaaaactcagttccatgaaaaggtcattctctccttccacctccctttgatggtgatatttatgtggccacactgattaaaataatcaagaaagaagaaacagtttatatttttcaaatgaagctagatattacatgatttatttttaagaaattgaatacaattaatgttttgttctagatagtacagttttcttgtaatctcaaatgtatttccttgcctgccttcagtagtaagcagctatcaaatggtgccctgctctgatggtgtttacttccaccattcacagtattgttcttaatggcatgcggattctagagtaaccaataattagatactcagatgttttccagtttttagtaattagatagttagatgtcttctagtttttgtatattacaaatagcattttaatggacatgattaaagctaaacatttggacagatccttcatttcctagggcgtacaaatttcaaggcttttgctatgctagattgatttcctccccaagagttgttaattacttacattttccccggtgaaatgagagagctccctacaagtccagatttgatgttatattttaataatcac

SEQ ID NO: 1681 - DNA, 1155 bp, Homo sapiens
ccccaaacgccagggagggtggcgccctggggagccggtacccaggaggtaccctcttcgggtgaacggctgtgtccactcgggctcgtccaagaggtcttctctggtcccgcagggttctgggtgcacgctgaccctgcgcgggcagacgcgccctttgctccaggtccggacctgggcgctgctatagcaacgtcctggacgcccagaccttaggccgccgccgccgcggaagcgaggaacccggccttctcccgctcctgagggctgtggcggcggcggcccgggaggcggcccaggctgggtaaagaccgcccggctcctcctatgcaagctgaggcagcggattggttttcaagcatggtaagaggcgggaggccggggcgcccccgacggggatgccgggctggggagaaccggggcttccccggacccccagctccccagcctgcccgccccccatccccgcctcccgccgcgctctctttgtgccccccgcagcccttccagaagcatgtctactacccgctcgccagcggcccagaggggcccgacgtcgctgtggccgccgccgccgcgggtgcggcctccatggcctgtgcgccccccagcgcggcttcggggcccctgcccttcttccagttcaggccgcggctggagagtgtggactggcggcggctgagcgccatcgacgtggacaaggtggcgggggctgtggacgtgctgacgctgcaggagaacatcatgaacatcaccttctgcaagctggaagacgagaagtgcccacactgccagtcgggggtggacccggtgctgctgaagctcatccgtctggcgcagttcaccatcgagtacttgctgcactcacaagagttcctcacctcgcagctgcacaccctggaggagcggctgcgcctgagccactgcgacggcgagcagagcaagaagctgctcaccaagcaggcgggggagatcaagacgctcaaggaagagtgcaaacgccggaagaagatgatctccacccagcagctgatgatcgaggccaaagccaactattaccaggtgggcagctgtgtgtgagcacgattcataatccagtaaacaactcagttcccatttgataggcctgtcccgtatcaccactctttcttctta

SEQ ID NO: 1682 - DNA, 1135 bp, Homo sapiens
acagttctggaagctggaaagttcaggaagaagataccaggtagatgcaatgtctggtgaggatcctctttctggtttaccagccgcggccttctctctgtgtccttacatggcaagagggggcaaagaagccctctggggtctcttttatcaggtcactaatcccattcatgaaggcttcacttctatgctctaatcgtacctcaaaggcctcacctccaaatccatgacattggagattagctttcaacatatggattctggggggacataaacattcagtctatagcaaacaccatactgttagactatcctaaactagtgttaatctgttttaaaattaatttgcttccactgtcttctttcaacatttccagtttagagcctcacacccccttcttacttggactcctttctgtgagctgactgttcacgtgggaaggatgctagaagccaaataccatatgccaaatgccttggatgaaacttagagggaaacactggcagtggattcaatcttaaacactttcctagtgaaagggggttcaaagtgggttcaaatttaaagtatcaggaaaatacagaaaagtaaggaaataccattccgaattccatgcctttttggtattataaaagaaatgaaatgtcagagttcctgtacatccctctaccctcacaaagattactatctatttggtattcatattcatatctttatcttaaaatatcacatatgattataaagccaaaaaaggaagcaagctagctattcatcaaaaggaaacaagttgaatatgttttcatacattcatactataaactgttatgtgactattaaaagattactattaaaatattacatatttaagcttatatgtattaagcttaaaatcaaatgtcagattaatatgtgtcataaaatttaattttgattaaaatatgtatatattggcaaatcatagaaaagcaggggttgcaatcctagttgctgacaaaacagactttaaaccaacaaaaatcaaaacagacaaagaagagcataacataatggtaaaaggttgaattaaataagaagagctaactatcccacacagatatgcacccaatataggagcacccagattcataaagcaaa

SEQ ID NO: 1683 - DNA, 1201 bp, Homo sapiens
ctctaaattttacagatgagactaaagtctcagctactgaatgagtgctcaagactatagaattgataagccaatatataattcagattcttgcttctcaaaagctagcccttttctccttgcaccttcctgttctcatggaatcagcttttcccatgggacttataagctagttagagtcttaaagcctttcccttgatatatgttgcaagaagatagcaataatttgaaccatctaaacttgtggttcatagttcaaacatgtttactatttactcatgaagttcttttgaatactagttgtccctactttgcagatgtaagctgaaaccatgcaaaatggttttaatagtcaatgtgaaaattctttctgtaacttttaaaaattttttgtgaaatcattactcttgtcaagtttgtaaatgtactaaaaataatgaaaatagtaaaattaatgtttagtatactataattgaaaacacaaacactgaggatgaaagcattttattatttgtaaaaaattaattaagagtgctttaggatatgagggtgatctggctgagacgtctgttaccctattgatcgccagggttgattcggctgacctggctggctaggcgtgtgtgctcttcttcgctcaccgctctatgtgcatccctcctgtccctccctaagtgcacgctccgtggaagaggtcgtcccccagagaagaggaccagtctttgagcaaaggtataggagtagctgcacccccatgatacactctccaaacaagctcttttgttttttaagacggagtctcactctgtcgctaggctgaagtgcaatggtacgatctcagctcactgtaacctccacctcccaggttcaagtgattctcctgcctcagcttcctgagtaattgtgactacaggcgcacactaccacatccagctaatttttgtatttttagtaggtatgggttttcaccatgttggccaggatggtctcgatctcctgacctcctgatctatccgccttggcctccctaagcgctgggattacaggtgtgagccaccacgcctggccaacaagctcttaaaagtagtttagagccatgggtggctaggagtggggacatggctgccacttaaacagcagcaggcatgaatgccagttgctgccggcttggttccagtggggacagtgtctttcacgatga

SEQ ID NO: 1684 - DNA, 1210 bp, Homo sapiens
gtgggggtggtcttgaaaaataagattcaggctgggcacagtggctcacgcctgtaatcttagcattttgggaggcccaggcgggcgcatcacaaagtcaggagatcaagacaatcctggctaacatggtgaaaccccgtctctactaaaactacaaaaaaattagccaggcgtggtggcgggcacctgtagtcccagctactcgggaggctgaggtaggagaatagcatgaagctgggaggcggagcttgcagtgagccgagatcgtgccactgcgctccagcctgggtgacagagcgagactctgtctcaaaaaaaaaaaagaaaaataagaatcaggcatgactttctaaactatggtggatcatgataaaaacatttactcttttttcttttctaagctgcagagtttttaacccctaatttcaattccacatttaaagacagcttgaattctttctcagtcttagtttaataataatatggttagaagtatgtctgtagagtatactatttcttttgtgtttcagatatattgagtacataattctgtttatgtgtttagcaatgcagttgcaggcgagagtgctctagatcgaatggcttgcggacttggtggaaagctcgttctgccgatgatcaaggaacacattatgcaaatgcttcaaaatcgtaagctgtgtccttcaaatgctagaagagtgaagttgtgccctttctaaagcttaaattctaagatatgtttagactgttaaaaattaatctttgtctttttatcatccatatttaacccaattcatttattttaccgataaaattgtcaatcccaaagaaaatgtacagatttacttcctagccaaaagtatttagatttgaatttgaaaatgatgttattatttgaatttttatggaatattagaatgtttgaatcatatactcttctttcacccaatatcttttatttttaaaagaagaaactctatctaatgttatcaaaagagaaaccacttctttctttctgtttttgcccctgacggaggtgatggtggaagcccacctgccctggagggcagctgttgttgttgacacaggatttcgccatgttgcccaggctggtctcaaactcctggcctcaagcagtcctcctgcttcagcctcccagagtgcttagattataggcatgagctaccacacctggccatccttcctt

SEQ ID NO: 1685 - DNA, 1196 bp, Homo sapiens
acttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctg

SEQ ID NO: 1686 - DNA, 1191 bp, Homo sapiens
gtttttagtttgttttttatttttgtagaggtggagtcttaccttgctcaggctggtcttcaccttttggcctcaagcaatcttcccaccttggctcccagagtgctcagataacaaggatgagccactggcagctggcctaaaatgccaggtttaatggggaaagggattttggagttttatctaggtgatttgcttttagttgatttaatctgtgagaggtgcagtgttttagataacctggaggtctggaatgaccatgagtacaacttggcaggttacattggagcgcctgtgttgttgctgttttagtcagaggtaattttagtaattaaagtgaaatgtcctgttttaaaggaagttctgttctgtaaagagcagtaggtattaaatgtctttgggaagtatggactctttggggggtttcctggaataatgaggacgtttgttgttattttttcacagccttgtatttcagtttttttctttaaagggagtaagttgcatatggggggcttaaatgctttattgacaagaaaaaaaactgcaccaggaccaattcatcatcatcatcagcttcctcccccttctttccttcctttttttttttttttgagactgagtcttgctccatcgcccatcacccaggctggagtgcagtggcgtgatctcggctcactgcagcctccacctcctgggttcaagcagttctcctgcctcagcctctggagtagctgagataacaggcacctgccaccacacctggctaatttttgtatttttagtagaggtgaggttttaccatgttggccaggttggtctcgaattcctgacctcagacgatccccccactttggcctcctaaagtgctgggattacaggtgtgagccactgcgccaagcctcctgttcctcctttttcttgctttttttcagcctgagcaactctctttgtacttcatcgggcattccttcagcccagcctgcagcaggatccttctcatgctgcgcctccttttcctaggctactgggcatctgcagcagtgttgtctctcccatccctcccagtctctgtgcagcatcacccacggataggccgggatgttttctttgaattttgggtgatgctcagaacagaactggaaaaaggccaaaggaggcctcttgggtgcctggaatccttgagctact

SEQ ID NO: 1687 - DNA, 1151 bp, Homo sapiens
cttgaacctgggaggtggagcttgcagtgagccgagatcatgccactgtactccagcctggaagatagagttagactgtctcaaaaaaaaaaaaaaaaaaaagtgagaaaaagaagtaggagagaaaggataagaaaattagagagctggtcaaggaggactaacctctaaataacaggagtccagagagaacagaggaagtggaagggagaaaattaaaaatgaaaaattcataaaaatgtcccacaatcaaaggacatgagtttccagtttgaaagggccactggagcatcagcacaatggttaaaaatgggcccatgccagatatatcatcatgaaatttcaaatttctagaacccaacagatgattctacaagcttctggagagaaaaacattcttacacacaagatccataacaatcagaatgccttgggcttttcaatagctgaagcattgaaagctggaacagtggagtgatactttcaaaattgccggggaacactgggcatggtggtgtatgcctgtagtcccagctattcaggaggctgatgggggaggatcgcttgagctcaggagttctgggctgtagtgtgctatgccaatcgggtgtccacgctaagttcagcatcaatatagtgacctcctgggggtgggggaccaccagattgtctaggaaagggtgaattggcccagattggaactggagcaggtcaaaactcctatgctgatcaatagtgggatcgtacttgggcatagccactgcatgccagcctgggcaacatggtgagggtccatctctttaaaaaaaattaccaggaaaaatggtctccagctggaattctatacacagtcaaatgtcaagcaaaagagaagggagaattcaaacattttcagacctgcaagaccctagaaaaagtttacctcccctattacctttctcaggaagtcactacagaaaagtaccccaccaaaaaaagggtcttctttctaagtcaagaaagaagatgatatggggtacaggaggtgacaaagtggtgagatgaaggggaccccaacatagttttttgttttgttttgttttttgttttttaacccaaaccaaaaatggtcaatacccaacatagttttagaaggatttctctgaattctg

SEQ ID NO: 1688 - DNA, 1367 bp, Homo sapiens
gagtgctgggattataggcgtgagccactgtgcccggttgggggagtttctttaagtggagaggaggcttagcttgtttaaaaggtgttgggaaaaacccagtgggaagggtgtggttgaagatacagacaggaatgagtgataggactgagttgtgaggaggtgaggatccggggcccagggcaggtatgcttctcattgctgtaggagggaagaggaggggttactcttggtcacggagcggtggttgtcaaacgctgctcctgtcccagctgcaaaaaaatcaatcacggtgttttctgaatgtacaccttcctgggtctcctccccagagggtcagattcagaagagctagcatgagtgtcagaaacctgttattttttgttttaagaaatgtgtatttttaaagtctccacatccccccaccccaggacattttaatggacaaacagattgagatggaggcaggagggcagccacaggcagggcagagagaacggagtctggtgcgctgatgagagaagatagaagatagaaggattcttggatgtgagggcgatctggctgtgacatctgtcaccccattgatcgccagagttgattcggctgatctggctggctaggcgggtgtccccttcctccctcaccgttccatgtgcgtccctcccgaagctgcgtgctcggtcgaagaggacgaccatccccgatagaggaggaccggtctttggtcaagggtatacgagtagctgcgctcccctgctagaacctccaaacaagctctcaagatagaaggattctaaagatgtgtattctggtaggttgtgtcaataaagctgattggatctgcggcgagggaggagttgaagctgactctgctttactgcctgggcagctgggtggataggtaacgttcccagtcactagagagggaatgcagagaagcaggagctcatttcaggagaagatgagttcagctttggacctgtgcagtgttgaggggtttgcagagtccggtcagaggtactcgggacacttggggaaagaaatccagagctggactggattggacatgagtaggtgagagttaggttgtgggtgtgagtgaggactccagaggtggggggacagttggaagctgaggacagaccttcagcccattccagcatgtaagggatggatagagaaagaggaggcagaaagtaggcagagctgggggcttctgtaggaggagttgcgtctcttcccctagtccagcggatggatgtgccttcttccacggaatcacgcgtcccgcagccgcttccctggctttgctcaccaccatggctatgctcaccagcctctgatccctccttgtctccagtgta

SEQ ID NO: 1689 - DNA, 1454 bp, Homo sapiens
aattgccattttacctttaatggcaaaaaccgcaattacttttgcaccaacctataacaaaacaaagttattaaagactaatattacttcctgctctttttgttacaataggaaaatagcctttattagagaggtctttcagactagcaccacatcaagattttctctttgatccgatcaggaatagtaagaactgaaaagggcagtttgaatcacggtgcgatgaaggagtagatggtgggatctcaccacgggtctgattagccctttctctgccttgcttgagcttcagcagaactcgaaatggctgacggtaaggctgggaaggactccggaaaggccaagacaaaggcggtttcccgctcgcagagagccggcttgcagttcccagagggctgtattcatcaacacctgaaatctaggacgacgggtcacagacatgtgggtgcaactgccgctgtgtacagcgcagccatcctggagtacctcaccgcagagggacttgaactggcaggaaatgcatcaaaagacttaaaggtaaagtgtatattacccctcgtcacttgcaacttgctattcgtgcagatgaagaattggattctcatcaaggctacaattgctggtggtggtgtcattccacacatccacaaatctctgattgggaagaaaggacaacagaagactgtctaatgtatgcctggattccttgttatctcaggactctaaataaaagaacagctgtccagtgttggtgatgccagtggactatatttctgtgaaaaacacaattttgtctttttgtaattctatttgggcaagttggaagtttaattagctttccaaccaaatttctgcatttgagtcttaaccatatttaagtgatactgtggcttcaaggaagctattgattctgaagtactgggctttgattgagctgactgtttttaaaaaactgtttggattttaattgtaatgcagaagttatagtaacaaacatttggctttgtacagacattatttccactgtggtggataagctcaataaaggtcatatcccccaagaaaaaaaaaaaacaaaaagaaaagaactgaaaagggagtcatgacctgacttctatttcaatgatgtttactgctgggctgacaccctgtctaaaatcatctccagtggtgcaaatgccaccgaacaagcatgacagcagtggggcctcaaacccttccccacccacagtctacaaacagccttttcaccaccatcccagttggaaagaaatttatttattcccccaaaataaaatcctagaaactctccaaaaagggtggggtgggggacaatctgcttaaggagaacaatgagggggttggaggtctgcaaaaaagtagaagagagcttggggtaacttcaaacttccaaaccagatcacagcacaggtgacggggaacggacaaggagg

SEQ ID NO: 1690 - DNA, 1198 bp, Homo sapiens
ctctacagtatgtgcttattaaacacccatttttttcttttccaaaatactttctaaaatctctataagccaaaaatttaaccctagtattctaagaggttcacctatttattaaccctataaatgatttcaaactatgcttctcagaatctccaagtgaaaaaccaaatgctaagactagggagaggcagactggggcataatttatttagaaagcaatcaatgagaaaacctcaaccttattatctaattagtcacagtactcattttataatttaacattaaagaagaatgtgcatttttaaatcttcatcaaaggtgatatagattaataagtgataagaaacactgaaagaaattgattaaattatgagttgaatttctagatgagagtcaaaagaaaatggaaaaaatctagcaatgtgtagagactgggttaaagaccagagggccatggtgtggtagtctgggtcgcccacagcatcagctgtttctgcttttcatagtctctttgttctattctcctcttaacacacagatctccaaaagcagcaaactattttgcaaagtagctcttcttggtggaagcatctgcctcctggagataggggtgaaaggctgggaggacagaagaatccatgagtgggtggctgcttcggaaatgggacaattactttattctcatttcaggagctttgacctgaattccacatttctcagcttccactagaattccatgccatgcacttaactattcttcatgcattatcctcagtgactttttaaaatgtcagagctaaaggagctgagaggtaaactaacccaagactcttaattttatagataaagagagactcagaaatgtgaggtaatggatcccatcatatatacgataagtgaagtgccaggcccttatcttctgactcttgaagctatgtttctgttagtggttcacactatttcttctctatttctgccactaaggatccactcaaagggggtttctccataggtcactcaaattccttgagtttcttcaaagctattcttaactctgagatttaacaatagggacttttctaaatacatgatataaaacctatatactgaagctcagtatatccattaaaaaactcatgtttgccgggcgcggtggctcacgcctgtaatcccagcactttgggaggccgaggcgggc

SEQ ID NO: 1691 - DNA, 1102 bp, Homo sapiens
agccagcagtgtatgatatgtacttccatccacacttgctttgtcagcctttaatattttggcaattctaaaaggtacgtagaagcatctttttgtggcttaatttgcgtttcctagatgacgaatgaaattaaacatcttttcgtgtgtttatttgccctttgggtatcttcttttataaaatgctttttcaaatgtttgaaggggggattctccctttttttattgtgaatttgaaagatttttatatattctggatataaagctctttgtcagctatacatgttgcaaatactttcctttgtgacttgagtttttgctctccatgaacagggtagcagagtaatgtgtattctttttatcatgattaataatatgcaaattgaattgaataaactttcagtccatgagaatgttttgtcatttccccacctttgtgtctctaggagctcatgggacacatgtagctagtatagctgctggacactttccagaagaacctgaacggaatggggtagctcctggtgctcaaattctttccatcaagattggtgatacaagactaagcacaatggaaacaggcacaggcctcataagagctgtgagtgtttgtgagttgttgattcagaagattaatgattaatgatcttggatatttttaggtttataagtgctcctagtttaccaagaatacattgaactatatatagtgtacaggacttttaacaaagcaaaaatatttactaatttatttttaaattatttttattaaatattattaggatttggcctaacctttgtgaaaaaattacttacttcatactcgtcatttctagcaaatctcctaacaagcaattttgagatacttaaaaagaaagacctcttagccagctttctccatcagcctaagaggaatttaaaacctcagctaacattctgtacgtcattttaacgtaggaaagtatatttaattttagtgattttttaacctaggaaggaccattccattccctctacctctgtccccctctaaccccactcttttctagaaatgctagttttttgtttttttttttaatgactacttttttatgtgtctcct

SEQ ID NO: 1692 - DNA, 1175 bp, Homo sapiens
taccccgacctgtcttcagcaagaatcctgttaggtcggtttagccagaatcctccttacccagatgttacctcatagtaattttctatccactgaccccctccctgctccttgactataagttcttacttgcccctgctgtggtagaacttgaccctgtcaacttgaaataatcgaaagaattagaacctagcttgaaagaagttatttaagctttgaaaagctgagaatatccatctgggaaacacagactccagagaaatgaggtgagcgctctgacgttaaaaattaagcttttgcttatataggcagaaaacagagaagtttagttggattgtaacattttctatacaaagctggtttatgagttacggcaatttaaatggtgacagtttgtttgctgcttgttttcattttctttccaatttaaaacagtatatttagtattgcatcttaagacaatgtgatagccataaagtctttgtgtgagaaaggtagggagaaagttaatctataatgaagatccacagtgaatagggaagaggtcttccctgaggcccttaagtcatttacatttaatagaacaatgtagggaaggaagaagtttaatctctaatcagagaaacacaggtttcagttgcctgggttatgtctgcctgcttgcctgactcaggccccataatcacattcctttaagggtcaaaataatttaaagttccaacagcttagattttgaattatatattttcacaagccccatctcccccaccacaaaacctcactgccgtggttcctccaccaaccctgatgatcctgaataacatctgcttcactgtgctgtaacgagcgtcgctgaataatgtttcctttaacagaagcgccaagaactatctttgcgattttgcaagattttcccagtttacattcatctcctgcttcagggttttctttccatttattttgacaaaactaaatgaaactggcagttaactttaactgagtaatgaaagacaacaaaaagcaaacagagctggagacagagagagaaaaagaacaccaatgaattaactgtggcagcaccttgagatttgatgttttctggcctgcaggcctggctacggggcacctagaaccctcagggctagaagttccagctgcccattgactaagctcta

SEQ ID NO: 1693 - DNA, 1129 bp, Homo sapiens
ttgctcgaagaactcgagcgacagagacaagctgagcttgccgcacaaaaagctagagaggtaacgctcggtcgtttggaaagtagagacagtccatggcaaaactttcagtgttgggttctgcctcctgctcagttcagaaagagatggaatacagactatctaattcctttctcgtctaaacttaacattgctgcgaaagttaattttttagcctattcagaagtgctgactgataacttaaaagttggaagcttttataaaacatattcaaggatactttttgatttaatggaactggctatttgagaagtgtttgaaacttttgccatggctgcaggacttacattcttttttgggaggacggtggggagacagggagtggtaaagggaaaaggttaaaaatccacctgtggttgtatattcttctattctgtcactctgttacctagactgtgagaggcttttgccttcagtcagattaaaaagagcagggcctaacattgagtgatagcacctgctttgataaataggttttctcactcttctttttttccttcttttatccctcactccctcccctaaaccctgcttcagcacaatggactaattctagcattctgatcataaggccctccattttcctaatgtgtttcaaggaatctttttaggaaaaatatccagattattcatccactttttttagtatctactaacaactcctttttttctctagagagttatgaaggaacaggttgtccttgtctggagtcaagctaaacacatgatttgttttatcagcagctggagcagaagttgaaaatgtctttctgtgagacagtaatttgctactgaagctttatggcttgtttgcactgattactccaggatccaaaaacttggtgaaagtcactgaaacactcaaggcaaattactttacagccctgagtgtctgtcaccatagtttgcataatgaatatgaatcccattggtgtgtgatgtaggaaatcctgtagttgtattttcttgaactgaaatatttgactcaaaataattaagactcattgtcatttttcatcttggcattattgtggacaagttgacatattaaatctctttgctttctggt

SEQ ID NO: 1694 - DNA, 1181 bp, Homo sapiens
caggaagaacatatctaaattttcacccacaactgagttgtggttttgcatattgcttcaacccatagctccaaacttcacctttggcgagggaggattcttttctcaaaatttaatagcagcttagactttgttcaaatcaactttctttcgtaatgttgtaagtagaaaaattaggagcaaaatacgactttcatttgctagagaagacgtggtttgtctaacagcgacaatctaaaagcaaatacttctttctcactgaatgaggaagaatgaggagctttgtgactgacaagtgaaaggatgatatatttgatgtgttccatttatatgtaaatgctaaggaacatagacaagtataccaagtaaagttttatttatttacctagaataccaaagttgcatgtaaatgcactgttatgtacgaatcataagaggttgcaaggaaggagatggatagatggtttgaaaggaggtagatacatagaaccaacaatgctacatttatatgagtagtagatgataaatatcaagtatctctcccatgcttttggtttgaagttagccagtattctccaccagtaaatcagaatgtgttcattttacaagtgactgtcattgctctccttccttctgtttttcttctccttccctttcttgcttttgcttcataaatcttcatattttattctcaagtacatggttgtcatgatttgtagcagcagaggtaggtatgcagctggctattatgtttcaaaatagaaatgccagtatccctatcacctcccccatcacgtttacattgattataaggaatattgacaccaggggcggtggctcctgcctgttaatctcaaccctttagtaggctgagtggggcggattgcttgttctcaggagttcaagactagcctgggcaatgtggcaaaactccatctctagataaaatagacagattagccaggcatggtggtgtgcacctatagtcccagctacttgggaggcttaggcggaagaaaggcttaagcctgggaggtggagattgcagtgaactgaaatcgcacctctgcacttcagcctgggcaacagaggcagaccctgtctcaaataaataaataaataaacaagtaaatagctgtatcttcctcattacagcagaattacagttaataagtacagga

SEQ ID NO: 1695 - DNA, 1199 bp, Homo sapiens
ctctatgaagtacatgaaaaattagctgggcatggtggcgcatacctgtggtcctagctaatttggggagctgatgtgggaggatcttttgagcctgggaagtggaggatgcagtgagctgagattgcaccactgcactcaagcctgggtgacagagtgaaaccctaactcaaaaaataataataataataataattgtagttaaaccaattgaaaccagttgttctttcaggaatttcaaaggagagtctatttgaaagccttataatctgacagttataaggcagtcttttgaaatggctaataacttgttgctgacttctgattgtattaatcccttctccatttatggtggctaaagtgaggagctgaatctgcatataataagatatactgaaattttgaaaagaaaactggaaataacattgtaaaagagacattgtgtgaagtacctacagctcaaggacaaactgacaagtgtttggtcgttgaagactgaatattcaaagacccatttttctaacatctggatttctatttaaatctatttcttataaatcttttgctacaaaaatcattgttgtgagagtttggctccaggaaacctagacaacggtttcgtagttattaatatgctttataattaatatttaaatttcctggagctaaagccttagaatagtgagaaatagagcaatcaattctatttgatgaatatggaataagatttccaagactggtgtgtttgagtacatatgtatgcgtttgtatataatattataaaacaatatgtaatatgtaaatatactactaaaagagaatatataagctaacagtagaatctcaaatcacttttgtataaacagcaggctgaatttgtatatttgagccaatttctgtttgaaatagaaaatcattttttaaacaggcatatatacatctcaaatttataattgaatttactagctgttaaaatatattttgttaaaatacaattcgcaaataatcatttattttgatgttgggcttattttcacaatgaataatcacagtgttctctaacaaaaggcaaatgagcttcctaaatccaagttttaaatttagcagggaaagcgtagtattttccagcttttgttgtttttgttttttttttaataagtgaaagattggtttggccctgctttcaggtgatgagactg

SEQ ID NO: 1696 - DNA, 1177 bp, Homo sapiens
ggatggagtcagggcccagaaataagaaaaccaaggtagttcaaataaaacatggactgaaatctagaagtacagagctattttataaaacttatactttaatttcaatcactccattttgatagtaaattggttgttatattccattgactttggaggaaaaatgatgagttgaatatcccactgttgaccacagtctgcagcaccctcaagaaaggcattccccagttggcctggagagagaaagaatttacccagtcagggttattgcggaggccgcctacctgccaattttcaggtttcttttttgtaatgttttcagtagtaagaaaagatggaatgacattggttgcctcttaatataacagtctgcctcttcattcaagattaaacataacaaaatatttgcaatttcattaggaaaaaagctccaaagttagtgtctgtgagtagaacaagcaggaaacaaaacataactgcaagtttggaatcttccccgggagtttcacctttccctgtgatctgagtcctcacctttgatgcccatccctgtggctgctcccttcctccaggggaggcgggactcatttctttcttttcttttcttttttttttttctcattgtgggaaaaaaacccaaaaaaacccataaatttgccctctctgttcttcagggttctccaaagaaatggagccaataggctgtgaatagaggtgtatgtcctatttgatagttagatagacaaatagttatcctatgagagaaagggagatttatttttaaaatatgtctcgtgtgattatggaagagaagtcccaaaatctgcagcaggcaagaaagtcaatgaatatttccagctggagtctcaaggcctaagaaccaggagggccagtgccagtccaaatgctggcagccttgaagtccatgaagtgccagtatacccgcctgtgtttaaaagtcaggaaggagcaatgtcctacctcattcagggaggaggagctctctctgactctgcctttctgttctattgagatcttcaactgatcgcacaaggcccacccacagcagggagggccagctgttctactcattctcccgataccagtgctagtctcatccagaaacactagcgtagacacacccagaacaatgtgggaccaagagtctgggcaatcc

SEQ ID NO: 1697 - DNA, 1183 bp, Homo sapiens
tctgtaaaatgtaactcattgattaaaaaacaatactacttgtttttatcatttgtagctttttgtaatacacataattttgaaacaaattactcttttctataatcttcaggtaaaaattagggtagctttttaaaatttgttaagctcagttttaaaaaataaatgcctaggtagatcagttttgaaataacatatattcccccatttcaaatatgtgaagaagctcaatggcttaaaatttggaaaatgtaatatttaactcagttgtttgcattatgtaatgtttactatacacccataatataaatattccttaattatatttaaagtaattcctttttacatttttctcctctatttatttatgacaaattgaactcagatattagtaacttgttcaggccatacaagttgtcaccggaggacattactaattctaaagtacataccttttttaatacaaaagtttattaattttaagcagcatcttatgttattaaggtttcatgggattgttatgtttgcaattctgcctttgtagaaacaatctatatgtccatcagtaggggaaggtttaagttttttttttttttcgataaaacatagtacaccatgcaagaatttaaaaggaatgaactggagctgcaagtgtcaacatgatgaggttcttttttgatttagtagaatatttttagtgaaaatgcatcttgtctgtatggtaaaaaaggacaaaattttgaaaactaactctttactgagggcatagagtgagggaagagacaggatttattcatgttcttgtatttttccagggaacatcctcatcttatgcttcctttgcatttaattccattttcgttttgttttctttaccaacattttggtgattgctcatattattatatataaattacctcaatctgcacagtgattcactgattacatataatatcatgtatttaaccagtctctttaggatatttccaaacttttgatttataaataaagctacaataagcattctagtatgtaagtctttacccaatgagtggtaatatctgtaaattcatattagtagacttgcttggtcaacaggtgagtgcattttaatttttgatgtgatgtcaaatctttactaaaatattatgtaaatacaaatcattgtcctttagaaaataaa

SEQ ID NO: 1698 - DNA, 1196 bp, Homo sapiens
tattgtaaaactctcaattatttccacttaatctatatattcaatgcaataccaatacaaatccaattgaaattgttaaattaactttaaagtatacatgaaccaaaggtcatgattagctaacacatgtttaagaacaaacttaggggactttctatttgtcaggattgactatatagctgtaatgatcaagatatttggtgatttgtttaggaacacacggaccaatacaaaagaaaacagatcctagaaatgcacccactccctggggtcacctgtttaggacaaaggtgctgtgatcatgcagcagggagacacatgtgggaacagttttaatctggatcctcctccttcacaattgtgaaatcttttccacatgggtaatatggtagccttgggtttgggccataatcccaaaagacaccaccctaaacaacataatcctggatgctgaaatcccaagagagtgaaatacctaaagtccaaaatcctgcaagtcaaaatcatgatgcaactcttctgcatacaaccaaaaccacaataatcctttccctagaattcagctttcaggattttaacattcagaattttattctttcaggattgtgatttgcaggattatagatgtttggcatttcagactttggggattttgatttttgaggatttcgatcttttgagatttcaacattctaaattatggcattggggattgtgtctttcaggattatgatcagcaccaaaatatcttaactgtaaatgctaaaataataaaatgttataaagaaaatgtaggaaaacattttcataactaatgccaagctttcttaaacaggtcacaaaaagtatgaaccctaaagaatctgtaaaattgtacactttgcttcttttaaatacgctatttgaagagtacaatacaagccataaactggaagaaaatgcaatatgtatgtttcacaacaaaaagaatatcgtgaatacataaaaactcctatatatcaagaagaagaaagaaaacccaattttaatggcactataactgaacaggcagttcacaaaagaagataatcaaatgaacaacaaacacatattaatattttcatttgttaaatcagagaaatagaaattagaaacacaataagctaccactctacaactgccagaatagctggaatttgaaaaactcttagtgaaac

SEQ ID NO: 1699 - DNA, 1170 bp, Homo sapiens
ccaccagccccggctccctgtcgtccagcagcggccacggctcgggctcctacccgccgccgcccggcccgcacccgcctctgccgcatccgctgcaccacggccccggccagcggccctccagcggcagcgcctccgcctcgggctcccccagcgaccccggcttcatgtccctggacgagtacggctccagcccaggcgacctgcgcgccttctgcagccaccgaagcaacacgcccgagtccatcgcggagacgcccccggcccgagacggcggcggcggcggtgagttctacgggtacatgaccatggacaggcccctgagccactgtggccgctcctaccgccgggtctcgggggacgcggcccaggacctggaccgagggctgcgcaagaggacctactccctgaccacgccagcccggcagcggccggtgccccagccctcctctgcctcgctggatgaatacaccctgatgcgggccaccttctcgggcagcgcgggccgcctctgcccgtcctgccccgcgtcctctcccaaggtggcctaccacccctacccagaggactacggagacatcgagatcggctcccacaggagctccagcagcaacctgggggcagacgacggctacatgcccatgacgcccggcgcggccctcgcgggcagtgggagcggcagctgcaggagcgacgactacatgcccatgagccccgccagcgtgtccgcccccaagcagatcttgcagcccagggccgccgccgccgccgccgccgccgtgccttctgcggggcctgcggggccagcacccacctctgcggcgggcaggacattcccggcgagcgggggcggctacaaggccagctcgcccgccgagagctcccccgaggacagtgggtacatgcgcatgtggtgcggttccaagctgtccatggagcatgcagatggcaagctgctgcccaacggggactacctcaacgtgtcccccagcgacgcggtcaccacgggcaccccgcccgacttcttctccgcagccctgcaccccggcggggagccgctcaggggcgttcccggctgctgctacagctccttgccccgctcctacaaggccccctacacctgtggcggggacagcgaccagtacgtgctcatgagctcccccgtggggc

SEQ ID NO: 1700 - DNA, 1342 bp, Homo sapiens
gatatgcaacaacacagatgaaccttgaggacattatgccaagtgaaataagtcagtcacaggaagacaaatactgcaagattccactcatatgaagaaccaaaaacagtaagactcctagaaccgaagagcgggttgctggtgaccatgggctgagggtcagggtaaatgaagagttactggtcaacgggcatgaagtctcagttatgcaggatgaaaaagctctagagatctgctatttacgacattgtgcttataatgagcaataccgtattggatgcttaaacatttgtccagagggtagattttcataccaaagtaaaataaaatttagtaaaaagaaaaatattccaacagctatgccagaggcaaagagaccaaatctgaggggcacatagtgtgctggggaagggaaagagaatgacggcaacacagtggttcatggtggtgttctgtgagtggactgtgttcctccacattcatatgtgaaagtcctcactctcagtacccagaatctggatgtgagggagatctcgctgtgacatctgtctccccactgatcgctagggttgcatcggctgatctggctggccaggcgggtatccctttcctccgtcacccctccatgtgcgtccctcccaaagctgcacgctcggtcaaagaggaaaaccatccgcgatagaggaagaccagtctttggtcaagggtttacgagtagctgcgttcccccgctagaacctccaaacaagctctcagtacccggaatctgatcttatttgaagagagggtctttacagaggtaatcaagtttaaatgaagtcgtgagggtgagccctaatccaatatgactaatgtccttagaaaaaggggaaatttgaacacagagatattcatagaggaagagaattgaagcctcagggagaattgaagcttcaggaagagacttgaaatctaccagcacagaagagaggcctggaactaatccttcccttatggtgctcagtaggaacgaaccctgccaacaccttgatgttgaacttctggcctccaggactatgagaaaatggtttcagttgtgtaagccacttagtttgtggtgctttgttacagcagccctaggaagctgatatatcaagtgagcagggttctagagaaacagagaaagcaacagttaactctgtcttggggaatgaaagaatgcttcactgagaaattctggaaagaagacactattatgccccaaatgctgctccttcttgtatgttacactcacacctcttaggtacgatgtctggatttgataagccagttatggcaatatttaccagagaggacagaaggc

SEQ ID NO: 1701 - DNA, 1178 bp, Homo sapiens
ggctgtgcgtgaatgtctagtcaccaggtaaccctcagcagaggtggtgtttggaaatgccccactggtaaagaaggaaggtcagtggttcggggctttcacctgccgtcggggcagccagagcctgaaatgaaagcacttggtagcttcgtgcctctcatgaatcttcaagatcagaaagaattgtgtcagtccccatgtcctggtggcagggagctggtagaggctgagacactggctgagttctggagggagccccatgggacagagaaagggccccgcaggggatgggaggagaggtgaggacacagtgtacttggagggtgtcatgggggcgatggggaaggtggggcaggaacgttgccatcagagaagcgggacaagagccccgaatccagggagcagagaactgcaggaaggaggaggtggccagcgtggtaaagggaggaagaagcaagagttaatttcacagatgccacaaggagggattggttgttaacttttttaaaaatgttatgattagaatatgaaaaacttggtagaattggttaaacattctaactgtagagagtagttaatttttgaaccagagaatttccatacttggtacacagcaagatcctaagatggtattgaatagtttctttcctcaaaataatgtctgacttcaatgtaataaaacatgtatctgaaacccatagttatgaaaacatctgttttttagtatttagtgaaaaggtaattctttaagaaatgcaaatcaaaaccacagtgagataacatctcatgccagttagaatggcgatcattaaaaagtcaggaaacaacagatgctggcgaggatgtggagaaataggaacgcttttacactgttggtgggagtgtaaattagttcaaccattgtggaagacagtgttgcgattcctcaaggatctagaaccagaaataccatttaacccagcaatcccattactgggtatatacccaaaggattataaatcattctactataaagacacatacacacgtatgtttattgcagcactgtccacaatagcaaagacttggaaccaacccagatgcccatcagtgatagactggatgaagaaaatgtggcacatggaatactgtgcagccatagaaaaggatgggttcatgtcttctgcagggacacgggt

SEQ ID NO: 1702 - DNA, 1157 bp, Homo sapiens
tggtagatatgtatatagagcaccaagactgagcctaaacagcagctccaggcaggaccccactcccttcagggcccaccctgcaccatcttcctcaaatgttttatacaaaaaaaaaaaaaaaatagtggtgcctaattggcattgcatcgattttcttaagagccaggactaacacaaagtgatttcaaagcttccattaggacaccatgaacactgggcccacggtggtggcatcaggcagaccttgctcccttctgcacagagcttgcagagaaagcccaggcaagtagggtggagggccttccctaagaggctggctctttcagaagttcaggtttggccgggcgcggtggctcacgcctgtaatcccagcactttgggaggccgaggcgggcggatcacgaggtcaggagatcgagaccatcctggctaacacagtgaaaccccatctctactaaaaatacaaaaaattagccgtgagccgaggttgcgccactgcactccagcctgggcgacagagcgagactccgtctcaaaaaaaaaaaaaaaaaaaagttcaggtttagcgggacaggactgacagattgacagctcttctgcggcttagcactggtggtgcatagcattcctggaacgcatactaggaacgcgacccttgagcaggcggcatcccccaactccacagagagacccaggtgttcacccaggccagatggagcagtaacaacgtctgtgctgccccgagacaccagagcacacatacgctgtagggattggcccagtctgcgaaccccactcatgacggggccagagcaatggattcccagtaaatgagggtcatgagcttgctcttcacccgggaccctcccttcatggcccgggaccctcccctcacagcccaggaccctcctctcacggcccgggactctcccctcacagcccaggagcctcccttcatagtccaggaccctcccttcacggcctaggatcttcccctcccctcacggcccgggacccttccctcatggtccggaacccttccctcagccaagacgctccccccacagccagggaccctcccctcacggcctaggatcctcccctcccctcaaggcccgggaccctcccctcacccgggaccctcccctcacggc

SEQ ID NO: 1703 - DNA, 1157 bp, Homo sapiens
tatgatgtgtttaatccatggacattctaagaaactcaggttgcaattttcttaaaacttaattccttgatatgaatatttatcaaggacaattttgtcaaaaatgaaagcattttcattctggaaaattgactcttagggtcacatgcccactgtggagctcctgaaaaagtatcacctgatgcagtttgcggaagtaaccagagctgtgaggtagagtatgccatccttcctgtttggggttttaaaaatgcaagcctgatgagagttgacgtgcacgctctgtgagaaactcaccctccttctgacgcgcctcccccctcaccagcgagggcaacctgctgctgctgcacgaggcgctggcgaagcacgaggccttcttcattcgctgcggaatcttcctcatcctggagaagctgaagatcatcacctacaggaacctctttaagaaagtgtaagcatttccccggcacattgggctcccagtgtggctctcggcagagcagtcagacatccagggctgttgcagtctaagagagaaggccaccgtgtgggtggggtcgttatcttccttccattgtgtgggataaaatgaagcctccgcccactgcctcctggggaccctgcgcgagacacgtgagtagcacaagctgtgcctggacttgtgggggaggtaagcaggttctatgtgagaagacaacttgagaacatcagccctgagagccgcggtaccacatttcatcagagcacacaggactcgccactcactcccctcccttagtgctgaccaagtagccctcccagccacttctgcctgtcacaaaggcagatgcagagatcgtcattcctttcctcacacgtcttctgaggcctcgtcccagcaggatctcagttgtgtaaacttcaggcaaaggccaactttgtatagagctgtgggtagcacgtcacaaacagtagggaccctatttcgctgagtctgtgagacacagcccattgtcaggtgcttcctgatttcagggagattaaaatgtgaaaaaaaaaaccgaaccttaatgaaatacttagaaaataattaaaaattgtgtttgtactagtgactttttaaagattgaaaagtcaaattagatttaatagctctgagagtgtagtttagagtt

SEQ ID NO: 1704 - DNA, 1143 bp, Homo sapiens
tgatgtatgtacatttcacaagtttcacgtttccctcaggaaaccacactctgaccataaactcacatggacgctttttttatcaagagataacgttaactttgtctttaaaatagaaagttttgttcatttcataaatatgtgtataattataaatgattttcatataaatatctatttgtatatatatttctataagtatagttacatacttcatgcatataccccttgtatgtaaatgtttgtaaatttaatgccattgtaattaggggggttttattcttcttttttagcctggagatttgaaaaagagaattgaatctctgatagacagagactatatggagagagacaaagacaatccgaatcagtaccactacgtggcctgacgcatctgcagacggttccccttcatgaaacactagaatgtaccctcagagcaggaagcacacctgtgccatttctgggactctgattgatccagctgtggacattggaaggcgaaggaagggaggtggctcctgggtcatctttcacaaggctcaagacttcaacctgcagatgtatctttttccctccagtttttcctctagttcttttaggcatttaaattgtttctgttactctgtgcaaaataactttgagattggacaagaagatgttactaaagagaagttcctttaaaaggtcttgttcttgtgtcaaaaagctgcaagtttggtttgttctcgtgtgtgatcatgagtgcacaatgaagaagaccctagatgctgcattttttagctctgaagattccttaggtatccctgaagacagctcgctcagatgatcagcatttagagtgaaaacaagggcccttcatgggtgaacattagaaagagccagggttcaaagctggcgaatggatgacgcaccctagccactggcccctctctgtttcatgtatttccaaaagttgtaaactttgatggctgatttttcgtaagtcaggtttctaagtgagctccctgaggtgccaaggccatggtgtccgccctgctgcgtctgttcgtcagctgagttccttgtgaatctctgttttagggtttggggctagtgtgtttgtgtttccattctaagattgagtctggcagtccctgtttt

SEQ ID NO: 1705 - DNA, 1226 bp, Homo sapiens
ctctgcctctgggaaggtctctgatgagcttgctcttgtgcgtgctacggaagatcagtgtaaaggtggcatggtggatctgcagatggcagcttatttcttcagacacctaaaattatggcagataaagatgactctgtgaccactgggctcgcacctgtaatcccagcactttgggaggccaaaatgggaggatcacaaggtcaggagttcgagaccagcctggccaatatggtgaaaccccatctctactaaaaatacaaaaaaaattagccaggtgttgtggcgcattcctgtaatcccagctactcaggaggctgaggcaggagaattgcttgaacccaggaggcagaggttgcagtgagccgagatcacgccactgcactccagcctgggcaacagagcgagactacgtctaaaaacaaaagagtgagacagtcatctcaacctggtacagagagagcttggttgcatcataattgaggtttccaatgcagtgcacattcttacatatgttggattacccaagcactgtgtgattggaagtgggtgtgatctggattctgccacggatggatttggggagaacacagtgactcaagtgtggctgtgtggagtagtgtgaacgtggcaggtgtttctctccaggaattgaatccagaaatgggaactaatgatgatcaggaaacttggaaggaagtgtataagatagtggttgaaagtgcctgtggtcatcaagctaaaaggatataccgactgggctcctgggtgaagtgtagctgatcttattgaatccacgttgaaaaatctgtccagggctcacccagtatcaacaatagtgaaggggatgcagggcaccaagaatgaagccctctggagcctcccatgtaccctcactgctcagggattaaacagtgttaccaaccacagctaagggataatgaggttgttctgctcaagaaaagtgcagataccccgtgggacatccaaaaggacctcaaagacctgtgactcctaagctgtagaaatttaaaaccacagtgagatgaaccctgagccttcagtgttcatccatatacatgcatcaccgtttgcttttatcttcttcagtatgtgaatttgggctcacagaatcaaatcccatgcttgatttcatgcttgcaatcgagtccttgaacaaatacaatgaaccaaatgaaccatggtagcatgcttcttaacaaaaa

SEQ ID NO: 1706 - DNA, 1234 bp, Homo sapiens
agagccgggcgcagcggcttccgcctgtcatcctagcgctttgggaggctgaggggggcggatcacgaggtcaggagatcgagaccatcctggctaacacggtgaaaccccgtctctactaaaaatacaaaaaattagccaggcatggtggcacgtgcctgtattcccagctactcgggaggctgaggcaggagaatcacttgaacccaggaggcagaggttgcagtgagctgagatcacgacactgcactccagcttgggcgacagagcaagactctatctcaaaaaaaaaaaacaaaagaaacagaaacagagtcagaattgtagaccacgttcctcctgacgctaacacagagctcccatttgacccagctgttcgctcctcggtatttacccgcaagaaacaaaaacacacatccacattcagactgatacacggtggtgatgggggtacaacagtgtgaatccacctgataccacagagttacacactcagaaatggttaacatggtacattttattgtatgagagtttcaccacaatgaaaaacttgtacctgaatgttcaagcagcattattcgtatagttaaaaagtattaagaactcaaatgtcaattagataacaggtagatatacaaaacatactatattcagcaaaggaatattattcagccataatatagaatgaacattgattcatcctatagcacagatgaagcacgatgcttctgaaagaaccggacaaaaagtccacacgctgtgtgattccattcataccaacgtccagactaggccagtccgtacagacaggatgaattactggttgccggagggtggggaggttgggggagatggggaggaagtgctgatgggtacagggtttctttttgggatgatgaaagtattctaacatggattgtggtaatagttgtgtaattttgtgaatatgctggaaaccattgaattgtatactttaaatgggtaagttgtatggtaagtgaattatatatcatagctgttaaaaatatatacgatattttaattagacatagaagaacatgaatagagactagaaatatatatatgtatatataacaaggtgttaatgattttctactagtagactggtagatttgtactaagttttttctactatatatacttttctgtaatttaggaaaacctccctttcaattttaataacgagggaaaatttatatttaaaatatcaaag

SEQ ID NO: 1707 - DNA, 1188 bp, Homo sapiens
taagctattgaatttagatatgcacctctgataagcaaggattgtttcccgtaggattaggacgtgctgtggatgtgtgttttgataccagtgtgctgatgcagagcgtttatttacttgttaggattttgtgttttcatttgctatttttctttaagtgcagagttcatttttgcccctgaaaagtttttgctgagtttgctgaagaaattgtatttcaaccacatccatgaaaataaaacacctcctgttgtggatggtgagcccctgatgccgcttatttgccgtgagtttggacggcacccctgctggcggatagcaagactctgtggagtttgttcagtggtacggtgtccaagcaaacagcagaatgcaactttctaaacagccccaagcaaacagcagaattcaactttttaaacaataaacaccatcaaccttattgactttattgtcccttaaattatattgactgttgtgattccatcaagtttgtacactcttttctctccctgttttgcagcaacaaattgcgaagtgcttttgtttgtttgttttcgtttggttaaagcttattgccatgctggtgcggctatggagactgtctggaaggcttggaatggtttattgcttatggtaaaatttgcctgatttcttacaggcagcgtttggaaaccttttattatatagttgtttacatacttataagtctatcatttaaagacatgtactgaaacaaatgtatttgtttcataagcatcttcctgtaatctattataaaattgaaattaaatatagagaatgttttaacaattttttaactcaaaatttgtcaatcatttttaatagttctttttttataaaaagaaaaaggaatttaaggacaggcagtagtctcttttaaaatttattcacaaaacccattaactgcacagttgctattagctgcctgttctaaaacgatagtctttttattgaaacacaaataaacttttctgtaatattttatggtatataaagagactttaattgtttgacttgtttaacttggcactgttagtttttattaataaaacgcgcatgggcattttaaacaagctgtgtttctctaattcaggattattatctagaaatttgtctgtcttgttggttttactttatacttgagtgagaaagtaggttgttagg

SEQ ID NO: 1708 - DNA, 1172 bp, Homo sapiens
ctatttcattgatctatgtgtctattttcatactagtaccatgctgttttggttactatagctttataatataatttgaggtcaggtaatgcaatgcctcctgctttgttctttttgcttagggttgctttggctattcaagctcttttttttggttctatatgaattttaggattgctttttctaattctgtgaaaatgacattggtaatttgataggaattgcattgaatctgtacattgctttgggtagtgtggtcattctgatgttattcattcttctccctgagcgtgggatattttcccatttgtttgtgtcatctacagtttctttcatcagtgttttgtagtaaagatctttctcctccttggttaaatatattcccagatattttatttctttgtagctattgtaaatgggattgcttttttagtttggttctcagcttgctcttggttataaaaatggtactgatttttgtatattgattttgtatcctgaaactttgctgtatttgttcatcaaatctaagagttttttaataaaagtatttagggttttgtaggtataagattatatcatcagtgaacagagatattgtgttggtgcaaaagtaattgtggcaaatggcaaaaattgcaattacttttgcaccaacccaatagtttgacttcttgttttccaatttggatgctgatatagtttggatgtttgttccttccaagtctcatattgaaatgtaatcctcaatgatagaggtggggcctggtgggaggtgcttgtgtcatgggggtggatcccttctggatggcttggtgctgtccttgagatagtgagttcttgtgaaatctgactgtttgaaagtgtgtggcacctccccaccactctctgttcctgctcttgccatgtgatgtgactgctcccacttcactttctgccatgattgtaaggtttctgaagacttcaccagaagcaggtgctggagccatgctgatacagccttcagaactctgaaccaattatacctcttttctttataaattacccagtttcaggtatttatagcaatgcaagaatggcctaacagaaaactggtatcaggagtggggcatcgctataaagatacctgaaaatgtggaagcaactttcaactgggtaatgggcggaggttg

SEQ ID NO: 1709 - DNA, 1284 bp, Homo sapiens
tttttttttgagacggagtctcgctctgtcgcccaggctggagtgcagtggcacgatctgggctcactgcaagctccgcctcccaggttcacgccattctcctgcctcagcctcctgagtagctgggaatacaggcgcccgccaccacgcctggctaattttttttgtatttttagtagagacggggtttcaccgtggtctcgatcttctgacctcatgatccacccgcctcggcctcccaaagtgctgggattataggcgtgagccaccacgcccggcctctagttcttacttagatgtaatgattcctatcttataagagtctcttgatgtcttcatttttttttttttgagacagggactcattccattgcccaggctggagtgcagtggcataatcagggctcactgcagccctggcttcccagcctcgggtgattctctcacctcaggctcccaagtagctgggaccacaggccaccatgcctggctaattttttgtatttttttgtagagatggggttttgccatgttgcccaggttgggatgtctttattttttataaacgtttcttaaattaatgtggttggagttaaactttgatggctgttcctctcactgcttgaagccttaggcagtgggattttgatccatcatatatcaaaaatggcttatcttcactcagggcaccatgaggatgggctggctgtccgttagtgccttctgatttttgcggagtcaaacaattactaaacgggtggtgattccagattaagaaaatgtacctgtgattaaaaaaataaaagaagcagcctagtttcaaaacacgagcatatagtaattagatagctgtcatctggtgctgtgaaataaagccagttgattctgagagttactgaaacattatactctaaagtcattcatgttcaaattttaaatggtttactcagttttttagagtggttgctcacacacgtcagggcagttttaaaaatacactttttggctgggtgcggtggctcacacctataatcccagcactttaggaggctgaggtgggcggatcacctgaggtcaggagttcgagaccagcctggccaacatggtgaaaccctgtctctactaaaaatataaaaattagttgggcatggtggtgtacacctgcagtcccagctacttgggaagctgaggcaacagaatcgcttgaacccgggaggtggagattgtagtaagccgcgattgtgccactgcactccagcctgggtgacagagtgagatactccg

SEQ ID NO: 1710 - DNA, 1410 bp, Homo sapiens
gtgtgccttacaattactttttgtaaattggatgacattaggtattaacaacagtactggcacattagttgttacagctccgcaaggctttatgcacaattatgtaatccccaaagctctgaaaaccgaaatttacaaaatttagcaccccaactggtttggtagccaagtgcaggttatagggagctggaaggggaagggggtcacagtaggtggcatcgttcctttctgactgcccgccccccgcatgccgtcccgcgatattgagctccgaacctctcgccctgccgccgccggtgctccgtcgccgccgcgccgccatggaattcgaacgctgacgtcatcaacccgctccaaggaatcgcgggcccagtgtcactaggcgggaacacccagcgcgcgtgcgccctggcaggaagatggctgtgagggacaggggagtggcgccctgcaatatttgcatgtcgctatgtgttctgggaaatcaccataaacgtgaaatgtctttggatttgggaatcttataagttctgtatgagaccactttttcccatagggcggagggaagctcatcagtggggccacgagctgagtgcgtcctgtcactccactcccatgtcccttgggaaggtctgagactagggccagaggcggccctaacagggctctccctgagcttcggggaggtgagttcccagagaacggggctccgcgcgaggtcagactgggcaggagatgccgtggaccccgcccttcggggaggggcccggcggatgcctcctttgccggagcttggaacagactcacggccagcgaagtgagttcaatggctgaggtgaggtaccccgcaggggacctcataacccaattcagactactctcctccgcccatttttggaaaaaaaaaaaaaaaaaaaaaacaaaacgaaaccgggccgggcgcggtggttcacgcctataatcccagcactttgggaggccgaggcgggcggatcacaaggtcaggaggtcgagaccatccaggctaacacggtgaaacccccccccatctctactaaaaaaaaaaaatacaaaaaattagccattagccgggcgtggtggcgggcgcctataatcccagctacttgggaggctgaagcagaatggcgtgaacccgggaggcggagcttgcagtgagccgagatcgcgccactgcattccagcctgggcgacagagcgagtctcaaaaaaaaaaaaaccgagtggaatgtgaaaagctccgtgaaactgcagaaaccctttgggaacagagggaaccatggggcaggaagcccacgaaaattctaattggtcttctggttcttggtgacatcaggtgaggggcgcccaaatgtttggcttcatgagaatcaccgagtatggggactgcat

SEQ ID NO: 1711 - DNA, 1227 bp, Homo sapiens
tatatattgaaaccctaatcccaatgcgatggtatttagggtgggatctctgggaggtcattaggtcatggagtttagaatactcataaatgggattggtggcctcataaggagagacggaagagctagctagctctttttccacgatatgaggatacaagaaaacagccatctgcaatcccaaggaagaccctcatcttcagaggcagaccatgctggcaatctgatcttggacttccattctctagaactgtgagaaataatatttgttgtttaagccacccggtctacggtaatttgttatagcaacctgaactaaaacatttcctttttataacaaatattttaaagctctttttatttttctgaaacataattcgtaaagaatgtaacttacccccacgcacaattttaaaccaaaatttaaagacaaaaagtagagacagggttttgctatgttgcccaggctctctacctccagggctcaaatagtcctcctaccttggcctcccaaagtgcttggattacaggcataagccaccatgcctggccaaaaaattagtaaaatctcttaaagagatataaaggagtctacggccataccaccccgaacgcgcccgatctcctctgatcttggaagctgagcagggttgggcttggttagtacttggatgggagataaaaggaatactagaaagaatatgacttataattaaatactatatgtttagatatgtaaatgtttgtgtataacattcaagaagacacaatgtggtactcagatatatgcatctgtatataaaatcacctggaatgtaacagctacaaatgcagaatgatacaggcattataatggcgattcaaataccatgaacagaattactgatgtggtatgattttccagaatactaaatagcttttggcagattttcaaacaaaacaaggtatgatcatcccatgattttcatggtagttgcatccctggaaagttcagtgtgtattaaaactacgcataaaatgccttgtgtttatatttaaaattaaattatggtcaggcacggtggctcacgcctgtaatcccagcactttgggaggccaaggtgggcagattacctgaggtcaggagtttgagaccagcctggccaacatggtgaaaccttgtctccaccaaaaatacaaaaattagccgggcatggtggtggccgcctgtaatcccagctacttggg

SEQ ID NO: 1712 - DNA, 1099 bp, Homo sapiens
gaaagagttaactttctttcctctgaccacagaaaactcctccaagtttagaggtttagggatctggattgagaaaggaaaaagccgtggaaaatctcttctcacctccgtccctggattttaccaccatattaagcggaaggcgagcactacaatttccttgtccatcagacgccctccatagacgcctcatatttcgggaggtgtgtgtggggggggtcgcccttgtacccaaagatctgaaattcttacatcaacaccgtttccatgcaccacagaggcacagtaggcaaagtctcaagagagtatcacggtgaggaacgggaagacagcctgatagttgctctgctcaaagcagaaccttttcgagggatttacagagcacgaaaatgttttcattttgtaggagaatatcctggaattttactcaagctaacatcctattcagtagccggaatgctaggagcataacatcaatctataagatgaaaggaagagaaactaaaagcagacgagggctccatagctcaggggttagagcgctggtcttgtaaaccaggggtcgcgagttcaattctcgctggggcctgtgtgttttttcctcctacccacagggatttccacatcaggaggtaagcggggtcggacaacgcggcagcaacgtgactgccgcttggcacatctgcatgtcttcggcgcctcttcggctgtcatttaggctacgggggttcacgcctgctgcagaagctgccagtctcaatgactcttggggcgtgtggtttacctctactattcaaataagtacgcattcttgccgatagaaggcacccaagaacctagtttatcagaaaaatgcctaatgatttgaatgagccttagtgcaaaacttaagagtatctgtatcgcggctcgttggtctaggggtatgattctcgcttagggtgcgagaggtcccgggttcaaatcccggacgagccctcgctcttttcaactcaacaaggtgtgtcttgtttgaaaacttcacgactgcactttgctgtccctgtataccgttctttgaaaaattgcagctattaactccccagggatgtgaagaagc

SEQ ID NO: 1713 - DNA, 1237 bp, Homo sapiens
ctcctgggcgcccttgaaagacgccttaaatctaaacctataatacataggtaatcaactaaagctgaaagggaatggccaaagcacccacgtggagtgctgggtgctgtaggcgagaggtctgaggtagtggcttttagagctcaacatcttggtaatgttggttcgaccttttcccctgccagtcccgcggtgacctttatctttcggtgagtgaaatcggtcgttcgtgtttttcgtgggtcttccaaccacaggccgcctgagatggttctagtccctttgagtatacagacccttcctgtgcattgaccgacacagctcggcccggatcccgaaatgaacgtttctaccttcggaacgctgcgtctcggatccttctgaacccgcacgttgactttcctggagtctggagaaaatcactagattctaaaggaatcaaaactgttcaagtgttgtgctacaactaaaaaaataaatgaacactcttaaagaatagaatctctccagttctggctcgttggtctagtggtatgattctcgctttgggtgcgagaggtcccgggttcaaatcccggacgagcccctttactttcctttccgtttcatctttctctctttaaagtcagtagttaacaaatactgcaatcggcgctacggctaggtcacctagccctcttcaacctcgacctatgggggatgagattgttgagcaaattgcggctactttcgctgaaagaatcaaagacaacgaagacgctgcgaagggccaaggtcttcatcacagatcggggttccctgacgggctctgacaggatcttttgtcaggagcagagtgttcgggcagttcttacccagtattttgtgtggaacaaactagtgcacttttcactaggtcacttcgtatggaaaagattgctacctgaaggcgtgttagggtcacaatgtcccaatagaacccgctttctgagaccctgaccgcgcggtgatccagccgcgggatggagtctagcccctgccctggccttggcgcctgctccgcagcgcagtgttgcactcttggttgttgtagtgagactgcctttccgacagttgcaagcgctgttgcatcgttcgaatgcgaagtcgcagccctgggaacttgagggtttacaggacacagacattcattttgttcaaggaagcgcaattcgattatttccaggtgttattttcgaaaacatagtataacatagga

SEQ ID NO: 1714 - DNA, 1244 bp, Homo sapiens
agcgcatcgggaggaagaacgggggtgggggatgagggggtgggagagcagtggaaggtgtagggaggtcagagtgttagggaagggcctcattaccggccaccaccagaccctgcggctcggctggggttggaagccttctaccagtgtccattccaggtctcctcctttctcctccagcaacccttccctcaccggacccccgcaccctgcatccacctcgccaacccctctgcctctcaccctctcacttttttttttttttgccactgaggtctgtcatcctcacctgtagaaagggggatgcacaggaggaagaagatagcaagtgagagcacactcccaccactacccccacgccccctacccggctcgcccctcatgggtcgttgttatcgatgccggggaaagccagtcaaccacagccagaggattttgttccgccgcaaaaggagcgcggtggcgatcggcgcaggattatctctctaaggcgagttccaaccaacttaaagcttattggacgactagagttgcaaggagtcttgcatttgctgaaagatcaatgacccaaccccagaaacgtgcgcccttcgatagctcagctggtagagcggaggactgtagcctgtagaaacatttgtggacatccttaggtcgctggttcgattccggctcgaaggagctgccgtattcttttgcacacgcacgcaccaaaactacgtggctgcatctctgcctggtcaaaggctttgccagccagcatccacactctcccaggagaaacctagcaaggcctttccggattacccagcttcccacagcctatgctgtggccttgggagtctgctcattcttcaagtcattgctttctctactatcttcaaattttttatataatctgggatttttatctccaagtcattgatttttatggccattaggtgacactataactgatattcttatgaaactagatgaaatatttgaataacatgttagaaaattgaattcatgtatattaaaacaatgtcttaacaattatttacatttacatataagttctatttctttccttgctcataaattttttgcatctcactgttttgtgattttattttttattttcaggagttcaaccttgagcaattcctttagaatgcatccatggatcttaatgaagatataagttctagaacaccccccaaccaagtgccctcaatgtaaactctcttttgactgctatt

SEQ ID NO: 1715 - DNA, 1127 bp, Homo sapiens
gaggacaggctgttagggcagtgcccccttatggtcttccatcagaccctgacgctaggctggggttggaagctgcttacaccacgcccatgctggttctcctcttttcctcctccagtgtcctctcctccactggacccacccatcagtctcaccaagccctctgccctcgccgtcttacctcattttccctctggccactaagggctgtcatcttcacaagcagaaagagcgatgcagagggagaggaaggccacaggtgagagctcctcctcgtggatcgtggctatcggcgccccagagacgccaggcacccccccgggcccagaggatttgctctgtccggaaaggggcgcagtggagaccggcgcagagttctcttccaagtcgggttccaattaactcaacgagtattggatctccggtggtccagggacttggcttcctccatttgcagaaagtccagtgacccagccttaacagtgtgcatccttcgatagctcagctggtagagcggaggactgtagactgcggaaacgtttgtggacatccttaggtcgctggttcaattccggctcgaaggaagcgcctgactcttttgcgcacaatgctgcctggctgcacctgttcctcgtcaaagaccttgcagccttccagtcataactacactttccccaggaaaacccagcaaaatcctgcctttcctgatcacaggcctgggagcctattcattcttcccgaatcctcatagtcttcagctcaaaacagtgccccttgccttgtgacccagccagaccccaattcgtgcccccaccatcctacgcctttccacttgtatttacaaactgcccacccatccccctgtcccagacccgtcaagcttcatctttcctgagctttcacaagtttttatgttgctacagccaagtttggctactgctggaaaagtaaggatatctaatactcagttcaaagtctgcaaaaacacctgcaccaagtgccctgcctacttgggagggtaagggaaagggaaagcgagtaccaaagaagtgcagacttcaaaacagcttcagtgatcctggagagttaggggctattgggtccatggcagggagcagacgtaaagc

SEQ ID NO: 1716 - DNA, 1228 bp, Homo sapiens
aagcataggacactgtagggaaaagggcggaggcacatcgggagaaggggcatgtgtgtgttggccgggaagggagtaggaaggccagagttttaggaaagggctgcttaaggactttcagcagaccctgcagctggtctgcggatagcggccgcccacccagaagctttccgagttcttctttcctcctcctgcaacccctgtcccacaggatccacccatccacctagcccatccctctgaccgagccctctcaccctcttgttttctttcgctgagggctgtcatcctcacttgtaaaaacagagatgcacaggtggaggaaggccacaggcgagagcctcccgtcctggattgtggctatcagcgctctgggacgcgaggaaaccacactcggaggatttgctccaccctgagaggtgcgcggtggcaaccagcgcaaggttctcttctaaggcgggttccaatcaactctaagtgtgttgactccagcgttccaaggacttggcttcctccatttgcggaaagtccagtgatccagctcttgcagcgtgcacccttcgatagctcagctggtagagcggaggactgtagattgtacagacatttgcggacatccttaggtcgctggttcgattccggctcgaaggaagtgcccgatgcttttgcatgcaatgccacctggtgcctggtcaaacgccctgcagcctccaactagtatccacccacaccctcccagtcaaaacccagagaaacctttcctgatcacctggtttccacacctgtgctgtggccaggaaacacgcccgtaagcccactcattcttcccacagtccagggacaggtactcttcaacgcaaagggccccttgcttctgctttgtgacccagtcagcccctctccccaacccccttcgcacccccaccatccagagctctttcacttttatccacagactgctctgggtgctgagggccatggactctagcaacattgtgtgctcaccattgatagatctctcgatctattaaaccagtgggcccaccatcaactcctagaagatcaagcctgctggaagagaaaagggtcagagacaactgtgacatcctcaggaaaaaaaaaaaatgctctctatgctgtctctctctcatctccttctccaggtctctagcaaatgcttttctatctgagcattctctctctctctctctgtttttctctgactcta

SEQ ID NO: 1717 - DNA, 1177 bp, Homo sapiens
gtgcagagcctagtacagaactggaatgcagtgtttgttgaatgaaggaatgaattaaactgcaaattaacgaatgcctgctctggcactgagactcgcagctgtgagaaaggtctctggaggcagacagttgctggtacgaagtcctgagtcaagcaggaaacaaaatgcggatgtcagcagtttcaagtgagacctgtggtgagctccttcctctgccggttttcccttcttaattttcagtctgaagtgagggagtggagaatctttctgtgttagactgtgtcgcgttgggcagatttctccaatcttaggatagtagtggtccctctcactggccttcactttgtaccatccccagcaagaacactgagtctgtgaaccgaattctagtagtcgggaaatggattgaaaggacatccaggttttacttagtttctatgctcagatgctggcagaagccctgcaaatcttttccttttctgtgaaaggaagaggcggtttctgcgtgaggccctatagctcaggggttagagcactggtcttgtaaaccaggggtcgcgagttcaaatctcgctggggccttgcgaaactactttcttgattcaggtgttttttgaaaaactccccttctagtctttctgaactaagtcacagaaaatgtggcaaattagagcttctttcctctgttcagagcttccaaacactagctcagcagaacgtttcctttaggttccagtagtaatgctgctttagctcctggaatgcggcggaatccattacacaggcggtggaaatcaccgtcagcctctgcccacgccctggcttgcggactggcggcgagagccctgctgactgccgggcgggaaatggggacagctaggcgagacaatagccctttaagctattctcaagccccgggtctgggcatatttggagtagagatcaaggttccacttctgaaacgggaagagccagcaatggccgctccggccaggcgtccagaagagagatgcacgttgtgaggcaaggtttcatgtgccagtggggttttgggaaattaagggcccgactttaggggcgagacttgggtcactaaatttgattttaacgcagagaaatgtggccttccttttgaatgagctgcaaatattatctccaaaagcgaattcacaca

SEQ ID NO: 1718 - DNA, 1321 bp, Homo sapiens
gtccctagtgccaaaaatgttggggaccactgctccattccacaccctctccctcccgtgtctgtggacgtgtaagcggaagagccgagattgggagggaagcgcaggaagtgaggacatcagggagcccgggcctaagcctggaggcccgccctctccggcgttcacagttgcgcagtcagaattgtgtgcgtcccaccgcctcagcccccagttctccgacgcccaggtgccggtccccaccctacacacaaacacacgcatccacgctcgcgaggcccctgggtccgcgcccagtgaggccaacagccctcgggcgcccagaggatgagcagcctcggtatgcccgagtttcaggggcgcctgctctgcttgggagcccctcagtgaggcaggggaatccagatttagaaaggttgtcctcagaacctcggacgcaggactgtcttacaagctggctttgtgactctgcagtaattactttccgggtataaagagatttctttctttcccgtctctggttaaggatgtctcgagtagggatttttaggagagttgtttccgtgcttccttcgatagctcagctggtagagcggaggactgtagtacttaatgtgtggtcatccttaggtcgctggttcgattccggctcgaaggagacgctgctgttttggggtttacggttgctcttcgtttgtgcaaaaaatctctgtatcttgacgtgatcaaatctgtttctgtctctcacccttgtccgaaggaaacagcttagccgcgaggtgggctgcgttaatcgcgtcttgaaaagttggttacctttctgaaagatagtagacccgaatcgtcccaccgttgggggaaggcactgttgtcttaccgaagtgtgttatattttggcttctacgttaagtccaaaggccggcagatatatacgtatcgcgcgtctgtcctggggctcagtaccctacagccttgcaaccgagctcagctctggccctcgatctctatttcagccccctccaggttccctccaggccctagcgggcttaaatcgctccccgggctcagtgagacacaagcatgtgacctaaagtctaaaaagctgccttccttcaccccatcctgcatctggatcgaggagaataagccagagaataagccacacttgaaacttggtgaagatggaaggaataactaaataaggcctaagggaaatgtcacaacagaggaaaagaaacaaaacaaaaaaccttcagaacagcaggcggaaaagagaaattcagagtgataggaagcaccactcagctacagtggctcgttg

SEQ ID NO: 1719 - DNA, 1164 bp, Homo sapiens
tgtaagctatccatattaatctagctaatgaatggcttgggacagaatttgacgtttgctatgctgtgtgtatatatacagaaccggtgaaactcaataaaagcaacgtgaatcaagattattgatggcagggaatagttagcatgacctgtaatgtgaaaaacagcagaaactggtgtcagagaatttaggcaaatctaatttgcttgagtacttagaggagggccacttggaattatgtccaaggaaattatattgccaatgatctgccagggagaatttttttttcctgagaatttagagtttagtgctgctgaaatagaatggaagaggaagaagttgactttctagagtatattcagaggctggagtctctgaaattattagcaaatacatacttaatgctgtgagtccctttaagttgcctaatactctgggcagttaacagtgattcagagtgagagtggagaatgttttatcaaggaatattgtttttagcatctgttcacctgtatacttttttttgctttacagttttcggctttgtgagaaaccttaccatcaaacacgatggccagcaacgttaccaacaagacagatcctcgctccatgaactcccgtgtattcattgggaatctcaacactcttgtggtcaagaaatctgatgtggaggcaatcttttcgaagtatggcaaaattgtgggctgctctgttcataagggctttgccttcgttcagtatgttaatgagagaaatgcccgggctgctgtagcaggagaggatggcagaatgattgctggccaggttttaggtaagtgaattttttcattgatgatgtaattcaggcctgagtttttctattcacgttttttttttgtctttatgtctgtaaaactgacagcatgagatattctggatattgcgactgtttagcctaataaaaatacattaggcttatagttataattggctaagtaaaggatattcttcattgtaccattttgtgtagtagagctaggacaactctactacaatcgtgagtagggggagctgggaatgacacttcacaatgtaaaaacgttgcctaaatggttgtgtcctgcccacagcagactggaggagccctctagtgttgattgcttgtctccccattgggatttcact

SEQ ID NO: 1720 - DNA, 1206 bp, Homo sapiens
atctttgcaatactcaaggttctcggaaatttgctaatggttgtgataaaccatacagcttgagccagtgaggcagattgggctggtgccttcgtctgagttttcctgctttcctgcctcgtgcagattctgaggtatatctgctgccttggaagacataagaagcagtgatactccctggctcggttattttctccatacaatgcacacatggtacaatgatagaaggcaaaattgccactgtcttcttttttttctcatatatctaaggaagatatatcaggttgtgcctcatgtaccgcttctagtgaaatgtagaggaaggctcaaaggagtcaacatttatatctggaagggacaagtcatgccttgggcctagaataccctgatgagaaaagagaagaggaagggaggccatatctacaacacagcctctcggcactgctgctccttattttaactttgtcttgcattgtcctgtatttatcacagtttctgttgaacagcttttcaagtatttggggagtttatcttgccatcctccccttctggttctctgcacccacctgtcccactgcagttccttccgtgctctgtgactttaagagaagaaggggggaggggtcccggattttatgtttgtttgttttttctccttagcagtaggacttgatattttcaattttggaagaactaaaagatgaataaactgggttttttttgttgtttgtttttgtaaattcacctgtgaccgttcattttcagttcttgaaagcaagcctgcttcctgcctggtaaagtgctaaggtactggagaaaaatgcctttagctagctagttttacaaatgaaactttcatcattctaaactttcatcattagattgagagacactagacatcacagtaaaccaaattcatgttatagcaagctaactttataagagactttttactatggttccctcagagacttttagattggaatagcacttgttccttcatgaaaacaaatcttcagtcatctccttgtaaatagcatggaggacagcagctgcttgaagggaaaccttcagccttcctattggggtagccagatcttcagggctaacaactgttgggaaagggaaaaaaacagcatcactcagttgaacactttgatacttggtatttgtcaggttaggtactggggatgctaaatgaatgaa

SEQ ID NO: 1721 - DNA, 1220 bp, Homo sapiens
taagccactgtaccaagcctccttcccagttttttatcatgagctggaagtgttgcttaaattacttaattagaaaatgtttaattcagccacttgaaagaataaggtaaataaaaaatatatatggaaaacatttccaggaaatatcattaaataaaaaagtaagtggcagaatagtacatacagtagattctgtttattaaaacaaaaaaaacttcagaactaagacaaaaaagcaaaaaatggaaacaaaatcttcttgcatttttgcactaacgggttgcttctagtgtgaattatattgcaccctgcagcctgagaatccagttttgatttcccagagcttcttgccactagtggacaggtttttctcagtggattcttggcctttcataaagcagttaagcaaattgatatatggtcagtacatagcataatcacattgtttgacagataatctccttatcatcttttggtctgatttttcatgaaaattttggagtagaatctaagtatatgaccatgagcaaataattttaaaagtcttctctgtgagagacctaactagtcactctaactactttttgctctacagaagagacgctcaaaccgccaagttaagcgaaaaaaatatacagaggacctggatataaagatcacagatgatgaagaagaagaagaggtggatgtaactggtccaataaaacctgagcctatcctccctgaaccagtgcaagaaccagatggcgagactttgccttccatgcagttctttgtggtaagctgtaaactcaaatgatttcagaggattgccttgctggtcacaatcatctgttgactgactgcatcttttgctgcaggagaatcccagtgaagaagatgcagccattgtagacaaagtgctttctatgcggattgtgaagaaggaggtgagggctttttattattattattatttttatttatttatttatttatttatttatttatttatttttgaaatagagtctaactgtgttacccaggctaaagtgcagtggctattcatagatatgatcgtagcacactatgaacttctgggcttgagctattcttctgcctcagcctcctgagtatctgggactaccattgtgcaccactgcgcctggcttttctctatcttaatattaacccgtaatgctatgttcacaggctttatttaatgagcacctttggatgtc

SEQ ID NO: 1722 - DNA, 1319 bp, Homo sapiens
ctcggaatttcattgagtttttttcttccttgcctttgggtgtctgcttgccacttcctaagaattcttgtagaaggcagtttcctctacttgcccaagagcactgagtacttctctactatcctattattagcttctatctcttagtgtaacttcaaaacttttaagagcagtgaagttggtcagggacatgtggccacttattattacctaaagaaaacatttgttccctgttcattttattttaggggccagatctaacattgtagtgtctttcaccagatagacttctactgtttcatcaaactcccttcttaactagacctagactttctactccaatcaggctaatctacttactgaatgtgacatatttattcctagttccatacctttgcacatgccctactctccactaattatacttaaaagtccaaaaattttttctttagtaacagacttaggtactgctaagcagttattaacacaatattccttagttttcatatgttggttattcatatgtctatttatatgtatatttatttttatgtatgttactatgtaaatatggtttgcagttgtttttgtgtggaatcttgtctttccgtataagttgtaagctccttgagagcaggatccatgtcattcctttatttttataaattattccccctatcattcctttacagtgcctagtgctactcattatgtgttcattgaatttgactgacatagttaaaaacttaaggtttattttagactttcaaggaaacaaaagactttagagtcctctctctgtaattctgccccactcatttgtttaccctgggttttatacagttctcttccttctcccctcccacctttccctggctttttgcctccattccatgaggcatacagtaaggctgcctgctagtaagcagtcacataagtgggtacctatccagccattctcttttcagagcatataatactatcttagccaaacttgcctttgcttcactcatcatgcagccttctgggttggttgctatatatatcttttttccttgatgtcccgttctcttccacagccctgaggtcttacgaatttttctactttctttttgctgttgatgaattgtttcattattaaatatatgcatgtatcaaagctattcatactccatgtgtcatttctaattgtatcccaaacattagtagatactctcctctcagggaattaaatcaaagataatgaagaagcctctttgggattcatgctatactcgattctgaccccagtagtagtagtaatagttgacagtgcacca

SEQ ID NO: 1723 - DNA, 1329 bp, Homo sapiens
ggtaatctagtgctaaagttggtcacagaatttcctgcacaaaatgaaagatctgtgtatgggaatgctagagaatttgacttctcagaaatatatagaccaacagtggttgccttttttcattttcacttctcttcattcttagatctacggaatccagaggcagcattgtctccaaccttccgtagtgacagcccagtgcctactgcacccacctctggtggccctaagcccagcacagcttcagcagttcctgaattagctacagatcctgagttagagaagaagttgctacaccacctctctgatctggccttaacattgcccactgatgctgtgtccatctgtcttgccatctccacggtaatgacctgacagagttaggatttaccacttattttcagttcacggtcagtgtcttattgcccatacctcccctcgttctctagccagatgctcctgccactcaagatggggtagaaagcctcctgcagaagtttgcagctcaggagttgattgaggtaaagcgaggtctcctacaagatgatgcacatcctactcttgtaacctatgctgaccattccaagctctctgccatgatgggtgctgtggcagaaaagaagggccctggggaggtagcagggactgtcacagggcagaagcggcgtgcagaacaggactcgactacagtagctgcctttgccagttcgttagtctctggtctgaactcttcagcatcggaaccagcaaaggagccagccaagaaatcaaggaaacatgctgcctcagatgttgatctggagatagagagccttctgaaccaacagtccactaaggaacaacagagcaagaaggtaggggtcatgtgaaaatactctcacaatatgctcttaattatagctttgtttgacagggatttacccctagggcaaggaactgtttacagcagtggttctcaactggggatgattccctactgcccaactcccaggggatctggtaatgtccggagacatttttattgtcacacacatgggggagtgctattggcatctagtgggggtagaggccagggatgttgtcaaacatcctacagtgcatagtgggacaaacccccacaacaaacagttgtctgtcccaaagtgtcaacaatgccaatgtcgacaaattcttatttagataatctgtcactgaatctgaaagaattggatcaagagaagaggaatccaaatatatagaaatatagggagatgaatggagaggaatactagaccaattatggaaattgactaaataatgtgaattggttctgagtataagtattggcct

SEQ ID NO: 1724 - DNA, 1217 bp, Homo sapiens
ctcacccctgcttctccgggatgactagtctgcccttctccgtccccgagttcggaccccgcattccgctcgtggaggtccggccctcacccctgcttggccacagcccctagtgtgtcagctatttcggggacgcaattcaggtccctcccgctggacacgcggctcccaccagcacccccgaccgccatcgccgccatctttctcctcgcgctgtccacgccgggattccttgatactagtagccaatcacaaagtcaaactagtgccccagaaggcgggacgagtcgccttaacaaccagagcgtctgccacagctcccgaacaggagggatggggagtggcttttcctgccaatccgcgggctgcacagtggcgtacggcatggatccaccaatctcagggtctggttcctgacgaacttcaatctcccagaatgcttagtctatctgaagaacgccgttgagagactacaccgcccatgaaaccctgcagtataaccttgaagtaccatcacggagagaaacagtgccatctcagggccagtggcgcaatggataacgcgtctgactacggatcagaagattccaggttcgactcctggctggctcggtggggttcctcgcagcttcgctgcgtgagcattttgtaattttcctttcctttcgcagcttgatgcttctttattatcttcacgctttcattatcagatcctgagtcggttgggttatgcagccatgtaatgtcagcttttcccgtaactaccctcaaaagtgtttttcttgtgtcattatttacgtccatatgaacactgagaaaactgggttaatggctggtgctattaaaatgagctttgtcaccttactatgttacatattaaaataaactgctaactcagctactacttcctagtgattctaggaagtagtgttttgtgtttcaaacacaaaaggtgtaaataaacgcctaaacacacacacacacctcaagatagagaaaaggaattcattaattacagtgggcagcagtcatgaaattggctggcatggaggccagagagaatctacattttctcatgtcattagctgctagagatggaaaggaaggaagcaaggaaagacatagggaggtaaatgggaactccagaaggcagggggcccactggtgttgagggctcggcagcaaggatggagaggagaacacggtacaagagaccc

SEQ ID NO: 1725 - DNA, 1174 bp, Homo sapiens
aaagtctaaggatctccttggggacaatctgcccttcataaaaaccttcctttatcaaagacacctttgagttctttttgctagcacttggctcaagagcctcatctccagtgggtctggtgctgcccttttccacagtgtggtgggggtctgggcagtcttgacatgacagtctgctgtccaagcatctcaaagccattgtcagtgggcatcagtctggccattgaagaaaggagggttaccttgttgaagttgccatccaaagttggttttccttgtttcctcgagttagcaaggaaggacctgggaggactagatgacccagtttggggcacagtttgtttggcttggtgtcctctcgactcagacggtgaaagagggggtatgaccaacatctttagggggctgagaggctactgaactcctcttccagcttatttctggttaagctaatacacaggtgtgatacggagtagatgacttttccctgctctgatgtttagttttatttttttctctaacttgcattgattctgcttcgtttttgccgtttgccgcttctgttttggtctctgtctgtctctgtgtctctctctgtctctctctctcactctatctgtgtctttggaggctaagctaagactgccccatctaacctccttcccccctctctgtggggtgtctctctttctcttttttttcccctttttcttcttcatacagagctcgctgcccaaatcattcaagaggaagatctccgttgtctgtaagtccagccccaaatccctgataaaagtcaggaataccataaaaaccagcattcattgagaaccagaatttcattctcaatggcattcttgggtcactccctcctgccccaccccttgtgcctagcaaatctgaatcctttcctatgtagggtttcattttggaattcaaaacttgagacaatccccatcatattgctccagtcacattttaatgagatacagtgtgaggtgtctgagaccatgtcccatttagccttagaggcatttattctttcagatacctgaatactcaacaaggaatgagtttcagggactcctatgtgatgcttagcagtttatgaattattctgggtattttgttgttgtttttttgagacggagtctccctctgtagtaccctaggc

SEQ ID NO: 1726 - DNA, 1341 bp, Homo sapiens
ttttcactcccacctctactgtttgcctgccttctattctctctattttctagaatcttccaatcaagcagctgtaactttacatgtcctccacccagccccctcccctgccccctgggaagaccaggagggagcactccagccctggggggttaagcctctgtagctgctgtaacttgagaaaagaaggccaggcctctggagccagcagtcggctccctgtggcctgccaaaggataagaaccttgctcactcagctccctccctcttttctttcccctcccctgctgcagcaaggccctcccccatccgcacacacaggctgctgggtaagtggcaagatggctcccctgcatgtctccggctgatcgctgccgctccgccaatacaatagagccagccactaccagcagcctggccctcttcctccttctccagagagaccaatccagccgaactcggggtttgccgtgaggacttaacgcttatctcttaaaagccagatctgttttagcctccccgcaccaccaccacctccccttccatttaccattttttggatccccggttgctacatctcaattttctctctctggatcgggtggctggggaggaggtggtgggatcttggaacaaggaaggtgtggttttttttctttattttttttaggattttttttgtttggtttttgttatttcttccattccagaaagggataaacagcacttccagggggagaaaaaaaatcatgttatcagaaagcaaagaagggtgagagcttcacatttccatgtatgccttttccccgccgccctagctcccttcgtcttccttctcttcctcatggctttcattccgtctttcgttttggtttgttttcagtcattctgccttccccctttgtcctgcctgcccagtttctaattggccccacatgccctttctgtatgggaaatagatattttttttgtataagccttttctctagatgtaagcagctaaatctcgtgtttctctgggggcctgtttagctgggggcacagttccgattttcccctccccctaacccccctagtgcatcccttcttgactgctctagggaggttcttctgacctctgagtgtcagtcagtcagcctgttgggaatgctgacttttctggtggtggttatcggcctgggaggcttggtttcccctctcctgagccttaggcctctgatcatcttgatttgattttttttgcttggtgtttgggtggtagagggggtgagatttgagatagaagttggggacgaagacagaaatcaaaggtggaaagatagtttatctgaagtgaatctc

SEQ ID NO: 1727 - DNA, 1178 bp, Homo sapiens
cttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggtttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgttttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataaaaattgtttggccttttgggtgtaaggattatttatcttcctattctctcttagatcgcagatggctattaattctgccttgtggtagaagtactggtgttgtggaagggaggttgccacttgtgaattaaggagtaggaattacattacaactagcaggaacattatgt

SEQ ID NO: 1728 - DNA, 1178 bp, Homo sapiens; identical to SEQ ID NO: 1727

SEQ ID NO: 1729 - DNA, 1202 bp, Homo sapiens
ggaaagagccttactaataaaattgattttgcttatgaattaaagcccctttttgcacatgtattgtacgactggagtcgttgggtttgggatatttttggtgagtggttggtgaaaagggaaattttttttggaagtgcaaaacatttgtattgttttctttgataatatatttttcccaaaaactaaaaattggttacgtcacaaaaagtattgagagacgaggctggtataatcaactctttcaacccatgttgccacaacttcctgtatgatttgttataatacaatacagattgagatattaacacatgaattttaggttttattagtgttatctgggctggccaccaggtggcataagtggttcaagaaacttgagcttggctgtaatcaaaagcaagatagaacctttccacatcagcaagattattcttatctccacttctctgaatgtttttcatttctttctgaaatagcatgaacataaggctgatctttggtcagttactgagggagtttgtagaaaatagtagagtgagtaagaaggctagagtgaagagtcagtatagtcttgtgtttttcagactctgacccccacccccccgccttcaactgagggtcattttaccagagtcaataaaggccaacccttctataaagagctggcaaaaaaaaaaaaaaaaaaaaaatgccagcagacaagcagaacattcctagcttaacagccaaacaaatgaaaatcccacagaaataattagccaaactcaagccaggagactggtgggcgttatacatctgagatcttgtattctaatgagagaataacctctgttggtgagatgtcccacaggccttggataatacagaaagtgaaaaaagggattaaaaaaagatagaagttgggtctgtagaattaattcattggagtttttaaaaaaggctttgggtctcatgaacatctgattttaatgtctagtattgctgggttatatcgatagacaaattaatttgggttatatgactaaaacctcgttgattctgaatttctgaatttggatttatactattcagcctgattggggcaggggtctttcactcagctgccgcttggtagaaagtagttaggagactggacctatggctgtcttaggctaattctgtgatcttgggcaaatcacttaatatccctggcctttaat

SEQ ID NO: 1730 - DNA, 1175 bp, Homo sapiens
ctagatactgggaatgttgaccagtgcttcagggctgtgggcctcaactcctccccaccctgcccaccctcaggtgtgagctgtcagtggagaagtccacagtgctgcagtctgagctggaatcctgtaaggagctgcaggagctggagcctgagaataaatgtgaggccccattccgtgagagtctgctcccagagcccgctgaggaaacccctttccagtgtggccctgagaggacagcaggaaggcctcaggaggatgggagcagaggaggttccaagagaaaccctccttttccctgccctctcctcagggtgcctgcttaccatcatcctgctgatgcgggcactggaccccctgctgtatgagaaggagaccctgcagtacttccagaccctcaaggcaagttctgtctgcagaacagaccagggggaggcccagcaggcaggaggcaggcagctgacatgcataccctgcccacctcatccactccaggccgtggaccccatgcgggcaacgtatctggatgacctgcgcagcaagttcttgctggagaatagcgtgctcaagatggagtatgccgaggtgcgtgtgctgcacctggctcacaaggtatgggctgccatgcatgccttcccctggccctcatcccgctggcctccccacgtccctgactttgcccccagtctcaggtgcctttgtggacttccaatcaagatagagttcatccctgcctcccagcttgctcctcttccaggcctttctgtcactcagcccattcttcttcttgccactcactttcaaatcccgagtcaccaggacctccttgtgctgtttcttccccaggctggtcacagcttcatcttccttcagagtgaccgctagcccactcctcccacacattccagcacatctcaccctggagcaacctccaatacctgaaggccaaatactttccagagattcctgagaagttgtccaggctccactttcctagtccttcccaacacattagttttatcacatcaccacagcccacctccattcctgccaaactcatctctgcctcatcaggaccagtccccatgggggaccagtctttgtttacccagcaccctccactggcccctgtacctccgaactccaggcctcctcctcctcacccaccccactgg

SEQ ID NO: 1731 - DNA, 1123 bp, Homo sapiens
tttgtgtgtctaaagtggaactgaatagtaggctgtgagaagataggaaagaggtagtgccaatctccttgcccagatcataaatccagactcagcagggtaaccacatgggcaagcacaaggtaggtgcttggggaaaggggaagtaattggcattctgtgtgataccaaggagaccatttggattttggcttctaccaaagagaatggagaattggttgacctaaatggaaccagtccctttaagtaaggggaggaaagggggtgctggaagatggccctcttcccaccacctagatcatagcttgaactgaagccaaggacagagtgctgcccccttcggcatttactgatgtgccctctttaaatcatgatgttatctaacccaaacccagacccaggacctagtcacagctccaacctacacttcctattaatcttaaaacaaagcaaaacaaaacaaaaagatatcagcattgtagcctccaatctgagcccatttcccttctctggctaccatacctccttctcctatatgataccattcactactttgttcaattatccagtctagacctgcatcttgaggccacacccagccttctcactccccacacccctctttcctctctcactgctccttcctggtctcttctcatctggccccacctctaaggagtcctcctgccttctgggttgccctggaaaacagactatcccccctcctagtgaagggagtgggtaggggtttcagccccaccctcaggaagatgcgtcttccctgtcctctgctctgtggtacttcctctctggctgatttagcaaacagcacctagacctggggccaggcctttggcagtgggacagatccagggataggctacaccaccctgccctgaccctgggattggcatcagcttccaaccagttcctgccaaagcttgtaagtaagtttcctgggagcggccgtggttgtggtggtggtgggacagtgtgcagccatgaaagaaggtgcaaaggaatctccaaagaaagcctgaccagcgtaaaaagttgggaggctttgtccttgtcacttgtccactaaactcctcccctccctgttattcctggttgaccctgg

SEQ ID NO: 1732 - DNA, 1213 bp, Homo sapiens
gtgttggagatgactctgctgcctgagaacaacatggcggccaagtaagtcccatgcaacttcccctcagtccgcaggctttgtactagctttctccactgggcctatgctagcccacttcttccttttcccagaagaggtagacatttttcctaggagctggcttcaggcctacccaccatctggaagaggacttttggggttgggggtaccccagagaggccatctctgggttagaaaatagcctcctaggcactcatcgaaagtcattcaaggctttggatggagggcgggaacttccctctttagggatgtatcaccattttggcttcagctaggagggcttgccatccatcctttgcctccagcattgactgcgcgggaatcctgaagcttcggaattcagacattgagcttcggaagggtgagacggacatcgggcgcaaaaacacacgtgtacggctggtgttccgggtacacgtgccccagggcggcgggaaggtcgtctcagtacaggcagcatcggtgcccatcgagtgctgtgagcaaagaggccctgggccatgtctctgtctcttgcaactcttttgtctgtgtgtgtgtgtctgtctgcccattccctctgcagcgtcctgtgccctgtctgtcctgggtagctctatagaggactcagcttctttctattctagtttgcccctgccacagactctgtctctggggtggcccagagtgacactggaccctatctattcctggggtgccctgtgcccttgtttgggaaactccctggtctaccctgtttaaccctctctctgctctgggagcggccccttacatggtgtatgtgactccatggatattactggtttatttgtgtgtctactgctgaggagggctccctcagagccctgtggcagttttcccaaagagggtggggacagaggaggccacccctccatgcccagcccagccagtcctcttccttgcactgctctgcagcccagcgctcagcccaggagctgccccaggtggaggcctacagccccagtgcctgctctgtgagaggaggcgaggaactggtactgactggctccaacttcctgccagactccaaggtggtgttcattgagaggggtcctggtgagtacctgctggggaggggagggcaggcagggagagcttgggagtggcaggtgaaacatctctggcattg

SEQ ID NO: 1733 - DNA, 1220 bp, Homo sapiens
ctggtgtcagatgggatggcgccggaagagggtgccacagcggggacggaaggcgcccccaccccaactccacgggaatataaacaatttgtattttccgatcaggtggcgggacaggcttcattgggacagccctaacccagctgctgaatgccagaggccacgaagtgacgttggtctcccgaaagcccgggcccggccggatcacgtgggtaagtccatcctctggaagcgggtgggagggcagagttgggcggcgcagggcggggcaggggcactgtgtgctttctccgacaggatgagctcgctgcatcggggctgccgagctgcgatgccgccgtcaacctggccggagagaacatcctcaaccctctccgaaggtcagcccgggccctaaagctgatacccactagagcacagggaggacagtgccccactgatgagaacctgtgagctatgggtaatggagctcccagattccgaactaaaccgatatcccagactactcattctgctccactcctccacccccacctgctcctccacccagtcagccaattggcttaagtcctcacgtataactcaggatgcccaggaaatgaatgccctttccctctacaggagacgttgactgtttctcttaagccgaaattcagggctttacaagaaattggtatgaaatagctcccaggaaaagacagagagagggatatgtgcacttatgtatttagtggctttttatttcccatgtttctcctgcagatggaatgaaaccttccaaaaagaggtaatcggcagccgcctagagaccacccaattgctggctaaagccatcaccaaagccccacaaccccccaaggcctgggtcttagtcacaggtgtaggtacgccccccaaatcaccagccccttatattcgccaggggaacggggtaactcagacctctgtagctatgcacacaccagagcactggtcttttccaggcaaaatgacttcctaggcccttgatccatgcatgtttctcctaacctttgtgtactttcactaagaaattgagaccctgaaaaaacagtggggagtggcatcactcaatgccagggaaaagtccacctatcccaaagtcccttacttctcacaccatagttctttaggaacagagttcctggtcacctttgggaccaagtaattgcaaacaattatacacaccagccactatttga

SEQ ID NO: 1734 - DNA, 1183 bp, Homo sapiens
ggaagagaaaaaaggttgaagttttgtccaccagaacttataagttttagtggtcattcaccttctacaactaaagatacttccccttctatagctagagatacaggagtaagtaataaatggttgcttcttatatcgttgccacagtcataaaccttatatatttgctcgataaagttggtgttggaagttttcccagtaagaacacctaatgaacaaccagttctttacttaaaattatctaagatatttggtctcaggaggtgatgaagggtaaacagtgtttatttagcattaactttgtaccaggcactttacatatattatctcattcccctcctatctaaaccatatgttagatactgtcacaaatattttagtgtttaaaagcctgagacaacaaaggcagagaaagttaagacaatttgtccaaggtcacatagatggaaagagggtataggcagggtagggatccagctaggacttaactcagagcctgagtagcaggctacatatgtccagcagtaaaaacaagacgcagacaaacaaaagcagacacattcatacactagtaatttataatcagccacactggaactgggaaatattctctgacagaaagaaccccatccatgtttcaacacatatttctcttgtctatctgccatattgaaaggtgacaacgtgctagcaaccctccctggggataaccaaggcagagccagctccctctgctagtagggaggtgtggagggagaggcacaggcgggagctgggactgcacgggacggcgcttacgggccggcacaggttcccggtgggtgcgggctctgagggccctgcactcgatgcagcaggcagacgcctgctgggcttgatcgggtgtcaagctccctctgggctgccagagtgcccgggctaggtgccgcaaagtcccgcagaaagtgccactgagaggtgaaggcagctgggcttctgggtcgggtggggacttggagaacttttctgtctagctaaaggattgtaaacacaccaatcagcactgtgtctagctagaggtttgtaaatgtaccaatcagccctctgtgtctaaaggtttgtaaacacaccaatcagcgctctgtgtccagctaatctggtggggactcaaagaacttttgtgtctagctaaaggattgtaaat

SEQ ID NO: 1735 - DNA, 1270 bp, Homo sapiens
ccgggatgcaggaggagagcctgcagggctcctgggtagaattgcactttagcaataatgggaaagggggcagtgttccagcctcggtttctatttataatggtgacatggaaaaaatactgctggacgcacagcatgagtctggacggagtagctccaagagttctcactgtgacagcccacctcgctcacagacaccacaagataccaacagagcttctgaaacagatacccatagcattggagagaaaaacagctcacagtctgaggaagatgatattgagagaaggaaggaagttgaaagcatcttgaagaaaaactcagattggatatgggttggtcaagtcggccggaaaatattccccccaaggagttcctctttaaacacccgaagcgcacggccaccctcagcatgaggaacacgagcgtcatgaagaaagggggcatattctctgcagaatttctgaaagttttctttccatctctgctgctctctcatttgctggccatcggattggggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaattaagtaaaataaaagaatagacactaaaatcatgttgatctataattctacctatgggatcaataagcatgtcagactgattaatgtctactgtaaaaaatttggtagtaaattttcatttgatattagatataaatatctgaatataaataattttaatatactagtcatggtgtattgtattttaaaaattatctgcaaccttaattcagttgaagtactttatatttcaaaagaatgaataacattgataataaaatcgctactttaaggggtttgtccaaaataaatattgtggccttatatatcacactattgtagaaagcattatttaatttaaatggatgcaggttgtctactaaagaaagattatacataactatgctaattgttcataatcaacagaaaccaagatagagctacaaactcagccgtacagttcgtacactaaactcttgttgcttttgcattataaggaattaagtctccgattattaggtgatcaccctggatgatcagttttgtgctgaaggcacctgctcagtatcttttcgtctttatcactctgca

SEQ ID NO: 1736 - DNA, 1175 bp, Homo sapiens
tggtcttgaaggatattccatccaggttatgggaaaatcttattgagtcacctgataagattcttttccttggataatttgatgtaaacactggtggattcctcaggttccaatcttttatctgttgctccaactgactgaattacagttctcctttacatcttccattctgatagtatcattctaaagatgtcactttgttaccttgttttaaatttagcaacttcctatccttgtcaattaacttgtaaagtaatccaggtctagaaaaccacatttagatctatctaatccatctactgtggtgcaaaaatctttggatggctgttctcatacatcatgtgtttgcttttgagcctttatagtctcataatgtgctttttatctgaacttacacaagaattattaaattgccttgtgcattagatgtattgtcttcttcctttcttaatctatttgtattatggttattggcaaactggccttatttactatcaggtctaaatttcttaaaagctgggactattacttattcttgtttgttttttctgtagtctcaagtagagtcacatcttttttttttcagaaatgtagctttacattcttcatttatttattaattctctccttccctctttcccaccctctctcccttcctttcttccttcgctcctttcttccttcctttcacaggcatttatgaaacatatactatttgccaggaatgtattaatgtctgagattacaggtataaaagatgtagacccaggccgggcctggtggctcatgcctgtaatcccagcactttgggaggctgaggcgggtggatcacctgaggtcaggagtttgagaccagcctgaccaacatggagaaaccccgtctctactaaaaatacaaaattagccaggtgtgttggcgcatgcctgtgatcccagctactggggatgctgaggcaggagaaacgcttgaacctgggaggcggaggttgcgatgagccgagattgtgccattgcactccagcctgggcaacaagagcgaaactccatctaaaaaaaaaaacacgtagaccctaatagcatagttactgccactcattgattgccttaagctcttcatgtaattcatataagaccaccaaaacctaagtgttaatactccccacttgttttttgtt

SEQ ID NO: 1737 - DNA, 1400 bp, Homo sapiens
gatatgcccccacctctggggtagggatgatatctagttacctctcttgccactcacacacacggggagctaaatctgtttctaaacagagaaggcatagtcatacccaacaaaaaggctggagccctacactacagcccacacttgtagtcatggagaaaatatgaatatggactggcatacaccacataacacagtggggaaacatggagctgggaacagatgacagagaatataaatatgagccaggtagatctggattctgttgaactgcacaatacctgaggtgtttgagcaagcttattttaggaaatattcctcaccttgaaatttactgaatgtttcttccatatcagacacactgacacagcaatctccctgtaagcatagtcatctctaagtagaaaggaaaatttattttctccctcttagtcatattttgtctgatgtttatattctttgtatgtgcatatacatacaaaatatttgtttatattctttgtatgtgcatatgagtgtgataagttagttttggtttttacattagagatatttagagaagcagataatctttttcttcctttagtaaatcgattgggcgggtgtgtgcgtgtttgtgtgtaagaaggcaggccctgtggacattgctagtggttgaaactagaataataacaaaatgtaagttctgcttttctttgtgtcctcagcaaatgggaaataaagcgctgtcagtgttgtggttccagtggcacacatttagcctgctcctcattacggtcatgggagcaaaattgggagtgtttggaatgtaggggtattatctacaattcaggtaatttttttgtaattttgaataaagtttttattcaaatgtatatgatttaaaagtttttacctatatctctattatgctaacatggaaatttaaatctgtaggagagttccaaaaagccaaaaaacatgtattacccaattctaataatgtggggattacagattgtttgttggaagagtcatcacctaaattacccagacagtcacctggatcccagagtaaagatctactgaggtatgtattttgaattggagaaatacataaaaatctatttggagaaaattatgataggaaatgccatatacatttagaatattaggtgatcatacagtagtctagaagaatgtttttcagccttcaggacccaacatttgatcatgaaatcaatgcaaccagcattttaaagaaaatgaaatgggatagaatagaatacaaaataccaaactgcatcatacgtgggaaaagtgtatctatcctactgcatcatacgtgggaaaagtgtatctatcctaattatttttttgtgtactgagtaatgatgtaaaatatattttttattatagat

SEQ ID NO: 1738 - DNA, 1211 bp, Homo sapiens
ggtctccctgtgttatccaggctggtcttgaactcctgagctcaagcattctgcccacctcagcctctcaaagtgctgggattataggcatgaaccactatgccctccctactttactttttcatttcacatgttgagagatcattccaaacctgctaatagagagcatccttacttttttttttttttttgagacggagttttgctcttattgcccagggtagagtgcagtggcacaatctcagctcactgcaacctctgccttcaggtttcaagtgattcttctgcctcagcctcccaagtcactgggattacaggcgcccaccaccacacccatctcatttttttgtatttttagtagagacggggtttcaccatgttgctcaggctggtctctaactgctgacctcgtgatccacccgcctcggtctcccaaattgctgggataacaggcgtgagccaccgcgcctgaccctacatcctcacttctttttaacagctgcatagtattttgtgtagataggccaaagttgatccacctaatccactattgctggacagttgtgttaaattttcataaaacgtttgtagctgtgttctttcttaaatgtgtgagcagtcagtcttgctgcctcaaactctgttgtgtttcctttttgttgctgttgttaagagttgttagcagttgtggaaagtttaaaattttgtgtgacactttatttcatggcttgcatttaaatctgaacttaggatgtttttgctttgaaagctgttaactggggcttgcttttatttaagttatctttcactgaaatcctggagaatagagaatgagaaagaaaacaaagataataggatgaagtgggttgaaagagaaataatatgagagagtaacaatggataagggtaacaatatgacactgatagatatctcagataacaaaaacatttcacagtggcctggaatagtatttgttgtgttgcttttttgttttcttttttttgagacagagtctcgctccgtcgcccatgctggagcgcagttgcgcgatctcggctcactgcaacctccggctcctggattcaagcgattcttctgcttcagcctcccaagtagctgggattacaggcgcctgccaccatgcccaactaatttttttttatttttggtagagacagggtttcaccatgttggtcaggctggtctccga

SEQ ID NO: 1739 - DNA, 1164 bp, Homo sapiens
gtgcagtggtgtgatctcggctcactgcaacctccactcccaggttcaagtgattctcctgcctcaacctcctgagtagctgggactacaggcgggcatcatcatgtccagctaatttttgcatttttggtagagacggggttcactgtgttacccaggctggtctcaactcctgacctcaagtgatctacccgcctcggcctcccaaagtgttgggattacagacatgagccactgctcctggcctcatttataaaattaaaatgtttccgaagtattcatacagttagtattattttcatgtaaaaatgagagagctctctatcatacacatgtattctgttctagcactctttcagtaacgtaggtgtaattatttccattacaaaagaaacagaaaacaggctgggtgcagtggctcatgcctgtagtaatcccagcacttcaggagtctgagacgggcagatcacttgagatcaggagtttgagaccagcctagccaacatggtgaaacctgccgtctctactaaaaatacaaaaattatccagatgtggtgttgggcacctataatcccagctactcgggaggctgacgaaggagaattgcttgaacctgggaggcggaggttgcagtgagctgagatcacgccactgcactccagcctgggcaacagagcaagactccatctcaaaaaaagaaaaaaaaagaaacagaaagcaaaaatgtcgacgcctagagagtcttaagtagctgacatcctttagctaatatatggcagagaggtttggatttcatgtagccttgtttcctagtgtagtggcctttcttggactgcttgttttagtataattgtttttcacccatcttccaaatttttagggacccctcattcagagctcttggaagaagtcgaatgtactccgtcacctcgattagctctcactttgaaagtaacaggtcttggaacgactcgtgaagttgaattaccactcaccaatttcagatcaaccatcttttactatgtacaaaaattgcttcaattgtcctgtaatggcaatgtgaaatcagataaacttaggcgtatttgggagcccacatacacgtaagaaattttaacttaatgttttggtagataatgtcctagtgtagagccaagaagcatt

SEQ ID NO: 1740 - DNA, 1186 bp, Homo sapiens
tccataaaaaatgtagaaatcttcaaaaacaggaagaaagtatttgtcattctgacttaagattgacttcataaagttgtcttatgaattctcaaatggttcttcatcataataggatgaaatatgcctatcatatccaaaccacatgttattttatagtgattaaatcctgtgtgcttccatatctgtctttgtgagttcactttaaatacatgcataagattgtagtgaatttaaaacactgaggaggtccaccctgactcttgtggatggtctgacactatctaacacatgattttttatatcatgattttcagtaaagaaatatatgactctaagaatcatattctactcgtttgagttgtaagcaaagtaagtccatctattattaatagtattagcttgtacttccctctattccagcaggctaagtaagtcaatgtggtgggattctcttaagcctcacctcatatttattacatagattcagatatttccaatcaaagcatatatcacttgagaatataataaccagttaaatctgcaaaatctgaaatagcatggttaacatagagatgtgtagaatcttcctcaattcaccttcagtataattggacagagagggcaagaaacctgtcaaagcttaacatctcctatacatcattagagatacttgattgataacctgttttaggatatttgagtttccagcatgccattaattcattgtctcgttttaattctacttactgtttctacattgtatttatctacatactgatatttgtatgccaacagcattaactgaaatctcaattatagccagtagagggaggtatgtggaaacataataaattgtagcattacctctcaggcctgttattccaaaattgcctatttactctgtcactagctggaggcctagatagctagatagtgatttcgagtggaatgaagtgccctggaaagtttccttacaagcagtcaataaagactgctggctaaacagcaaagtcctatttgtaatagagaaaactagaggtatttaaaaataaatgttagttaagtgaaaattgatgatgcttaatgcctagcttaggaattcatttgggtgttcgccttggcaggtttttaccagattaattccatgatttgtagagaggggtaaccatatgaatacttacta

SEQ ID NO: 1741 - DNA, 1219 bp, Homo sapiens
ttttaataaaattccttattatccttttagtgccttctagcatctgtagtgacgtctttcttccctgatattactaaattgtgtcttttttgttgtggttgaggtttatcaattttattgatcacttcaaaggactagcttttgcttttattgattttcctttttttttccattttttaatttattgaattctacttgtttctttcttctttggtttttctgaagtttcttaaaatagaaatctagattactgtgttagaccagttttcttttctagtgtaaatatttaatggtccagattttcctctaagcattgttttagctgtattccatatagatatgctgtgttccatttttgtttaattcaaaatactttgtaatttccttttttttttttttaaattaactcatcggttattagatttctaaatatttggtggttttccacatcttttttgttcatttctagtttaattattttgcatttgaaaaacaaggagtttgattccaggttaagtttattgaagagtttaatgagaccttgaactgaatgtttattatagtgtgaagggttctataaatgtcagatcaaattctttgagtgtgttggtcaagtcctgtatgtcctattttatatcctatttttcttgtttaacttttgtaaaattaaagaatactgttgaaatctgcaatcatgattgtagattgtgtgtttctcctttcagttctattagattttacatcatgtattttgaagatcttttaatttcatacacatttaggattatgtcttttttttttttttttttttggagacagggttctctctctaacacccaggctgaagtgcagaggtgtaacttcagctagttgcaacctccacctccccggctcaggcaatcctcccacctcagcctcccaaatagctgggactgccaccacacccagccaccttttttggttttggtagaaacagggttttgccattttccccagcctcgtctcaaactcctgagctcaagcaatcttcccacatatgtttgttctgaagtctactttgcctagtattaatatagccaatgttttttcctttgagtagtgtttgtgatatatctttttctttacttatgcttttatgtatcttcatttctaatgtggtatacatctttatagattaccttcaagtgatataccactttaatgtgttttataagaacct

SEQ ID NO: 1742 - DNA, 1197 bp, Homo sapiens
attcaatggaagattgcagaaataaacaataagttttaaattatgcgctgttctgcatagtgcagtgaaatctctcaccattactgttctgtcctgcctgggatgtgtatcattcctttgtccagcatatccatgctgtatatgctaccagcttgttaagtcacttaatagccgtcttggttttcagatcaactatctcgctatcataatgcccatgttcaaataacctttattttacttaataatgactccaaagctcaagattagtgatgctggcatattgttacaattgttctgttttattattagttattgttaatctcttattgtgtctaatctataaattaaactttatcacaggtatatatgtataggaaaaaacatagtatatgtagggtttggtgctatccatggtttcaggcatccactgggggtcttggaacatattccctgataatgagggggactattgcagtttgaattaataaggcatacagtttcttctccacgagcacataccggtcagtaattgaattcctgagttggctttaagatttggtgaagataaaggacagactttgttttcctcataagccaccagccatatttttctctgttcttcagccatggggcatgctccaaactcttccagccatcttgcagtggtgtgctttgagtcacaagggtaagtagggagagaatgtggaacctttattttattttcagatttttttttggagacagggttttactctgttgttcaggctagattgcagtagtgcaatcattactccctgcagccttgaaattctaggctcaaacgatcctcccacttcagcctcccaagtggttaggactgcaggtgcacatcaccccacctggctagtagagcctttagaatggggtctcaaactggctaatacatgagctaaacctagcctgcagcttgttttgtatggctgctgggcaggctttatgggtgtgcaacctgtgtagttgcatagggccctgcactgagaagggcccacacttagtttaatactctgctgtaaccatcttggaattcttaataattttttaataagaggctccacatttttattttacagtggaccttatgtagccagtcccatatggcccttttggtgcccccactgatactgcctgagccctgtagatgtttgagtttcagactcc

SEQ ID NO: 1743 - DNA, 1233 bp, Homo sapiens
ggggacctcaatgccatttcttgagttttagaggagaaatgatttgtttaatacgtggcagagctaagaccagaacctcagtttcctagcctcaggctggtgtttacttgtgttatttcagtgtctctgatgcattggtttaataggaactggtttatcctgctttgtgggggttcagctccacccttcaatgagctccctgaaaagaacaaagtccacattattgttacttgttttggttttagggggcatgattgtcactggcaaggtgtgaagtgtacgtaaattctgaaaacattttgtgctcatatatgcaggggtggggagagattaaaatggggtctgttagggtgggtggagggatatggatgatgcctataatgaaagctccagttgcaaaaattgattcaacttatggtaatgggtgctgatggaattaatggggttttatgaatattccatgctttgatctgcttggcattagggagatctgcaaggagcaaatttgaaatgataaaaagctctagactacttttttggtgcttcacctgtcatgatgctgtcgctggtcttgcttggccttcaccttcaataagaaactccatcttgcctcatgacactctgaaaaaaaaaagggtagatgtaagagacattttttttagagagaaaagccgcatccattatgcagattggaagcatttacttaaatgtttactctgattcaagctttgaagccccagaattcaggtcccatagccataaaaggagaggaattcttcccctttatcttttgatggcattggtttgaacagaagttctgtttttactaagattgttattttttatttgcaactaaatgtctctgttttttatttttatttctttttttttttttaatttccacaggttattggggaacaggtagtgtttggatacatgagtaagttctttagtggtaatttgtgagattttgttgcacccatcaccctagcagtatacactgcaccctatttgtagtcttttatccctcacccccttcccaccctttcccccgagtccccaaagtccattgtgtcattcttatgcctttgcatcgtcatagctttgcactcacttatgagtgagaacatacaatgttttgttttccattcctgagttacttcacttagaattatagcctccaatctcatccaggttgctacgaatgccattaattcattcctttttatggct

SEQ ID NO: 1744 - DNA, 1128 bp, Homo sapiens
tcaaagcagtttatttatttattactgttggcatttctttccaaacctggaatttaagaaccagaatgcatattttggatttagactctgaatatagtttgctttgatttcctgcaccatttatttgtagctgcagtttagtctcactctttagggctcgcaaggtcatgccttgtaaaatatatacttgaatgcatatttaatagaagtctctcagtagaagcaagtatatcttgactgacataacacatcctaaaattaatttaaacaatgctgggttaaaatgaaactctttaaatcagaggttgaatgtagagtgcactattagaatctagtatagatttgacacctaaaatctaatatagattttacacactaaaatgctacagttatcaatgatgttaagatttttctgttatgttgcaatagtgatagtgtcctataaataactaggtgatgccttttttgggggatggagaaataaattatgaaatgaaatatagtgccttagtagatatttgcctttaatgtttttgagttaccatggtttagcgacaagtagtttcaatttttttttcaaataggtgagaactgcaaccaactgacatccaatattatagaaccttatgattttaaacttaagataaaaaaatcttatttcaaatttcacgttattgaattaactcaggttagaaatgcaattgtttgacataagccagtcttgaattactatcagctgttgtatttatatttttccacttcaacttctagaatcatttaaaactatctgatagtttggaacatcaatttgagattgaatcctcattttagcttggtggaaagaactgaatgagaaaactggatttttttccctacttgtcaggaggcttactctgaagtagtttgaatttcataaatccattaatgattagtaagcttcacccagaactaatctgtggccagctacaggcttttggaaagaggcatactttctacagcttaaacattacattcaacttaatcatcaatcctagaaacctaaaatttagagaaatttgcctctgcctgtctgaaaatttgtctctgagttagaagtcctgaacagaggaagacttcagattgatttct

SEQ ID NO: 1745 - DNA, 1104 bp, Homo sapiens
cttgagactagagactccccaactcctcaactcctccaaagactggagacagcacgaattagaattcatatgtatattttactaatatatccttaaggttggcatcttttacaaagctattttgtttgtcttctctgtaacttgctgtgagcaccattgacaagggagtagtaagtaaggtaagaatagtaaaaacaaaatactaagaggtggcatatgaaaaagattaattggggatgatgaattataggaaaatcatgatttaaaggaggctcagttaagagttaagtagaaaaggggtctcaagatgccagtggataatctagtaagtttttaagctaagtaattaaattttttcaaccaatagcagaaaatcatcaggaaaagtatttagaaataactgaaaacctctttcccttttaaaattaagttacgctgttgtttttctgtggatttttttttttttttttgacagggtctggccctgttgcccagactgtgcagtggtacaatcagaactcactgcagcctcaatctctcagcctcaagcagtcatcccgcctcagcctcctgagtagctgggactataggcatgtgccaccacacctggctgatttatttatttttttaacttttagtatagatgaggtctggctatgttgctcctgagctcaaacaataatcccacctcggcttcccaaagtgctagggttatagatgtgagccactgcacctggccttttctgtggatcttataaatcaaccacactgtcctatgaagtgtgaaataacaacataatttaccttttaaagggatgtacctgtaccagtcttgctgctatacagtagtcatatatttgagttccttttttataccagacactgatttaggtgttatggattaatggctccccgactcacaaagccagacatacttgctgcttctcaaatatgccaggcatgatccctgcctcagggcctttgcattactcttctctttgtctggaatttatttccccagatatcaacgtggtgagttcttttacttcttcatgtcttcctccatatcactttcattgaagccttctgtcctatctgaaattt

SEQ ID NO: 1746 - DNA, 1391 bp, Homo sapiens
atgccacacaagggaggctgggaaagtgattgtcttgcatttgtgcttcaagacagtgcatcccctaaacataggaaatgggttcaggtgacaaatgtcccaagatgtcaacagcggtttttgctgggtggttgtcttctatggtgttttaaaaaaagtattatttagaagttcaaatatacacaaatgtagacacaatattaaaatagatatcatctctagcttcgttatcagctcacgggcaattgtgatattgtgaaatatatatttgggccttctctcaccaggcatcctcgtggaagtgacatcgtgttggcctgcgtggccatccctgacacaccgccgtgatgcccagggaagacagggcgacctggaagtctaactacttccttaagatcatccagcttttggataattatctgaaatgtttcatcatgggagcagacactgtgggctccaagcagacacagtagatccacctgtccctccaagggaaggccgtggtgccaatgggcaggaaccccatgatgcgcaaggccacccaaggacaactggaaaacagcccagctctggagaaactgttgcctcctctgcaggggaatgtgggctttgcgttcaccaaggaggacctcactgaggtcagggatctgctgctggccaataaggtgccagctgccacccgtgctggtgccattggcccatgtgaagtcactgtaccagcccagaacactggtctgggacccgagaagatttcttttttccaggctttaggcattaccactaaaatctccaggggcaccactgaaatcctgagtgatgtgcagctgatcaagactggagacagagtgggagccagcgaagccacactgctgaacacgccgaacatctctcccttctcctttgggctggtcatccagcaggtgttcaacaatggtagtatctacaaccctgaagtgcttgacatcacagaagaaactctgtattctggcttcctggagggtgtccgcaatgttgccagtgtgtctgcaaactggctacccacctgttgcatcagtacccccttctatcatcagtgggtacaaaggatgcctggctctatctgtggagactgattacaccttcccgcctgctgaaaagatcaagaccttcttggctgatccatctgcctttgtggctgctgcccctgtggccactaccgccacggctgctcctgctgctgcggcagccccaactaagtttgaaaacgaggagtcggaggagttggatgaggatatgggatttggtctctttgactaaccaccaaaaagcaaccaactcagccagctttatttgcaaaataagcaaataaaggcttacatttttttaaaaaaaagtatgcatatatttggtct

SEQ ID NO: 1747 - DNA, 1250 bp, Homo sapiens
atggatttataaatgtgtagtaataatataaaaatattttttgaaatgattaataccaaagcctagataatggtttcctctggggaagaaaggaacaatatgatttgggcctcagtgatacctgtacagttaagtaaaacattggagataatgcaggtaagtgaaataaacatggaactacgtgtagatttattcatactgagtggtggtcctctgcaggtttgttcatgttattttcagtattttattataggtttgaaatatttcataatttaaaagaaaaaaggaaatattaatgacttttcaaaacttagaaaattagtataatggaaatattcattaggaaatattacagttaaggatgttcatgtggttaactaaatgaaaattttctatagtggatttcatttggatagtgataaaagtattttattttattcttagtctaaataagagatttataatagattgttgtgttaaatgcaatttcgggcctaggttttgttaataaaataaatcatgtttaattgcaataaagcatgtgttgaaaaggtgattctttttatatgcccttctgatcccaagtatggcagaaggatataaaggtcaccaagaataatttggaggttgccaaggacttatttaaaagtgttttcaagtccgaccgagaactctgacatttacaaatagataagatgtgaatatttaaaatcatattttcttttcaggattgattttaaagaagctacttcacacaggaaactccttaaaggtacaactatgtttactttccatgactttaaaaatactgagtagaacatacatcccacctgttaacacttttcctacctaagctttttcctaaagatctctgaattgtcttcagtttatttaattgaagtgagttcccttaaaatgtagcaagaggctgggtgcagtggctcacgcctgtaatctctgcactttgggaggctgaggtgggtggaccacttgaagccaggagtttgagaccagcctggccaacatagtgaaaccctgtctctactaaaaatacaaaaattagccgggcgtggtggcacgtgcctgtactcacagctacttgggcagctgaagcaggagaattgcttgaaccctggaggcagaggttgcagtgagctgagatcaagccgatgcactccagcctgggcgacagagtgagactgtatcttaaaaacaaaaacaaaaacaaaaaaaaaacgtagcaagagttt

SEQ ID NO: 1748 - DNA, 1162 bp, Homo sapiens
ttcattttgaagtttttctttagatactcataccctctgactaaattgcttgaatagataaattgtcatcactaagatacatgtaatttggggccttttgatgcttcagtaacaaaacaaaaatcagtttttcatgtatcataattcctttaagtctttattgaactaattcatcttaaagcaaattgaaaaacataactgagaactatacttggttagattggaaaagaacatatttgcttgtagtttggcactgtaattatattttttaatacacaatgtccctgagggttttacattagaaataatccccagggaatgtactttaagacatgaatgcatacaagtatacagaaaatattattaacacataaatataatgtcttcagttttaaacaaattaattttgtccctgctttaaaaaatatcttttcttgtgtatgatgtcacaaaatgacattagaagtacaatatttaatattaaagctgaaaaataaaaatcaggctgttggaagatagttatctcaattgattgttcatagttacagatggaactccttgttctactctttcccccttctcactactgcacttgactagtctttaaataaataagtacaaaaactacctcaaactcattcctttaaggtaaataaaaaagaaaaatatataatataattatatagtatatgtaaaaaaaaaaaaaaaactaagaccagcctggccaacatggtgaaaacccgtctctactaaatatacaaaaattagctgggcatgatggcacatgcctgtaaacccagctactcaggagtctgatgaacccaggagccagaggttgcagtgagacaagatacagccactgcacttcagcctgggcgacacagcaaaactccatctcaaaaaacaaaaactagatgagggtgatatcaagtaagaataccagcatgctgcaggaaaaataaagaatgctacctcatttcagatagaaacaaaaatatgtctccagagtttagctcttcctactacagttttctagaaacaactgaaaaggacaggggaagaagggaacttcctgacatcctatgctctgtgataggctcaggggacttattagggaacagagcagacatgttccctgcccttatagactttacatgagaca

SEQ ID NO: 1749 - DNA, 1324 bp, Homo sapiens
actataaaaatgtactttaggacattaaagaaaactcaagttagaagcataccattttcctttcatggaagggtacagtattacaaagataatttgtttaacttgatttattaaattctagttatgtgccctataatgatgtttcagtcagtgacagacctcatatatggcagtggttccataagattacaatactgtatttttactgtaccttctttatgtttagatatgcaagtacttaccattgtgttacagtgtcctacagtattcactacaataatatgctgtacaggtttgtagcctaggagcaataggccatagcttaggtgtatagtagatcataccatctaggtttgtgtaagtacactctgtgattgtacaattttaaaatctcctaatgatgatgcatttctcagaatgtatcccctttgctaagcaatgcatgactgcaatcctaattctcacatgttttggggaaaaaattttaattttgaaaaaatttaggaaagttcctaccaaatatacatgtataaagtttattaaaagtcataatgacccaggaatagctaatgacacagaagtagatcaaaatagaacacaatagagaacttcaaaataaaacaggtgtgagaattgtgtgtgtgaaaaagctgggttcaaataagttggtttgttagacattcatatgcctacccatcagccatttcgttctcccttccttgctgacaaagccccattttttttttctttttttttggcctaaaactctgtatggctgccttgtgctatagaatagggtgcttccctagcctagagagggtgagtgttgattagattctgtgccaatcatggtaattggcttacttgatcatttgatggaatctaggctaacgagacaaaggaagtctgaaggctttgaataagaaattttctgttgctcttaacaattgatacaagttagggatttgccagcatccctcttctgcttctcagtgaagatatgtgatatggatgtttgaagctaatctgcaacagccttctgatggccatgaaaggacaagtatggagatgaaagctatcacactgagaatagtgggatgtagatagaaagcacctgaattgtgcttctgaattaaccaatccaggaactgctttacctttggactttttgttatgtgagatattctttatattgttccatttgctttgggtatatgtatattgttacttgtagccaaaaagaaacctctcttagtagaaacaaagggagagttaggttattcaaaaattagtatgggacaattgaatatgcctttttctgcgg

SEQ ID NO: 1750 - DNA, 1735 bp, Homo sapiens
ctttctcctgggaaagagaatgtcagtgctttagacatggaaaaggagtctgaggaaaaagaagaaaaagaatctgagccccaacctgagcctgtggctcaacctcagcctcagtctcagccccagcttcagcttcaatcccagtcccaaccagtactccagtcccagcctccctctcagcctgaggatttgtcattagctgttttacagccaacaccccaagttactcaggagcaagggcatttactacctgagaggaaggattttcctgtagagtctgtaaaactcactgaggtaccagtagagccagtcttgacagtacatccagagagcaagagcaaaaccaaaactaggagcagaagtagaggtcgagctagaaataaaacaagcaagagtagaagtcgaagcagtagcagtagcagttctagtagcagttcaaccagtagcagcagtggaagtagttccagcagtggaagtagtagcagtcgcagtagttccagtagcagctccagtacaagtggcagcagcagcagagatagtagcagtagcactagtagtagtagtgagagtagaagtcggagtaggggccggggacataatagagatagaaagcacagaaggagcgtggatcggaagagaagggatacttcaggactagaaagaagtcacaaatcttcaaaaggtggtagtagtagagatacaaaaggatcaaaggataagaattcccggtccgacagaaagaggtctatatcagagagtagtcgatcaggcaaaagatcttcaagaagtgaaagagaccgaaaatcagacaggaaagacaaaaggcgttaatggaagaagccaggctttcttagccattctttgcagcagaagatttcttgataaaaaaggattacctttccttgtaaagaggatgctgccttaagaattgcatgttgtaaaaaatctttttggaaaatacagactgtttgtttaccagacattcttgtactttttgcataattttgtaagagttatttatcaaaattatgtgaggttccaaaatatgtaaaaatgataataataaaaaaagattaacatcccttgtcatcttttttaaatatcctatactcttcagtaagaatctgtatattttaataggcaaatctttaagtctgttcccttctaattctgtatcatacattgcttttgtagaaataaatgtgtgtttatttcattatttttgggatgtcctcgttgacacttgtataataaatatcctctttatcattttcagcttttaacactagatactgcacgtgattagaatgtttttgaaggtttcctcgtttttatttgccttggacagtttttagttgtcagagtcagagctttgcagctttgagggggaacagttctctttaaaatcatttgctattttctattctcccttgttattttaatctaagcattttcccccgtttctcatattttaaccatatgttcggtagataactaaacagtatgatctggttggcattttcttcctgatgatgggagcgtcattcttttgtcttcatggttacttgtgtgatataacatacatctgttaaagaaaatcacttctttctaggggagggaggtagaaaagtatctttcaaacttggtttttgagtttgtgtcttgtcttaactttgtgttggctctaacttaaacatgctgatatgtgttttcaagaattttgtttaaggaagta

SEQ ID NO: 1751 - DNA, 1202 bp, Homo sapiens
ttcattttgttccctttgttggtaacctgatttttttcctatggaaacttgcttttttcccccctttatctttggtgttctgacaatcacaatataatgcatttacatgtgaggctcttttcaattattgttttgttaaggttctctgagaaagattccaagattgaattagacaatgaagagatttattgaggaagaacacctgtgaaggattaaggggcgagagagcaaaattagattggagaggaccttcagacagtgattcaggtctgtcatcagtgaatggagagagagaaggaagaaaaattgggtgtaaacagtcttagtgcatctctgagaaagtctcaggcagggcagtggcaattcccagggtaaaaattgcctgttagaatagtccctcattaggtaggaatggctctattctggttcccctgctgtgttctgtccttggcttggagaatctcccaggaggaacctggtttttgtgtgcgtgctgaaggctaaagagctgtactcctcatagcaggatttttgcagaggagagacatgatttggtgtaccgtggctgccaccttgtgttaaggcacttactctgaagactcattttctgaaattctgggaatttttttttttaatctttggaaaattccttttctacttttcttatatttttagtctctactttttttctttttcttttcttttttttgtttttttttttggtaatttttgacccataggtaatttagtctttcaacttttgttctgaaaatttttttcaattatatattccagtcattctcttgaaatttttttcagtaaacgtacgtttaatcttcaagaacatttttattatacttgtttctttagttcaaactttgtttcacagatgttgtcctttttgtaaagatttattatcttcttcaatctctctatattagagctttctaaaagttgtcttctaaattatctgtttcctctggagttaataattaaattccatttgcttctcttgggtcttctgtcctcaccatgcttgctaagtctgaagttatccatgtttcagaaagatgaactagttaactagtactggctcatatttttttaaatgtaagatggactgttttcctgttacatggctttctcaagtgagaattcagactgggagatcttttttcttgtgggtagggcttggggagggg

SEQ ID NO: 1752 - DNA, 1155 bp, Homo sapiens
agaaggatttgttttctctcaggttggaaggttaccttagcacagccttcatcgtagaaatgcaagcagaagggtaaaagactttagtactgcctgttgcttcatgttgctccttttggggacaatacatttttaagatgccctttcggcacaaaatttgtggtcagaccctgttctggtatttggtttagataaaggatcattgtaagcatagttcaaatgagaggttaatttcacataccggacattgtgtattggggagaataagaaagagaaagtattagaggagaaagattatcctgagtacttgagaacaatcgttacctgtgtaggatctgaaatcagaacacttacgatctgggtgactttggaatggttacataatctctttaattcagatgctttatcctttaaaagagagaataatacagtttggtgagttttaatgaggccgtatatataaagcacttatctgagtgtctgggacatagaaagcaatcaaataatgttaggatttgaaggttttccaagttttcaatcagttgagataccagacttctacgttaattagaatactggtatgtgaattgcagaattcaacttagacaagaggccaccattggtactgatatgtttaactgaaccaagtcattgtattagcttttttaggtgatattgtggtaacaagctatctcaaatatctgtaggcttacaaaaacaaaggtttagttcttgtttacattgtacattggctgtaggtcatattaggctctgcactatgtctttattccaggatccagaatgaaggcatagatgctatccaggatattattaggctggtggtacagaaaaataaaggagtggttgatttgtgaaataacttttcttagaagtagcatctgtcacttccacagatatttcattggctaaaacaatgacaagcctgatatcagtttgacagagatatataatctaccttttagaaagaagctgtggatgtttttacagtaatacagttgacaagagttcacactttaggtgtaaatatttatttgcttttctttcataagaaaagcacattcaccctctccccaagtgcaatgtcgatcatggagttgggttcaaggtctgtgagtgattacctttgcatcagct

SEQ ID NO: 1753 - DNA, 1213 bp, Homo sapiens
gggctcgtcacccttgtaaacgcgttactctctaccaccctgagtaactgcgatcctttcctcttgccatctgcttatcaggacagaagatctggaccacggccaagctcacaaatcgggtattttttttcaattcctggtctttggggcctttattcgcctcccccttctccttttgtcgacttctcttaaccctccggccgcagagggttaatttttttttgtttttgtttgtttgtttttggcaacgtttccttaccctcatcactttgcgttttctttacaacgtacataatatggaaataggtctgtttttttccccctgtagctaaccgcctctcccttagacgttatcaaaatctttccttctaatgcagttcctctgtgggactctcccctaacctccgccccctccgtctgccgccctagcctccctgcaggatcctcaagcgtctctgcagcctttcagtctcctagagacagagattgcgaagacaatttcacttgcggtggaagttcttggcatcatggttctaagagaattctgccttgtggatttaggaatgatagtagacatttatttattttaggcgaactgagaattttgtgtgcattttctcctcataagtgatacttaaacggacacagtggaagagctggagtgtctagtgtgagcctgaatgctttggagtgtggaagagatattttttttttttgaaggaataatactattacttttgaatgactcgtgcgaaaagtctaagttatcatttgaagacccaaatttatgcacttcaaatgcaagtattcctaccctgctctgtaccaggtgggatttctcttaaatactttttaaagtcttggaataaatgagtcacatatgccaaacagctttataaataatgctcccagctgatgcaagtgcaaaaataatttctggatttttgccttaaagtacgatttgaatatcagttttgttttgttttgtttttgggggggtgggggtggggaatagactataatgtaaatgaggctgtgtaaatatacatcctatgttttggtttaaattctaggctgttactttggttttaatgagccattttcgtgtttaaatgaatctgcctaaattaggtttagctagcatgtttcattttagggacaggttaaagacagggaggtgaaaaacaagaaatgattgtagcagttgtcaatg

SEQ ID NO: 1754 - DNA, 1216 bp, Homo sapiens
tccatgtcttaatttgcaacattaagagaaacttaatagatgttgattcttaggacaaaagataatatatattaagatgtggggttttgtttgtttgtttttgaaacggagtcttgctctgttgcccaggctggagtgcagtggtgggatctcgggtcactgcaaccttctcctcctaggttcaagagactctcctgcctcagtctcccaagtagctgggattacaggcacacaccaccacacctggctaatttttgtattttgagtagagacaggctttgaccatattggccaggctggtcttgaactcctgacctcaggtgatccacccacctcggcctcccaaagtgctgggattataggtgtaagccaccacgcccggtttaagatacgttacttgaagccaggagtttgagaccagtcggcccaacatggcaaaaccccattttgactaaaaatacaaaaattagccaggcatggtggtgtgcatctgtaatcctagctactcaggtggctgaggcaagagaattgcttggacctgggaggcagaggttacagtgagccgaaatcatgctactgcactccagcctggtcgacagagcgagaccctaactcaaaaaaaaaaacattgtaaaattcctttccaagttattattagtgattttcttgcagaatatcagcaaaatgtacattttgaatttttttttaggtgaaaaatttacgttctggagtttctcgtgctgctgtggtctgtttaagtgatcttttcacttatttgaaaaagagcatggatcaagagctagataccacagtaaaagttttgttgcacaaggctggtgaatcaaatacatttataagagaagatgttgacaaagcattgagagctatggttaataatgtaactcctgcacgtgcagttgtttctcttatcaatggtggacaaaggtaatgttcaaaataaccttgaaatgtctttaaacaaaaaatgaaatgttgcaatcgggactgtagaaaagaaacaagcaaatcttagtagtatatcagtcaaaaaacatttattaaaaagttcctatgagataaacattatactacatgccgaatatgaaaagaataattttttattatttttctcatagaatatgtatacttcttttgtccctcgggcaccttgcaaaatgtctgccacacaaaatcatctaggcaatttggctttagg

SEQ ID NO: 1755 - DNA, 1135 bp, Homo sapiens
agagatggggtttcaccatgttggccatgttgatcttgaactcctgacctaaggtgatcctcccgcctcagcctccctaagtgctgcgattacaggcatgagcctgtaatcacgcctgtaaccatttcaccatgcctcatgaaaatattcttaaattgagataaaatttgcctctctttaacttcctacttgttttaattttgtcttctgtcataaatcaatctatacaatagacatttcagatttaacaaatacttacatgtctactcttacctatttgcaatgtgtacattttgtatttaattttctatttgataaagttacataaaaagtacatttatctattctctttgttttctcactctttttaagcagctgttgtatgctttctgttattctgtctaccctttaatccctacttgcataggaagcagttgaatataatttttgaagttagcattatcttctaaatttagaaataatattttaaaagtgattttatcttggaaagataacttaagagtaatttaatttttcagaacttttgagcatgctgttctagctgcaggaacagatttccgttctgacagactgtgggaaatgtatataaactgggaaaatgagcagggaaacctgagagaagttacagctatatatgatcgtattcttggtattccaacacagctgtatagtcatcattttcagaggtaggtgggaaattctgatcattgaaacatctttgattactcagatagttggtaatattaagtattataattatcttggaatgttatgtaagcttttattatgtggaaagaggaataaattttgttgctaatcacaacctacatgcttgcttttgacattttttcatatgccttatgaaatgtttagaaattttactgtttttagatagaagtttctccttattcattttaatggataaagagaaacaggaattctgtcttgtctaaggtagttcagagtaatgaaggaatgagaaaatagtacctaagttgagttatttatttatggcattaaattgacacagtgcctggcacatgatagatgcttattttttttgaaacttaatgatttgctaaatatacattattgtgattgctataacacctta

SEQ ID NO: 1756 - DNA, 1196 bp, Homo sapiens
tgcacttcaataatcattgctgttttatgtttatttgtaaataagagaatattttatttaaatattttatattgtatacatttttatttatagattatagaaattattaaaaaagaaaaatctgatgttcagtgatcattttgactagattataaaactaatttttcttattaaataaaacaaggtttattaaaagtgttactaaggatagtttaagaaagtaaaagctaagctagagatatactttggaatgtttcccaaaattaaagttgtactgttgtgataaatagtaaagttgacatgtctatgactacagccaacttgtcgattttccctatgtgtagatagtatacttttaagtgtactgattctaaatacatgtacttggtaaggtgtgggtgatgggtgggttgtgagataaatgacccagtaactaggaaagtagaaaacttaactgaatgtttatctgaccaaaggtgtgtcccagttaagtactgtcaaatctattaatatgaactctgatatggtttggctgtgtccccaaccaaaatctcatcttgacttgtaatctgaattataatcccaatatattggggagggacctcctggaacgtgattagctcatgggggcggttcccccatgctgttctagtgatagttctcagaggatctgatggttttataagcttttcctctgttcactctgcagttctcttgcctactgccatgtggaaaaggaaacgtttgcttcccctccaccatgattgtaagttcccgaggcctccccagccatgcaggactgtgagtcaattaaacatcttttccttataaattacccagtcgggttatttcttcatagcagcgtgagaatggactaatacaaactcccagctacattactcttttttgttgctgaaatatattcaaaatggtatattggtttggacttagaaagtttctttttaatataaattactgaatgcaggcccattatgttgaccctattatatttaccgttttgatccattctgttgtctgtgatggcattaagaaggctctgcttggggccgggcgcggtggctcacgcctgtaatcccagcacttggggaggccgaggggggcggatcacgaagtcaggagatcaagaacatcctggctaacacggtgaaaccccatcccgtctctactaaaaatat

SEQ ID NO: 1757 - DNA, 1192 bp, Homo sapiens
caaagactgcaactcctaggcaagttcttgtgatgaactgggctgagagccagtggatttgggggatataggacctactgagagaccagcctgggtggctaacagactcgcaccatgccttccccaaacccaggctgtatggcttgtggcttcaaaagataccccttccttccacttgaggaatagaaaagggaagactaaagaggactttgtattgcatcttgagtaccagctcagcaacaggaggataaggcacaggttagagccatgagaccccctttacaggccctagctcccagatgatatttatagatacaccctgtgtgagaaaggaacccactcccttgaagagaaggacccagtcctggcagcattcatcacctgccaaataaagagctcttgggccctgaataaccagcagtgatagccaggtagcatgccatgggccttgggtaagactctgagactagcaggcttcaggtgagaatcagcacattcccaggtgtcgtggttatggggaaagactccttctgcttgagaaaactggagggaaaagtaaagggcgcttttaattgcacattagataccagctcagccatggtgggtagagcactgagtgggttcttaggacctctgattccaggacttggctattggatgacatttttggacctgccctgggccagagggaaatccactgccctgaagagtgaatcccaggcctggcagcatttaccaaaactggttgaaaagcccttgggccttaagggaacatcattggtagcccagcagtattccctgtgggcctggggtagtggtggctaaaaatgaagagcctctgcctgtggaaaggggagggacaagtgggaaaaactatgtctcatggtttgaatgccagctcagccacattacaatagaacaccaggtagacttctaaggtatttgactccagtccctggctcctggacagcacctctagacctccctggggcctgggagaactcaccatcctgaagggaagaacacaagcctggttggctttgccacttgctgattatagaggaccagagccttgagcagacataggcaatagccacatagtggttacagcagatttggatgagacccagtgctgtgctggattcaagtgtgacccagcactatctcagtggtgatggtcacaggagtgctt

SEQ ID NO: 1758 - DNA, 1435 bp, Homo sapiens
cgtgccggtttgaacagacacgactgtaagaaaagagacagcggttttgcaggtcatagaaattacaagactccgcactcagacggctactacccgcatcccgggactcccaagccacagtacaggcctgtaatggcggcaccagcgactcccagtcggcgtgctccctcgtgccgcccgtggcctcctctacttgagattttaagcagcctagcgctccacggcaacgcttccccaaaatcacaaactatttctcaccaagagcgagaaccctggccgaattttcgcgggtggctccagtacagctgctggtgacccatcttgctctcagcagtgcaacgaggtaaaaggaagaagctggcccacgcatgcgctcttcaaatttttgagacagtttacccagaatgcagtgctcaaaggaaacgcgtgcgcagtgtggtcaggttgtttcgctgggtgagtaaaatgaaatcttagaggcgttgtgggctggcccagttgatgacgtcaccataccacagcttctagtgctattctgcgccggtatccgaccgccgggcgcggtggcgcgtgcctgtagtcccagctactcgggaggctgaggctggaggatcgcttgagtccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgggcaacatagcgagaccccgtctcttttgaacaataaatacgttaattttggactctcaagagatgaatattctcatagtcttttttattgattaaaccttttactttcttttaattaaaacgttacacttgggaaaggagtttttcctcgactcaccagtgacacctactggaataaatttacaaaacaacttaaaatcagctgtaatgatcacgagtcaacggtagggtttgcttttattttgttaaagagagtacgttttcaaatttatttttttgacacactcctccaagaaatacacctacaccattccaaaaaaaaatgagattctttggcatttagtgtatttgattcttaaatgtaattggctgaatgtaaagtaataaacaagtaatgtgcagtgtatgttgctttgaccagataatttggtgacaaaacaagtaatgaaaagcaaatgcaaaaatgcaaaaaaccaatgtcaataaacgaatttctgctgaaagatacctacattccatatggtcatttataatgcctccagataaaactgctctgaaatcaaagctttaactagatttataaaatgtagcacagggtgcaacaattc

SEQ ID NO: 1759 - DNA, 1214 bp, Homo sapiens
gtatcattatttctcattatttttgcactctgtagaatttgacaatgataattacccttttcttaataaaactctttcttttcttggtatctatgatagggcactatggtttaccttcagttttcttagtcacttctttgtctcttgcttccagcaacatttttttctatccccaaaataaaggctttatttcagtcctctgctgttttctgtcatacctgccttccatttgatagttcagctgttatatgggtgaatcccaagtctgtgaaccagtatgctttattgtacctagttgacccaggtcttctccagacttttccctactctggttcattgtgtacagtgctaccaaaatagtatttagttcttgtcatgtaactttcatacttaaaatccctccactttacgttggcatctgagctcatttacaatctgtcctcatactgtatttccaatcttttgctctacatagcttccatgttccaacaaaaattagcttttttttttttcttttttttttttttatatggagtcgctctgtcgcccaggctgccgtgcagtcttgcgatcttggcttactgcaacctctgcctcccagtttcaagcaactctcctgcctcagcctaccaagcagctgggattacaggcgcctgccgccatgccccactaatttttatatttttagtagagacggggtttcaccatgttggccaagctggccttgaactcctaacctcaggtgatccacccaccttggcctcccaaagtgctaggattataggcgtgagccaccagtcccagccttttttgtttgtttgttttgttttgttttgagaccgagtttcacttgtgtcgcccaggctggagtgcagtggcgcgatctcggctcactgcaacctctgcctcccaggttcaagcaattctcctgcctcagcttcctgactagctgggattacaggcatgcgccacattgcccagctaatttttgtattattagtagagaaggggtttcaccatgttggccaggctggtctgaaactcctgacctcaagtaatccgcctgccttggcctcccaatgttatgggattataggcgtgagtcactacacctggccttaaactcaaattttttttttttttttttaatttttcagatagagtcttgctctgttgcccagcctggagtgcagtggcacaatctcggctcactg

SEQ ID NO: 1760 - DNA, 1200 bp, Homo sapiens
ttaggaagaatataaccttgaggccccctatcctgtgggtcagaaatgacagtctggttgtatcactgtttctttctccttatggtttaatgatgtggaattttcattttacattatagctgacatttttatttttatatgttcggaacaggaagagcaagatctggatcaacagggaaatgaggtatgattttatgttggggttcctactacaacactgtgattacaattcagttcccagaatgtttgaaacacaacttattaaaacttagaaacctaagacaagactgcaggctacgaagtcaaactttcggggtcttaatcccaactctgctatatgtaactgtacaaacttggaaacattctttgtgcctcagtttcctcatctgaagaatggggataatgtccctacccaggagagggttgttttgataactaatgtatgtaaagggcatttagaaaagtttatggcacatagcaaacactcaaatattaattatacttcagcaccaagcattctgtcctaaatctaagtttattcatattgtaaaataaatgggggcaatctcacaggcagcacagcaaataagaactctgggatttctccttaataatgggtaagagagaaggctgttctagcccagggtttctcaactttggcactattaacattaggggttggttaattctttgttgtggggtctgtcccattcattataaaatgtttagcgacatcctcggcctttacccactagatcccagtagcagcccctacctattccttctcacccctcatcgtgtcaacgaaaactatctctagacattgcccattgtcttctgagggcagaatctccccaggacgagaaatagtggtatagccaaggtattagtcccatttccatgtgataggacttaaatctatttgtggttattattgcatcattttaatccacagcaggtttctgcaactcaggtaatatccaatagtttttttccttttttttttttttttgagacagggtctctgtcacccaggctggtgtcacccagtgcagtgacaggatcatggctctccacaacgtctacctcctgggctcaggtgatcctccccccctcagtcttccgagtagctgggactacaggcacccactatacccagctaacttttatattttttgtagagatggtgtttctccatgt

SEQ ID NO: 1761 - DNA, 1199 bp, Homo sapiens
ctgttacgtcttcctaattaattgagtcttttatcaactttaatgaaatgtccttctaacttgtaactattttttccttgtttgtcaggtgtaactagatgagctttcttttggttagtgtttacatggtatatcttttttatttgtttgttttttgttttttgagacatagtcttgctctgtcacccaggctgaagtgcagtggtgcaatcttggctcattgcaacttctgcctcctgggttcaagcaattctgcctcagccctctgagtagctgggattacaggcgcccaccaccatgcctggctaatttttctatttttattagagatgaggtttcatcatgttggccaggctggtctcaaactctggacctcaagtgatatgcctgcgttggcctcccaaagtgctgggattacaggcataagccaccgcgcctggcctgtcttttttcatcattatatttcaacctttccatccttatattttaaaggagcatcatatatatcattgtcattgttttccagtctgacagtctttgccttttacctgggcatttaatgcatttatatttaatgtaatctctgatatatttgggtttaaatccacccatcttactgtttgctttttgcttgtcccatttgttctgtgtcctcttttgtcttcattattgccttcttttgattgactactttttattgacttgttggctatacattcccttactaggatgattacaaaatacatctttgatttttctctcccattctttttgtccctatgtctttgtctttttacaaacctctttactatcagtaggggaatggttaagtaagtgtagtgcatccattcagcaatgaagaaaatgtacttttaggtgaaaaaagcaatattcagaacagtttgtgctatgtctaaaaatgtatcagggaaacccacctccagtatttcaacataggttctttctattttccttaagtgtcagccagctgagaaataaagagaaagagtacaaagaggaattttacagctgggctgctgggggtgacatcacgtatccgtaggaccatgatgcccacctgagccttaaagccagcaagctttattaaggatttcaaaaggggagggaggtgcaagaacagggagtaggtcacaaagatcacatgcttcaaagggcaaaaaggagaacaaagatcacat

SEQ ID NO: 1762 - DNA, 1246 bp, Homo sapiens
aataatattccactgtatgtatgtatgtgtgtgtgtgtgtgtgtgtacatatatatttgcactcattatccgttcatccattgatgaaaagtagattatccctatatcttggctattgtgaataatgctgcaatgaacatgaacatatatcttcaggatagtgatgttgttgctagatcacatggtaattctattcttaattttgtgaggagcctttatactgttttgcacaatggctctactaatttacattcccatcaacagcatacaaaagttccctgttctccaccttctccccaatgctttcatattttgggccattctgtatggtttactgtaccgtatgacagtaatgctgtgcagtatgtgctatagccatttttgcatctactggtaccagttctgaaatagcagcggcgccctttctgtttagagtcgccttctggtggtaggaattctggttgctaccatgtgtagcctgcaagcctctagcagctcttttgcagcgacgccgagcgccgggcgcggtggcgcgtgcctgtagtcccagctactcgggaggctgaggctggaggatcccttgagttcaggagttctgggctgtagtgcgctatgccgatcgggtgtccgcactgagttcggcatcaatatggtgacctcccgggagcgggggaccaccaggttgcctaaggaggggtgaaccggcccaggtcggaaacggagcaggtcaaaactcccgtgctgatcagtagtgggattgcgcctgtgaatagccactgcactccagcctgggcaacatagtgagaccctgcctcttttgagttctcaccttataaagtagcctttcttcccatgcatctatcctaagacaaaagaaatgcagaatttacattcttacaggactattttcctcactacactgtgaatcccccctcccaccccacccccattgggaatcttcttgtttttatttttatcttatttcaccattatctagctaaacacttgcacattcatgctgccaagtgtttatggagcaccgattgtacaccaggtactgcggtgagtctcaggggtaccaagaccgaggttcgatgagaatcctgtaatcaattgcagaatgctccttccgagagcaggacccatcaaaataggaactccgttttgagagttcgcctcgatcgttgaggataatcttagaaggaccgaagcagttccgtttcgttacatttcaaaatcttatgtc

SEQ ID NO: 1763 - DNA, 1212 bp, Homo sapiens
gatgcagcacatatttaaggcctgctgaagcaagcaacgctgacggaccaggttattgcgtttttctctcgctgcgtgtccggacgccacactatgagcattaagcgcatactgaccaatttctgttaagcaggaacgtggtgttctgatcaaaacacagggagccgcggccgcaaccgcgccgataagcttccggggtcccaaccctgtaaggcagaacggctgcccagctcggatgacgccacactaacgtagcctccagaccgcccagtgtgggtgtgtccaagctcacgtcgcccggcgtggcccccccgctccccaatgacgtaactgccctgcagcttctagtagcttttcgcagcgtctccgaccgccgggcgcggtggcgcgtgcctgtagtcccagctactcgggaggctgaggtgggaggatcgcttgagcccaggagttctgggctgtagtgcgctatgccgatcgggtgtccgcactaagttcggcatcaatatggtgacctcccgggagcgggggaccaccaggttgcctaaggaggggtgaaccggcccaggtcggaaacggagcaggtcaaaactcccgtgctgatcagtagtgggatcgcgcctgtgaatagccactgcactccagcctgagcaacatagcgagaccccgtctcttttgcccccctccctcattaagggtacctttgtaagtaaatagtgtctttgaagttaagaagtttgcctcctttccggttcatacgtattaagaaacatactaatgtgcacatttaaagacgagtcctctcttcctctaaaggaaaaaatatatagagaaagatgttactgaggtttatagttggctttctctctccactcttatatttatccactgttttacgtttccttcagcgcgaaagctcaccagttgacgggatgcttggggatttgcaaccgcctcatcgctgccccctaccggcgcatattcaaaacgtctctgcgaaaagctgttattaccttcggagccaacaggggctgctcgtttacccacagacagtcggaaaaaaatggccgccggatcacagagagcaaaaagtacgttctcttaaagaatttccaagttcttcccgcggccgttcaggatgctgcttgcagttaccaacattattcccctgcactgagctgacctgagcttccctgcctacctcctgtcacggat

SEQ ID NO: 1764 - DNA, 1385 bp, Homo sapiens
ggaaaggaatgaagttggtgagctggatgtggtgcctggcactcccacccactgtgagccttcctgtatgacagagacaagaacactaaaacctatgtttccagattcctttgcagctagaattctgcttaggcattaggtgctcccaacaagatgcactgggatgagatctgaaggaccacagtgaggtagaggccaccttcttattgctgcctctgcgggcaaagcctggtcaactgtgtggaaagaagctgtggaagatagggttagcactcgatgtctcttaaccagcctgaggggcttgccgagcatttgccgagatggggcagcagcagtgactgcccaggagtccttcccaaagacatgctagcaaaaacacaaaaacacacacaagcgtgatcattgcactgttgtaataagcaaaggactggcagcaacccaagagagggaactggttgaataaattatggcctatccacacacataatggaaggctgtgcagctctccaaaggagcaaaaataatattttcataacatgccatggagtaattgttaagatttgtgaaaatggatgcagggtgatctggctgtgacatctgtcactccattgatcgccagggttgattcggctgatctggctggctaggcaggtatccccttcctccctcactgctctatgtgcctccctcctgaagcggtgctctcaatcgaagaggacggccatccctgatagaggaggactggtccttctttggtcaaaggtatacgagtacctgtgctcccctgccagaacctccaaacaagctctcaagattggtgaaaaagccgggcatggtggctcacacctgtaatcccaacactttggggaactgaagcaggtggatcacctgaggttaggagttcgagaccagcctgaccaacatggcgaaaccccctctctactaaaaatacaaaaattagccaggcgtggtggtgggcacctgtaatcccagctactcaggaggctgaggcaggagaatcgcttgaacccaggaggtggaggttgcagtgagccaagttgccccattgcactccagcctgggcaataagagcaaaactccatctcaaaaaaaaaataaaaaataaaaaagattggtaaaagaaacaaactggagaaaaaggtataaagtacacttccacttacaaatgagggatacgtatgtgtattttaaaggaatctcggaataataaacaaaccaaaaaaaggtagtcctaaagatctcttttaataggaaaaatagtgagactaagatgtcaggccccaaactctggctgtaaaactagaagcaaaggatgagtggacccgtctctcttctgctcagttcagaatgaaggaggagaaaac

SEQ ID NO: 1765 - DNA, 1193 bp, Homo sapiens
aggtaaagggaaagttatttgcatgcctggctttgtaacattctagcagtgattggtcaagaagaatgcggctgacagctgacacctggcttctcttcaggatgttgtgaattcggattggaccagcaggtctgccctgctgttagctctctagggcatccaaggacagaggatcattctcaaggcattcttagttgttctaactccattcaccactacaagagcatgggctttggaaacaggcagagttgggcctgaaacctgtgttcagcccttgatagcagggtggctttgtctctactgatcaatctctcagagcctcagcttcttctttcataaaacaggccagttaataatcccagtcagttaacaaatccatgtaagattgtcataaagatcagagataatgtggatactgagcctgaaatgcgtccctaaatgatagttattagcttttgtctgtatggactctggaatcaatttctttcccaattccacttaaaacagagacaataaattcaagtatttcctcaagctgctgtagagtgtcattttaaaatgacattgactcaactcccctttccttacaacataattggaaaaaaaaaaaaaaaagctggctgggcacggtggctcatgcctgtaatcccagcactttgggaggctgaggcgggcggatcacgaggtcaggagttcgagaccagcctggccaacacagtgaaaccccatctctactaaaaatacaaaaaagtagccaggtgtggtggcgggtgcctgcagtcccagctactcgggaggctgaggcaggagaatggcttgaacctgggatgcagagtttgcagtcagccgagatcgcaccattgcactccagcctgggcaacaaagcgagactccatctcaaaaaaaaagaaaaaaggcttcaagcattggccctgggttctgcactcagatgaggcttcagtgttctgcccaatctcatggaagttcattctcctggtgctggagctgcacacacatgaagttgctgagctaccatgagaagggagcatatagacaagatgagtcttcccggtagcctaaaaaaaaggaggaaggtgctacactgtgcatcattttaagtgctctgcgccagctctcaatgtcctacacattaactcaataatcctgacaaccaccacaatgcattaggtagt

SEQ ID NO: 1766 - DNA, 1179 bp, Homo sapiens
aaaaaattaactgagcatggtggtgcatgccctttggtcccagctactggggaggctgaggtggaaggattgcttgaacccaagagacagaggttgcagtgagccgagatcgtgccactgcactccagcctgggtgacagagcaagaccttgtctccaaaaaaaaagtaatagcttcacacaagacattttcgatgttcctgttggcggttaaaaaaggcaaagcccagctttgcacagcagctgtggttatgggtcacactcactgccttcacacctgtgtatgcaggaatcttgtggtacagccttgtcaatgcatcagtcttgttacttactgttatggcaagacagcattcctgtttctggtcagtttccatattaggcttagcagttgagggccattctgttggcctatagaagttcatgcaatgggcagcacaagcttgctctggaaacctctgtcccttctacagaagctgtgcaggtctcttaggagacccagtgatcttgcctgttctagagtggcccccagctgcagagtgtgggaaggaaaaaaaattctcaatgacgtgtgggattgatttcttcctcttataatgaattctgaatctgacagatcttgttttttgtttgtttgttttgttttgttttgttttcttgagatggagtctcgctctgtcgcccaggctggagtgcagtggcgcaacctcggctcgttggaagctccgcctcccaggttcaagcaattctccacctcagcctccctactggctgggttacaggcacatgccaccatgcctggctaatttttgtatttctagtagagacggggtttcaccatcttggccaggctggtcttgaattcctgacctcatgatccacctgcctcggcctcccaaagtgctgggattacaggcgtgagccaccgctcccggcctctgacagttctttattgtactgctggccgcttttttctcccttttggttgctggaagcccttctgtctcctctctttggggatgttgggaatttattccttgggctcatacttaatctcggggctaccaggcaatgtggaaagagggactggggccgagtctcccctgatgtgactatttcataaggagtaataagatggggatctggagccaggtcttctttgttttgattgcagttttcc

SEQ ID NO: 1767 - DNA, 1137 bp, Homo sapiens
cctggcccatgctaaatacaaggcatgacgctaatctgcatatacaacattaagtaatcctcacaccaacctcataaggtggatattattatcccattttacagattaggaaactgaggctaaaaaggtaaattaaatggcccaatatctcacaggattcaaatccagattagaatgacaccagggctcttgctcctaaccactgagcgacactgcctccctcgcccctcagaagggggcaggctaagtgctgtcctgttctttgctgactctcaggaggtgtatgtggggaaggagacaatgtgcactgtggatggtcttcacttcaacagcacatacaacgctcgggtcaaggccttcaacaaaacaggagtcagcccgtacagcaagaccctggtcctccaaacgtctgagggtaaggcccttcagcagtatccctcagagcgagaactgcgtggcatctaaagtggctggcaagcccggaggtaaccccaccactgcccacattcctgaagtgtttccatgacttgctctgcattctgcacagagccgctgttcctctcctgcctttagagagcctatggtatgtggatgtgatcaaaccaaagattccacatcggcagttccaatggcttgggccggcggcttcctttgataacaatctaaataagctgcagttgaagaagctgaaaaatgaaggcctgaatgtgcccctggtgtgtaagacaaatgtatctaggctctagagcaggctcccattctccaccgatacacatcatgtgccagttttgcccagatgattctaaattactctgtagtacttgcttgttctgagggtgggacctaggttctttccagtcgtggatttgtatgactgaatgtgtttcaaatgggtggtggggtgctagagctgtttagagagggcctgttggctgctcctggcttacccacttagactgcctccgtttcatacccaaagcggaggccgtcagcaccaggattgagacttcctgtgggcaccaaacaggaagagaccagcaacttcgcattacccgccattttcatctttgccagtcccttcagtcttggctaggctaccgagagccaccatacaaggttcatctctagagaattttt

SEQ ID NO: 1768 - DNA, 1219 bp, Homo sapiens
aacagtggagtaggcaaatcaaatttgtaagataatttttgttgtcatattttttagaagtggcattctactatgtaacattttctcagcttcagtaatatttatagggtagttatatagtaaaatgaaatgccaaattgtatgagatggctaatatttactgttccatatttctcttccatgatgccactaatgaacattatactagaatggctttatgtagatttttggatagtttcatttcattgctggttttggaactcctagctttttaaattttactaaccttataattttacttctgatgagaacctgaatgagaatgatcatttttcttgccccaaatccacaatttaaatctctttgagttgctgacaatcatgccttaattaattcactgctgaattattttataccacctcacaaatttggctgtacatttggttcttcactgtgactctcaattctccttgaataactccttgcacagtataggtaataaataattatttatgggtcaaactaacatcctcttttatattcttacagattcaaattaaccgcaacatgaggcttttatgcaagtttctttgtggttttgaaaatagctggttctctaaaagagcagttcaaaacacccaagtaaagataatatggccttaattttttaaaataatacaattcaacttaaaaatacttactgctcactttttaattatgagacatataatgaagccatccctgccctgtcagaattgctttattagagagtataagacaagccatttatgatcagagtataagaccacgagtgccaggaaaggggtccagagtggggcagggggtcagaagagggaaagcagcacatgtggaggaggttcagaagtcttcatgggtaggattcaaaagaaggagctggggaagggaaaaatgtctagtagggcatgcagtaagcagagaaactacagcttggggcttttgaccatgtaatgtagtaaaggggcatcagccttgagttattatttttgtcatatatggcatgagatcatagggatggtagaagcagctggacttcagggcagaaacatgtccgtgaattttagcatcctctgacagacttggagtaactccttgctaactagtgaaaatctgatattctccaggatctaaagagggaaaaggggctggatgcagtggctcacacctgtactttcagcac

SEQ ID NO: 1769 - DNA, 1203 bp, Homo sapiens
ccagagaatatggggtttaaatgaaaccttggaagtagaattttaagagtggagcgtaagcattttattgtgaggacaatctcataaacagtcattaacaggaacatgttatgtccaaaaagtagctaagaaagtgctgttgtacagccttgggtagagtaataggtgacagttgggtaataaaacagaatgagcaagattatgtagtcttcagtgtcaggtctattagtttgactttatcttctaaattgagggtatgaaatctcaagtctgtgtaccccaacatcatgtagctggtaggttaaataccaggaggtactgaaaataagttgacaattctttgtatttatagcttgcttttctttgcccttttttcttttttttatggttttaaaattcacccctactccctttacatctatataaatttctgttcgctgtctccataagtgcttctgtcctgcccttctcattcagtccttttccccacgtgccccttcagtctctccctttgcttttcacttcttagtgccctgtgaccttatttggaatttcctgccctttttcttttagtcaaaattgtttaccatatcctttctcctgtttcctgcctgtcgaaatcttacctatgcttcaaataatagctcaaatgacacttcacaaaaactttgtgttttggggtggggggcttcctcgtggtttttacctctgagtggataaagggtcccttaaccctacttaacaggtccctagtagggagctgatgagtttttgcacttaaagatgttggagccaagagaacatttgtgactctgacagaactttctacattgggaatgggaaggaggaggtggatctaaggaaggctgcaaagctcactaaatagtcactgaaatgagaggaagggaagcaccataccagatgcctccagtgatttaaagcagggtgtctgaggtgatgctattatagccaaaagtactagaaaaatgccttaaaattttaagttatagcttaacagctaataattactatgtgccaagcactattctaataatttttatataattcttttaatatgtgtattacacataaggcttaaaagtactttcctgagatttatctacttactgtatttcatagtttcattacttggaagaataacagtaattacattttaaggcttatgatttaaaaaaatgtaac

SEQ ID NO: 1770 - DNA, 1189 bp, Homo sapiens
gatagttcttaaatggaaagaattggcttgacaattgtttccagtccttactttagcctccctttggtcttgctttgaaggcttttaagggtgagtaagagttgccttttccaactggtttcatggaacttgtaaccctttactcagtgtattggagaaatcatcagatgaaatacaaaatattaacatcaaaacagtgggagaaaaggaaaaaaatactgtcaagtatttttatttatgaggctgtcacatggtagtgtcaatttagaaacagttttcatgaagaaggcttattacaggcatgaaatcagtgatgtgtcactagtcttgattaacagcaataaaatctgtcatattggggaaattatagagtagaaaatagtatgtatagacaaatctgtgtatgttactcagttttttaatcatctcttttatttttaggatgagtagtatgtcagcactctttcagctatctatgtggatcagggtatggactaaaatatttttatcttaaacatttttaccactatcactttaacaaaaatgaacagatttttagtttttttttttcttttgattttagacttgccataactactttattgaagaccttggattgccagtgtggggatcatatactgtttttgctttagcaactctgttttccggactgttattaggactcgtaagtatttcatttttggagtgctaggaagaaagatatttaaaaatgtgattatttaaaatagttacattagctgtggcatatattctacattcagatttcttacaatgtttatttttacagtgtatgatatttgtggcagattgcctttgtccttcaaaaaggcgcagaccacagccgtacccatacccttcaagtaagtatattttaaaatgtttattttttattcacgatagtcctattcatttctgtaatcacaatcacacatttcacaggttgctcttccagcttagaattctaactgtggattgttggtctttatcagctatggcataaaggaaggtagaggagatgtatatttcatataagaatgtagcccagtggattttggaacattgttattttcttgactcttatattatggggaattttaacattgcatatagcatgtagctatttaataatatttatttggtgtcgttttataagtggagtatattctac

SEQ ID NO: 1771 - DNA, 1192 bp, Homo sapiens
ggtaatacaggatatgctactgatttaggaagtttttaagttcatggtattctcttgattccaacaaagtttgattttctcttgtatttttcttacttactatgggttacattttttatttttcaaattggatgataatttcttggaaacattttttatgttttagtaaacagtatttttttgttgtttcaaactgaagtttactgagagatccatcaaattgaacaatctgttgtaatttaaaattttggccacttttttcagattttacatcattcttgctgaacttcaacttgaaattgtttttttttttttttctttttggatgtgaaggtgaacattcctgatttttgtctgatgtgaaaaagccttggtattttacattttgaaaattcaaagaagcttaatataaaagtttgcattctactcaggaaaaagcatcttcttgtatatgtcttaaatgtatttttgtcctcatatacagaaagttcttaattgattttacagtctgtaatgcttgatgttttaaaataataacatttttatattttttaaaagacaaacttcatattatcctgtgttctttcctgactggtaatattgtgtgggatttcacaggtaaaagtcagtaggatggaacattttagtgtatttttactccttaaagagctagaatacatagttttcaccttaaaagaagggggaaaatcataaatacaatgaatcaactgaccattacgtagtagacaatttctgtaatgtccccttctttctaggctctgttgctgtgtgaatccattagatttacagtatcgtaatatacaagttttctttaaagccctctcctttagaatttaaaatattgtaccattgaagagtttggatgtgtaacttgtgatgccttagaaaaatatcctaagcacaaaataaacctttctaaccacttcattaaagctgaagaccagtatgatttctggttgctttttgaaggtatgctttattactttgtatttaacgatgttcagatgagtagttgtgtgttcctatatatgtacttgatatgtgtaatcaaaagactgccttctttttctattgagatgtttaaggacagtaatgctcattaatcaagcattttttttttttagtgttctagtatatgtgacatggccaatttttttattagaaaatatgt

SEQ ID NO: 1772 - DNA, 1142 bp, Homo sapiens
tataatcaattttaatgtcaatgataccccttaattatgccattaaaattgcatttttatatacctcttatagttcttgcttctcattttactttgagtttttgaactcttgactcattattaaaaattgatggcaaattttttcactgtttgatatatactgcctctgaagaacagaattattaggaaataaccaatgagtaattacttcattttttttttcaggaacaccggcttgttagagagagatattatgtgcttattgataatattgaatgagcagagtaaatactcaatttaatatgatttttcatacatttcaaattctttattattttattctttgctgaaaaattctacttttatccttatgagtatatagaaataatctattgctgttttttcctattgcctattttgagatagtgagcttgcatttgaaagagatgggtcctgtttgaaattttaaaaatactgaaacaaaattttcacctacagctatgactgtttttatattatactaatttttctaaactttcttcttttaaatgtagataacatagatcatcagtagaaaacttcttgaagttgttcaagaaaaatttgaaagtagcaaaatagaaaataaagaattaacagcagatacagaggacagcatggaagtaagtacgccaagaaagaagataagaggaggatatctagaacaaatttgatttcagaacatagaattgaattaaagtatgagttgaaaaagatatttaaatttttaagcagtatagagaaatctaagggttaggcattacaaattatgtatatttagaaggaatgttcttccattgttttaatagatttcttctaggggatttaaagtaaaagtaaacatattaggcatattttggctgtttcactcccatctaaatggtattaaataattattcgattatttcttataatcaactataggtaaagaaaaacaaaatgcccaattaaaaaatggattggttaatgtttgagaattaattttagaaccctttaaaatgacaattagcttaacacactctactaaattgagcattttctaggtagttttgatatcttttgcaagtatgaaaaatcaatagtattttcaagtcaatgttgtt

SEQ ID NO: 1773 - DNA, 1243 bp, Homo sapiens
tatcactcatggctaaagcagcaacaaaagcaatgtctttttgctgtgagtctcaaagcccccaaattcatagggcagcactgtgagaggatgttacctgcgcatgcagtggggaatgctacaggagagaaaaccctgaaataaaaacagagacagagatagacatttattctagagtgtaagcaaatcttcaccagggagagagagggagagtttactatcctggaatgtcctcagggaggacagcgttctctacctttattataccagtcaggaatattccttctgaccttaaagtaaacactatctcttgcattcagggatgtttgtcatgcaaacccctttgctcagaagatccagaccatgcaaaaacatgagacattcatagagaattctcttccaacacagattttcccaggtttctgttagcttcagatatctctcagtctgtactcactgcttctgttgtcttacttcctatcaactccttgcacttctgctctgtcaatctgaaaactattctctgcaaggtaccagtgacataccagtcactcaattaaatggtcttttcttaatcatttctgacgttttgcagaattttaacaacggctctactttcttgcttttaactctaaactactctgctgttttctatgactagtctgattcttatgtttctctcctctgcccatctcccttttctttactcttgtgctttctaattgtgactattaaatgtgaacatatcacaggttgactctcattctacactttttcccttaagtgtattctactgagtttcagctgtcacctctataggtgactgtaatttccttcttgcattccaaaactcacctattatctttatttctgcctagatgtaatacattttaaatataacaatacatttcgtgacctggcttttaagttttttgtcagtggtgccctcattctatcaattgtttagattcaaaacctgagaatatagtttagtcagctcaagttcaacagtcttttaactggaattctttgccccaccgtaatgcattttctacactgtcacttaagaaatcattcaaacgtagaatcatattacagagtttatagccagcccaattcttcagcattttatacaaagcctccatgatttgatgactgcttgcctccagcttcaacttctgctgtttcccacactatcccacacaccaccaccacacgaaaacactttctttgaccttaattc

SEQ ID NO: 1774 - DNA, 1195 bp, Homo sapiens
tggtggcacatgcctgtaataccagctacttgggaggctgaggcaggagcattgcttgaacccaggaggtggagtttgcagtgagccgagattgtaccaccgcactccagcctgggcaacagagcgagagtccttctcaaacaaacaaacaaacaaacaaaaagatggaaatttaggatcagagagataaggatgtaaatcccagctctactgtttattggctgtgtgaccttagtcaaattgcagcatctttaagcttcactttcctgatctgcaaaatggagataatgatagtgctctcatgggttgctatgaggataagagctgtccataccttataaggttgttgtaaggattaaattaaaaaatacataaaatgcttggtatattgcctaccactaaaaaattgcttataaatgttatttattatggtattaatgtaattaggggatggtaatctaacttcacagagttcctgaacacctgaaaatgttggcaaaatttgactggagaggggtcttgtataatgatcaaatctcaaaaggaacagtcactgaaaaaaaggaataagaattactgaagaacaggattccccttttgaatattttaactttgcttgactctacatgatttatatcctactctactttttggtaagagttgacctgtctgatagattacattttatctactacttaagtagtttttctgagaaatttttggaacaaatatgaaatagcctttttgatgggcatttttgttctgaaatctcatcttttactccaatctcagttttgttttgtttgcattgacatgatagactggatactgtcttttaactttttgtctattgctaacattttaagtgtgcctcactaacttaggcaaagttttatggagtttaattatgaatgagcacccctttttatagggtaactcaaatagtttccatttattaccatgattgtcagtatttgtctttttctctctcattaagtttttttgttgctgtttgatttgccttcatttgtagaatttctagggcacatttactttttatcagaattataactttttatcagttataaatcaatgaagtaaatatgctttttatcagaattataacttttaacattaaaacgcatgctaatagaattatttttattctaacattattttccatttcagaaaaaat

SEQ ID NO: 1775 - DNA, 1127 bp, Homo sapiens
agatcccagcttcagtgttaccattacagactattttatgtgtattttcatcccatattttctagtcttaaatggtagtggttctgaaacctgaaaattgactagccacttaatgtgctaaagtatatttgtgtatacttctacaaagaaggaacctgaagaaaagcataaggtcattttcttccttctttattgtcctaaaggctccaaagaggtttgctatttcttttcatttaatacatttagatataaaagggtttctaatagtacaaagaatgtcatcattcttggttatttcaggtatcagtaaatttaccacttagggttgtaggtatgtcatagctgattgctttcaacacagatatttaatgtagtttaggggagtacattcacttttaaaaacagtattcttggatgtaagagatatttttaatctcttaattttcagtatattctaaatgtatcactatggattaactttagcagtttaaaattatttttatgactaacttctgattctttttccacagcttctcttttaaaaaaaaaaatgctggattttgtctttgacaaaacacgttacagggctttgtgggattttttttcttttaatgttttaaccaaatctcattttacagtttctttatttgatcaccaattttcataaattttttcaagtaaaaaaaaaaaaaaactcttacattacttcagtttgcgttgatctaactcagtgaattccccttaagaaattatcttacataagtgctgtctctggtctctgcccaagccagcctgtttcataaataaataattttatttatgttttttgcatttttggttggagaaaggaaaattaattcattcatatttgtcctgcaaccaagtagcccatatatccagtatctcaaaaccatcctacctagctacctaagtagttaaacctgtagtcataactacacaaaatgattcagatggtaatatctatatggcttctttttgcgcttcctgttttcattcactcaacaattatttacttcactgtttaccttgagccaagagaccatggcagtcactagaaaagataagatgaaacaaatttcaatactgcctataaagatgctagtgtg

SEQ ID NO: 1776 - DNA, 1144 bp, Homo sapiens
attgatcattcctttctatacaatggggatacacatggtacctgccttctaggactccttgaaggattaagcaaggtaatgtatataagagacctaacagggcctggcgtgaagtgagccctccagagatactcattctattattagacacaactccagagtgtgtgatgtttggatggcttctctaagctctgatccgccattaagctttcagctgtgccgttctacttgctaaaattggaagggaataggggacaactacagcatatgcactgagccaagtcatatgttaggcaaaagtccataaatgcaaattaaaatcactgtgaacttgtcattagtcttgtcattttctgtgatactagtttgctatataaagcatactctctcatgctctgagtttttttttaataattagtaatgttcaaattaacatcttttttcttcttttcagcatgatctatgttttggtgagctcttagaacaacacacagaagaattggtccagttaagtgcatgcaaaaagccaccaaatgaagggattctatccagcaagatcctgtccaagagtagcctgtggaatctgatcagttactttaaaaaatgactccttattttttaaatgtttccacatttttgcttgtggaaagactgttttcatatgttatactcagataaagattttaaatggtattacgtataaattaatataaaatgattacctctggtgttgacaggtttgaacttgcacttcttaaggaacagccataatcctctgaatgatgcattaattactgactgtcctagtacattggaagcttttgtttataggaacttgtagggctcattttggtttcattgaaacagtatctaattataaattagctgtagatatcaggtgcttctgatgaagtgaaaatgtatatctgactagtgggaaacttcatgggtttcctcatctgtcatgtcgatgattatatatggatacatttacaaaaataaaaagcgggaattttcccttcgcttgaatattatccctgtatattgcatgaatgagagatttcccatatttccatcagagtaataaatatacttgctttaattcttaagcataagtaaacatgatataaaaatatatgctgaa

SEQ ID NO: 1777 - DNA, 1231 bp, Homo sapiens
cttctgaagtagtacggaaactccacattcttcagaccaacttgcggcatgccagcacattcctctccgatgaggtggaggaatactggtggctggcctgggacttgtaggactggggcggggagctgctgtttaaaaatacatttaattatattccttctctgcagtaacattgataccatttttagcccattacaaatactgtgattttcatttaaatcacgtccattatcttattgacctagtttttattttgtaatcaaaatgttctatttctggatagcctcacccagaatctttttttttttaaaggttacagaccctttgtgcagttttttcctttcgtatctgcgtacagatgggctgcatctgtgttcacacagcagaaaatggtactatattgttccctttaagagtgtgggttttctctacttaatctcggactcttcatggagacacagctggcaagatgccacgagacctcgcatttggtaactgttttggtgaatggatattgggagagttaagtaatcctatttctattcgaaatgagaatcctgattctcttcttccatttttgctctttctctgttcgtctgctagttccctctgtgagccttctctttcctccccgcctctccagccgtccactatgaacctcacgtagccctgtcttcattcatgccctctcgggtgctccctgctgcttgtaagatcccacttatttctggcctttgctttttctacatttctttctctcctgtttccttctttccctcttaccttctcttccttgctgtcagccatgtatttctgcactctggttggaagctcaccctgcaaagaacaccccggaggtgtttccagggctcagctgtttttcactcatgtctaggcagggccttgaggcccctgaggaactttcaactttgccctcaagacttcctcttaatattattattattattattattattattattattattattattattattatttgaggcagagtctcgccctgtcacccagggtggagtgcagtggcgtgatgatctctgctcactgcaacctccatctcccgggttcaagcaattcttctgcctcagcctcctgagtagctgggattacaggtgtgcgccctgacgcccagataatttttgtatttttagtagagacaggatttcacgatgttggccaggctggtcttgaactcctgacctcaagtgat

SEQ ID NO: 1778 - DNA, 1198 bp, Homo sapiens
cttctcggcttcacttctagggtggtttttgtttgtttgctttcttgcttgctttttggctaggaagaaaggcacttgcctaaaaatatggggatgctactgtatatctatggaggatttgtgatttttgttcattcaacaagtttttattgtacatcttccaggaaccaagcagaagttctggggctagaaccacagcaaataacaatagagacatagtggtgcttccataaagctcggggcagccgtggggatgacaaagacagaaaaccaagcaggaggggcactgagcctaggctagggagggctcctagaaggacacaatgtctaagccaaggcctgaagcagtacaggcaaagaagggaatgcaggctgctggggagcagagggggagcaggggatagagcaggaggtacaggagaggacaatggaataacgttacgtgtgtttccatctttgtccaaatagttctgccttcctattgttgaacaggtatgtggtaatgataatatgaaaattctatacatagaattcactgtcaaagcatttctgaatgagaactagcacactgatcatggcactcatttatgggttacgatatggtttggttgtgtccccacccaatctcaacttgaattgtatctcccagaattcccacgtgttgtaggagggatccagggggaggtaattaaatcatgggggccggtctttcctgtgctattctcatgatagtgaacaagtctcatgaaatctgatgggtttatcaggggtttccacttttgcttcttgctcattttctctttctgccgccatgtaaggagtgcctttcacctcctgccatgattctgaggcctccccagctatgtggaactgtaagtccaattatacctttttttgttcccagtttcaggtatgtctttatcagcagcatgaacccgaactaatacaggctatgaattagaaatcaagatttggcttaagcatcacctctgctttgaaactttcctgcccatgtgtggtctggctatctaaatgtcacatcaaacctccttctcccttactgcctctctactagaggggctgaaaaccaaatattcacttttccaacttcccttgcagctaaaagtggccatgtaaactagatctgggctgtgacccctaaataaatgtctgcaggggaggcttctggaaaagcaaa

SEQ ID NO: 1779 - DNA, 1206 bp, Homo sapiens
agtctccccaccaatggatctccacttcaggatattctagttcacccttgtgtaacttctcttgactctgcaattctgacttctagtagtattgatgcaatggatgactctgcatttagtgggccttacaaatttccattcactccacctttagagtcattcaacttatgcttctacacttcccaggtaacaaccctagaatagttgagagtttgctgatctttatattcataaatactattgataagtagataattcatactcttggtatgagaacttagaaaaagttctatttatcagacaataattgatgattgaagatgaagatttagaccaggcacggtggctcatgcctgtaatcccagcagtttgggaggctgaggcaggtggatcacttgaggtcaggagttcgaggccagcctggccaacacgatgaaaccttgtctctactaaaaatacaaaaagttagccaggcgtggtgtcatgcacctgtaatcccatctacttgggtggccgaggcaggagaatcgcttgaacccaggtggcggaggttgcggtgagccaagatcgcaccagcgcactccagcctgggcgacagagtgagactccatctcaaaaaaaaaaaaaagattcacttatttgaataagatacctcttatctttggtgtcggtaactatttgtaaatagctttcaaaataattgaactttttttttaatattccctaaaaaggagttcatggtcatgggatagattttggtatgatttagtcatgattttaaccatgaacataaaatacccctcatcgcaggcaacctgaattacaaatatatattattattaatagctatttattgtttattgaataattgcttgtgtgtcagacattgtcctaagcactttacatgtattttctctagtactgtagtactgctaacaacctttagattaaacattatccccattttacagctgaggagagtctcaaagaagtgaaatgacttgcaccacgtctatagttgataaatgaaactgcctggatttgaaccccaatttttcagacttccaaacctcgtttctactataccatttatctcttgtcctagttgtgaatgagtaggttagaaaaacctactcaagctagcttaagtagagcaaatttattttgagaatgcaataggcaatctcattgccatttaaggataag

SEQ ID NO: 1780 - DNA, 1218 bp, Homo sapiens
tccgctcaccacaacctccgcctcccaggctcaagcgattctcctgcctcagcctcccaagtagctgggattacaggcacgtgccactaccacccggctaatttttgtatttttagtagagacaggagtttcaccatgttggccaggctggtctgcaactcctgacctcaaatgatctacccgcctccgcctcccaaagtgctgggattacagacgtgagccacggctcccggctgataattagatcttgatagaattttagagtaacattttttaaaattgtaactacatcccacaactaagttaccatttttttaaagctgggtttctgtattctttcttgctaaaaatatcaccaaggtgagtcagaaatttaaacataaatatatgacaccaagaatgtaccagaaataatgaataagtatttttatagccttgcattacagaagtgttttctaaatattacagttatttcagaagccatacaaagaataaccaattagttcatacagaattgaaattctagctgggtatggtggcatgagcttatagtctcagctactcgggaggctaaggtgggaggatctcttgagaccaggagttctgggctgcagtgcgctatgccattggggtgtccacactgagtgtggcatcactatggcgacctccaggagtggaggcccaccaagttgcctaaggaggggtgaaacaggttgaaaacagaggagatcaaaacacccatgctgatcagtagtgggattgcacccgtgaatagtcactacactccagcctgcagcaacacagcagaccccatctcatttaagaaaaacaaaataagattctgaagggtaaaagttactttaaatagagttgaaagaagaagcaggaaaaatatttgtaacaaacatgacacaaaagaggtgatttatttcataaataaagggctcttataaatcaaataaaagcagtcaaaaaatcaaagtgggacaaggggatgaggaggccatttccattacctgtcatccattctttgataagaacaacgaacaatagaccttttctcaatcttatgtaaactatggcacaatcacaattttaaggcaaggtccttagctttaccctttccaacaaggttgcttatcttaaactctttctgtatagaaattccggtgttgccactaaaaagaagacactcaattcaacagaataatgggcaaa

SEQ ID NO: 1781 - DNA, 1197 bp, Homo sapiens
cgtcctatctctcattgtcagacaattacgctaaagagaccttatattaattgactcgaagccccccttttctgaatttaactctccttcatcagaccatgctaaagaaaatagctaagccccgcggttgttcagggaaactaacccctcagagattggactttgtttctaaatgcggagcccaaacatgtaggaatccggaatgccatttgatggaagttggatggccttgatatgtgtttatgtaaacaaaacatattggttggtaaatatttttaaacactttgttaaaaagattcaatgactctgtaatgataaagattcgcataagttttcaatgatctttggatacatatacaaacattcttaaatctaagtacaattaaatatttagaacgctctgaaaaataattctgaagtgccgatctaatagtacgttataaatttttttagaaaagaaactacgcggagaatataaaaccatgtagttaaacagtcctcaagaagtaaaaaagcaggctaacgtaacaggcgcccggctagctcagtcggtagagcatgggactcttaatcccagggtcgtgggttcgagccccacgttgggcgcgggttgtaacttttttcctgaaacttaaacgctttcactaaagcacttaaactacagagttctcaagcagaattaatttaaacactttcaatattaaccagattctccagtaaaaagttaaccttttgtaaacgaaacaggtcacaaactgtgtttgcgcaattgaaatcacacgtcctccccgtgttctccttaaaacacagaggaaaccaaatgcccactgttaaagactagttttttgtgttactgtgcatacttggatagttagtggtagagggcagttttaattgttatcttaacaaacctatgagccccacattttggctgctcttctaaaatttaagagaccggatgtaaaaacattcagaggcacctgaggactccgaagaaaaagaaccaatttatccttctctgtttctcttcctctctctctctctctgtcctttttcctattctcaatatggagtctatccctgaagaaatatatagtgaaaaatagttctttttgtagtgagatttataccaccagtgcatacatcaagttttcttccattcttcttggggatggatactaggaaattaagattcta

SEQ ID NO: 1782 - DNA, 1260 bp, Homo sapiens
aagataaagtctattaaccttgtgttacaaatcatatcctggaagtattcaaaaatattactcaattcccatatttgtgtggtattataccatatacaagtgtttgttcttttatgttatggttttttgtttattggctttttagttcatcgcttaaatgtgctcataaaaaatgtgtatttgccagaataaaatatggtagaaggagctattttgccttaattaaatttctctctttttgttttgttttagtatcaccttttgccatgatagcatttctttcattggacagttccttacaagggctccactcagtgtctgtctgtattggattcacaagagcctttagaatggtaatcctaatatgtgtttaatagtattttcctattgctaagttttattgtaattttgtttaatagtttgcttagattatctaattctacctgataaaaatggataatttgtatactgcaggtatggcagaatacagaaaatgctttattggagacagtcattgtatcaacagtacacttgatctccagtacagacatatggtggaacagaagcctggatacaggactcagactcttactggtaagtgtgtcttttaacagctttactgaaatatattttacatactataatatttgtccatttagtggtgtatattcagttttgtagtcatcaccacaatctaattttagaacattttcaacatcccaaaaagaaacctcaactgttatttcccattccccctctccatctcgcctactacccactgtagtcccagcagctactaatctactttctgtctttatggatttgcatattttagatacttcacatgaatggaattctgcagcatgtgatcttttgcatctggcttctttcacttttatgttttcaaggttcattcatgttatagcatgtatcagtacagtcatgcactgcataaggacgtttcagtcaatgacagaccacatatacaacggtggtttcataagattattatggagatgaaaaattcctatcagctagtggtatagcccttgtagggtagctcattactcacgtgtttgtggtgatgttggtgtaaacaaacctactgggctgccagtcatatagaagtatagcatatacaattgtgtacagtatgcagtacttgacaataagcaactactggtttatgtacttactgtgctttttattattttagagtatattcctacatattaaaaaaaaagttgactgtaaaacagc

SEQ ID NO: 1783 - DNA, 1352 bp, Homo sapiens
catacactgaataatgctattagtctcataaagtgggatggaaagcatataatactactgtatatactgtataattctaattttgctttttttctcctccaggattataatttaaaagtttttattgtgtggctcactcttaactatcattatagtcttttaaaattatattcatacctactaaatttgctcaatttctagtagaatttccataatattttaaaaaataatagtagcattatttttaatctctatccagaatcaaatgtgttaagtgccattaactttaagtcaggatgttgctcttgagttaaagaaattgtttttgtcattttccatatttttgtgatgagaatctatgggcatttacatgactagttgctgtatattatgtaataaatgattataaactcaagtactttttatttcttctttaggggttagaattgcaggaaacatcctgtcatactgcagaagctcgcagagttgatgaagtttttgaagatgcttttgagcaagaatacacaagagtatgttcccttaatgaacactttggaaatgtcttgacaccctgtactgttttgcctgtgaaattgtattctgatgccaggaatgttctatcaggcataattgattctcatgaaaacttaaaagaatttaaaggtgacctcattaaagtacttgtgtggatacttgttcaatactgctccaaaaggcctggcatgaaagagaatgttcacaacactgaaaataaagggaaagcacctctaatgttgcctgctttgaacactttgccacctcccaaatccccagaagacatagacagtttaaattcagaaacttttaatgactggtctgatgataatatttttgatgatgagccaactatcaaaaaagtaatagaagaaaaacatcagttgaaagatttgccaggtacaaatttgtttattccaggatcagtagaatcacagagggttggtgatcattctacaggcactgttcctgaaaacgatctttacaaagcagttctattaggataccctgctgttgacaaaggaaaacaagaggacatgccatatattcctctcatggagttcagttgttcacattctcacttagtatgcttacccgcagagtggaggactagctgtatgcccagttccaaaatgaaggagatgagctcgttatttccagaagactggtaccaatttgttctaaggcagttggaatgttatcattcagaagagaaggcctcaaatgtactggaagaaattgccaaggacaaagttttaaaagacttttatgttcatacagtaatgacttgttattttagtttatttggaatagacaat

SEQ ID NO: 1784 - DNA, 1210 bp, Homo sapiens
tgctcggggctgcgtgtacaccatcttcgcagggagtggggtttgtatctgcaggcaggtagaagagccagggctccgggcgcggacgccgtaggggtagcttccgagtccctacttggccaagggccggcacggaggggctgtcgatctactgggcacctaatagccgcacattctgtccagtccctggcgccggaacgtgaaggcccgggtcctggctgctatccgggatccggacgctcccttcggcttcggcctggtgctccaggccgtaaggcaaaggcggcggcagcagcagcggcagagaaagaagctgggtaaggcagtgacgtcatctgtggcggcccctcccccgcccgccagccctcaccgcagttcctgcccaacgacatccgggtctctgtagctgcgcgccgcgccgcagctgtagcggcggcggagccagcggggcggggcgagcggaggggtgggggaggggcgacgcggtcgtgagcgcgcctgcgcggggccgcgctagaggcggcggcggcggcggtggcggcgctagggacgggagcgcgcgcgggagctagagagcagtggtctcggcgctcgtccggcccgcagcttcgggtcctcaggcggctgttgctccggaacgggtggttggggaggggggggtggggggactctagacagctgaggcgcgaaagcgatgagtcctcggctcttcctcctccttctccgggacccgctctctgcctccctctccaacgcccggatgatctgagccgcgagggcgccgacagccgggggcccggacgcagcccggctcctcccctcctccgccccttccccagcctgacctggcccgccgctgcagcggtgacccctcccccggctgccgccgtcgccgccgcggtgaccccctccccggctgccgccgccgccgcctcggccgaccagggacctgcccgcctgcggctgctccgggtaagtgcggcgctcgggccgacggcgggctggcgggcggtgcgggcctgcgcggcggcggcggcgggcaggcctggggcctgtaaacaagccgggcgtctgcccgggcgctcccgggaggagacgcgacaactccaccccctggccggcctcctcccccgagccgggcggcggacggcgaggggttaacgctcggcgagggcggtggcggggaggcgggggcggggtgttagttgcg

SEQ ID NO: 1785 - DNA, 1206 bp, Homo sapiens
gtcagattcagtgggctgtttagttcactttttatccagaaaatggagctaaatgagaaattgcagcttccaaagaaaatcataccttgattttatagatcaaagcctttctgattagatcagaattgttcctgagattttaggggcattcagttaaagtgccccaagaagagtgataaatcacatataggtgtaaagtcaataaagtcctatagtaagcagactggaatttagggggaggggaatacacactgttagactgttggtacctatatttgactactaggatgattatatattttaaattctgtattcagtttcttatcagaaatactgcctacaatatcttatacttaattttttaaggaacaggtgataaagataggttatattttcttcagaataattgatattcattatttaatagataaaatgtgttatctgaatgtttatagtagtagaaaccaagtttacaaaatgtctatatataatttgtttttaataaccaaggattctttctttacaaaagatttcctctatataaatcttcctgttttatagatgatctgtattataggagaaatgagtatttgttgatttaactggctaatctacaggactgagcattattagaggagtatttaaacatagaagtctgtgaaaatatttttagtgctgagggaaattggagggactttctagaaccgcaaactaatagaaaaccaggcatagtggctcaagcctgtaatcccagcattttgggaagccgaggcgggaggattgctgaagccctggagtttgagaccagccagggcaacacagtgataccttgtctctacaaaaaaatttttaaaattagctggacgtggtggcacatctatactcccagctacttgggaggctgagacgagaggatcacctgagcccaggagctccacgctatagtttgagttgtgatcgtgccattgcactatagcctgggtgacagagcaacaccctacctcaaacaaacaaacaacaaaaaaacccttctacctctgaacatgtggggatttaaagattgctatgatttaaatataaatcatgaatatagaaaatatgagaacagaagagtatttgttaaacaagactaagctgtgctgcataaagtaaggcactatcattgtgctggtattttctgattctcttagtgcaataaatgttaaa

SEQ ID NO: 1786 - DNA, 1195 bp, Homo sapiens
tgcccatgacgggctacatgtttggtaaagggatctatttcgctgacatggcctccaagagtgccaactactgccatacatctcagggaggcccaacaggcttaatcctgttgggagaagttgcccttggaaaatgtatgaactgaagcacgcttcacatatcagcaagttacccaagggcaagcacagtgtcaaaggtttgggcaaaactacccctgacccttcagctagtattactctggatggtgcagaggttcctcttgggactgggatttcatctggtgtgaatgacacttgtctactatataatgagtacattgtctatgatattgctcaggtaaatctgaagtatctgctgaaactgaaattcaattttaagacttccttgtggtaattgggagaggtggccaagtcactcccgatggctctggtataaattcagccgaagcccttctgcaccaactcacctggccggctaagttgctgatgggtagtacctgtactaaacctcctaagaaaggattttacagaaacacattaaaaggttttctccaacttttcgagtcccttgttttgtgttgtgtttgtggggaggggttgttttggggttgtttttgttttttcttgccaggtagataaaactgacatagagaaaaggctggagagagattccatccgcatagactagtcctgtggaaaaaaaaaaaaaaaacaagctccattagaatgtctgccttactggtttccccagggaaagaaaaatatgtttccacccttttttctaagtgttcatctttagttttgattttggaaagttgttaagcattcatttttagttaaaaataaaaactaatttcataccattaaaaaaaaaaaaagaaagaaaagaaaggcctgtgcccctggagtgagagggcagggatgagaaacagcaaaggaggcaggtgtgaggcatgtgttcatttggagcactgctataacaaagtaccatagacaggtgtcttcaacaacagaaatattattgtcccacagttctggaagccaaaaatccagaaccacggtgttggcagggttcattctttccttgagctataaggaaagatctgttcccggcctctctccttggcttgtggagggctgtcttgccccgtgtgtcttcatatcaccttctttctgcatgtgtctctctctccat

SEQ ID NO: 1787 - DNA, 1150 bp, Homo sapiens
atatatacacacacacacacacacatatataaatatatatatgtgtatatatgtatataaatatatatgtatatatgtatatatataaatatatatgtgtatatatgtatatatatataacgtgtatatatatatatgtagctgaattatatttgctaatattttattaaggatttctgtgtaaatatccttgagagatattgtagtttcttttttggtactgtaaaactggctttcataaaattaattgggagtgtttctttctcttcagttttccaggagagattgtacataattgctgttaaatctcctttagatgtttggtcaaattctctagtgaaaccatctggacctgtagatttctttttggggagtttctacattattcattcaatttctttagtattaatagggcaattcccattatgtatttaatattggatgagttgcagtagtgtttttcaaagtatctgtccatttcctctaagttttcaaatttgtgtgtgtaaagttatttgtagcattaacttattatctgcttgatgtctgtagtgtctgtagtggtatccctatttcattcctaggactgtattgctttcttctgtctttgcttttgtccgtctttctagaagtttatcaattttactgatcttttaaaagaactagctctttattttattggtttttttcccctaatgttcttgtattttcaacttgattgatttctgttttaatttttattatttccttccttttgcttgctttgggtttattttgttcttttcttagattcttgaagtggtcatttagattatcgatttcagacttttcctcatttttaatgtatgcatttagtgctataaatttccctctcagcaatactttgactgtgctatacaagttttcatgttttattttcattctgtttgatgtatttaaaaatttctcttgagacttcctctttgactggtatttagaagtatgttgctcagtttcccagtgattggagattttcgttttgataaagtagcatttttgccttttatgttagaaatgataaagttagaatccaagatgtcttagagttctgtttattttattcagataagtgcttaggttctttgatattaaaaagatgattcttattagg

SEQ ID NO: 1788 - DNA, 1203 bp, Homo sapiens
ctgaggtgtgataattgcttgagcttggggggcggaggttgcagtgaactgagattgtgccactgcactccagcttgggtgacagagccagacttttgtctctaaataaataaataaataagtcataaatatttaaggatggacccagcagctctgcttgaattaaaaactgtatatagcccaaaagtccattgagagctgactgataacaaaagcagggtacacccttacaatagcatgctgtgtgtctgtttcgaaggagctagatatgtgtataccaatgtgaagagatgctgaagagctggtgagtgaggaatgctaaccgcaggacagaatgctgtggtgcagttcattgagtttagggatatgcatgtctacccctactggtatggagcatgttaggaacttgggacctctggcaagattgttaaggagagcaggaggtgagggagcgggagctgggatttttgcttttcccttcatccctttctgtactatttaattctttttagataactatgtgtacttctctgacttactgaagggttttcttttcttgtattgtctctcacttagaaagcagatgcatatacagtggagctggagaacgccgagagccgagtggccaaactaagagatgaaggggagaggcttcatttaccttatgctttactccaggaggtttacaaattagaggtatgcctgagcagaaaacattgactcagcactgtgattgtgaggagccagatccttttcttccaccagcagagtttagatttgtctttcagttattgccccggttggatgaaaatgcatgtgtgcacctgctcttctcttttcaggatgtacttgacagtatgtggggaatgctaagagccaggtacacagaactcagcagccctttcgtcactgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtgagacagacacatgggtcgggtgaccccttcatagactaaaatcttaaggtatttctgaatgtgaacagaaaggatccatttttcttctttgttgaaatttaagctattcattcttttaataaacatctattagaatgcttaatgtgtaccaggaacc

SEQ ID NO: 1789 - DNA, 1127 bp, Homo sapiens
tgatcttcaggcttctcagaaatgcctttgtaaattagtgatgctctgttgatgtttatcagctcccattttggaaaaatgcccacactttgtctccttcaagaaatttcaaggtgaaggaaataatatttatgtattatttatttatttacttatttttttagagataggtactcactctgtctcccaggctggagtgcagtggcgtgatcatagctcactgtaacctcaaacttctggtgaggctacctcggccacccgagtagctgggaccacaggcactcaccagaatgcccagccaggaaaacatatttagaacagacaaaaactatttaatttttcctctaaaaccaaatgcctttgggagtatggatcaattttaaagtttttactttatttttgtattataaatacctagtttcaatctctttaaagaacgcccatgtagccaggtgtggtggcgcatctcttaaaaaacaggaccttcgctactctctgcacactgcctgcggagcggccctgctctgcaggagcagtcacggagctgtaacaccgccactaaaatatagaaaaaaataaaaataaacaagaccttgtctcttaaatttttttttttttttttccttgagacaaagcgtcactctgtcacccaggctggagtgcagtggtgtgatcttggctcactgcaatctctgcctcccaggttaaagtgattcttgggactcagcctcccaagtagctggaattacaggcatccaccaccatgcctggctaatttttgtatttttagtagagtcagggtttctccatgttggccaggctggtctcgaacccctgagctcaactgatctgcctgtcttggcctcccaaagtgctgggattacaggcatgagccatcacttcgggtctaaaactattgtttttaaattgtttttaattttcagaaagcctacatgatattcggatgaaattttttaaagctgcgcctttggggcacacatcaatgtacatgtttatgtgctcataaaaagcttaagaaatgtatattttttgtattttaccctttctcgcgttctttccttttacatttgtttagcgtaatataaggtctgttacttgatttcagg

SEQ ID NO: 1790 - DNA, 1322 bp, Homo sapiens
gacaacaggcacatgccaccattcctggctaatttttagtagagacggggtttcaccatgttgcccaggctggtctcgaactcctgacctcaagtaatctgcccacctcagcctcccaaagtattgggattacaggcgtgagccactacgcttggcctcatagcgtattttaatattggttgagactagccttgctcattgatcttctcttagcgtttacttggttattcttgcttatttttccataagaactttcatttttatttaatcctgtgttttttggttttaaagactattttataataaattttcgtgattaaactcttgtgcttaaactcttgattaaacaaacaagcaatgaagagatgaatgaagcagaaaatgtgagtttcatgcctcacattcccactcctctgaggttaatattttcatgtatatttttcaggatgtatttgtaatctcatacaaacgtatgtatttttttaatgaaaatatttaaattttcatagttaacagctgtagctctaacttggcaatatcttctgtgtttctttacagccattatacttgcccacgaatctttgagaacattataatgacctttgtgcctcttcttgcaaggtgttttctcagctgttatctcaagacatggatataaaaaactcaccatctagccttaattctccttcctcctacaactgcagtcaatccatcttacccctggagcacggctccatatacataccttcctcctatgtagacagccaccatgaatatccagccatgacattctatagccctgctgtgatgaattacagcattcccagcaatgtcactaacttggaaggtgggcctggtcggcagaccacaagcccaaatgtgttgtggccaacacctgggcacctttctcctttagtggtccatcgccagttatcacatctgtatgcggaacctcaaaagagtccctggtgtgaagcaagatcgctagaacacaccttacctgtaaacaggtaagtccagtcttcattctgaattatagttgctagccatttctcaaatcactttatggttgagtgagaaggaaataatatgttagacaaggtctttattgtattaattacatagtttacttacagcacccaaaacacaggatgccctgttctattctgatattttagttctcattaaaaactggtatgtgtacatcagtgttgtggggagaatttgctatcatgactattgtctttatacagtaaatactgaacttaagtcactccttttctttttttgagacagggtctcgctctgtcactcagactgga

SEQ ID NO: 1791 - DNA, 1203 bp, Homo sapiens
caggcccccaaaatgccactacaacatgccccactgatgcagattttgttcaacccaacctaatggctttagactaaaatattcaaaggaaacaaataaagaagagagggaaacatttccctgatttttttttttttttttttttgagatggagttttgttcttgttgcccaggctggagtgcaatggtacaatctcggctcactgcaacctccacctcccaggttcaggcgattatcctgcctcagcctcctgagtagctaggattacagcccagctaattttttgtatttttagtagagatggggttttgccatgttggccaagctggtcttgaactcgtgacctcaggtgatccacctgcctcggcctcccaaagtgctgggattacaggtgtgagccactgcacccagcctccctgattattttttaattaaaaaattaatgcaaatatcatgaacaataaagaaagactaagaaactctcttagaaggaaactaaggatcacttcttggtcttttggctaagatcaagtatagtatctgtttttatcagtttcatatctgatatgtcctctatccaaggacaatatattaaatggatttttggaaacaggagatggaataggagcttgctacatccactccacacattgacctgatattgcagtacttccaggaacagtgcacccaaaccttgaaaaaaaatttttttttttttgagacagagtctcactctgtcgcccaggctggagtgcagtggtgccatctctgctcactgcaagctccacctcccaggttcacgtcattctcctgcctcagcctcttgagtagctgggactacaggcacctgccaccacacctggctaatttttttgtatttttagtagagacggggtttcactgtgttagccaggatggtcttgatctcctgacctcgtgatccatctgcctcagcctcccaaagtgctgggattacaggcgtgagccactgcacctggccgaaaaaatacaaattttaatgaaaaaacaaaaaaagaagaaggagactaaggagacaggacaactaaatgcaatgtggaatcttgggcctgaaaagaacattagtgagacaatgatgaaactggaataaggcatactactactactactactactaatgttattattagttaataatgttatgtcaatgttaattttatgat

SEQ ID NO: 1792 - DNA, 1200 bp, Homo sapiens
gcaagtgaggctctgggtgaagatcagcagaggtgatgagaagcaatgagaagatgttttccagaagctccaggcacagagagtcaggaatactgcacagatactgttgacacctggccaggtaagttgagaagagatttgcagcacctacaaaaacatgtacaagagaagaggccagagaaagagaagacagagaatgcaaacattagaaacattacctcccagcgtcaaacattctcgcaactttagctcatttatttattttttaattataagggaactgaggttacagtgagaagaataagagacttaggatgtcttttaatgatttgcagaaagattttgccattttaaaagtacagctggccgggtcccgccccgaggccaaccgggcctccccagccttttggccaccaggccccgcccccggggagggcgctgagctccgcttggcgcctctgatctttatttctcgcgccgcggtttcggtgggaggggcgggggtgatttacggatactctctgccctcagatcctgggaaaagtctattccgttcccagtgacaaagaacagagagcagtgtacgatgagcagggaacagtggacgaggactctccagtgctcacccaagacctagactaggaggcgtactggcggctactctttaaaaagatatctttagaggacattcaagcttttgaaaagacatacaaaggttcagaagaagagctggctgatattaaacaggcctatctggacttcaagggtgacatggatcagatcatggagtctgtgctttgcgtgcagtacacagaggaacccaggataaggaatattgttcagcaagctattgacgccagagcggtgcaatcctataaggcctttgtcaaagaatcgaaacaaaagatgaatgcaaggaaaaggagggctcaggaagaggccaaagaagcagaaacgagcagaaaggagttggggcttgatgaaggcgtggatagcctgaaggcagccattcagagcagacaaaaggatcggcaaaaggaaatggacagttttctggctcagatggaagcaaagtactgcaagtcttccaaaggaggagggaaaaaatctgctctcaagaaataaaagaaataatagaatttttctcttcaaaggtccttaggtgtaaattgatgccatggtaggcaaggtgctggcaag

SEQ ID NO: 1793 - DNA, 1173 bp, Homo sapiens
gcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctcttaaagaaaaaaaaaaaaaagttgtgcgcggctcacagtggggttttttttttccgccttcttttctcgtctcccctcccccttcttccttttgaaagtttcttctcctccccctgccccccctccccgcctgaccgcatggctgattcaactccagtgtcaatcaacttctttttcctcctcttcctcatttaaataagtttaaagctcctcctccccccggcccaccaaatctgaactttataaattgggctttgcgcgccccagcccggagtcagaaaggcgaggggcgccgggaactggcgtgtgggactccagacaggagaggctgcgccttccccgcaccgggaccttcgcgacacaccagatcctcgcccctggctcgcgcgaacgcacaggatgaccaccaccctcgtgtctgccaccatcttcgacttgagcgaagttttatgcaaggtaaaggggggcggagcatttgcttttcaaaaagtctttttcttttgccttaagaaagaacccccaaaagtttgggtcttggaaggcaatggggaaagtggtgcagcgagatgattcttttctcctccggcatttctcccaagtttgaaggaatttggccccgtccttcccaccctttgagtttcaacagttgctggcggggattacatgtgaatctggaggccagggttttgaggggcgaagtttgcctggcagggcagcccgggggcttcggggggagggctgggattgggacaagttttgggcgatcctgttttacgtaacgtgctgctggatcccaggtttgctggtctgatcgggttcccagtctgcgccctaggtctgtccagcggcattacccacccgtggggttgggagtgggaggtccctcggggaagtgagtctcgggacaatgttttcctccactctttggggggagctggggatatgcgaggaagaaaggccaagttgtgattcaaaaagatgttgcaga

SEQ ID NO: 1794 - DNA, 1132 bp, Homo sapiens
ctcttctaaagccaatgttaagagtcttatgcttacattttaggaatttgaggatccaagggatgcagatgatgctgtgtatgagcttgatggaaaagaactctgtagtgaaaggtgagattcctgtgtaactagataaccctgggacatagagcagactgggtctgctggcatatttttctaagtagatttatgtagcttaagtgtgtaacggagatttttcttccctttttgtagggttactattgaacatgctagggctcggtcacgaggtggaagaggtagaggacgatactctgaccgttttagtagtcgcagacctcgaaatgatagacggtatgtgaagggtggatggctgcattgaacaattattgtaggggtagcatttaagattcaggagtcattagcagtgatgattttgggtcctgccgtataatctgttcttctattcccacgttagccagttgttcttgatgaatctatatgagtcatagaacacaaatctattgacggaagtcattagaatggcttgtgatatctgatggcttgaacttgcccacagttgaacacaagtgctgtcattgcatttcttccattgtgaatacgaattttcttcctcagaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatttaattaaatgtaatttgggggatattttgaactttaatattagtgatcaaatgtaaatgttttgaggatatttttcttgttttttaaaatcaatttttaaccaaatattaaaccctttatttgccagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccagg

SEQ ID NO: 1795 - DNA, 1194 bp, Homo sapiens
actccagtctttatggctatttgtgggatgaggaatttgccagtttaatggagacttttaaaaataaatcgcttttgaaagattaggttgaaatgtaatcagtgtagtgtctcatcagtcattactgaacttttaatgctaatgattttactgtgagataacctgtaatctttagtcatttatgaatgtctatttaccaatgattcagcaaccatacaggccacctttcagcgtgtctttgaaagggttctaggaacacagataaaaatatatgatccttaccttaaagacactggcgatttcatgggcacagaaacaaacatgtgtgaagtactgggatagcttaggaagccgatcccccacgtgtcccatttaccagagtgaatcagagtgcaggtgatgcggaatattatcttccatgctattcctgaaatatttccatctgtccctgcctctctgttaccactgaaatgttcctttttttaattccttatcatcttttcacctattaaagtagcctcttaagtggtctccagaagagaagctccagatctactgcaggctactccagtgaaacttatccttttggctaagatcaagtgtagtatctgttcttaacagtttaatatttgacacattctctatccaaggaaaatatgttaaatgggtttttgaagcaaggagatggaataggagtttgctccaccactctacacatcaacctgtatttcaatacctccagaaacccaggaacggtgcatctctcccatcttatttacttccttttgatatttcaaaattcatgcagaccaggcatggtggctcatgcctgtaatacctgcagtttgggaggctgaggcaggaggatcatttgagcccaggagttcgagaccagcctgagcaacaaagcaagaccccatctttacaaataataataataataataaattagccaggcatggtggggtctcagctacttgggaagctgaggtgggaagatcacttgagcccaggaggtccaggctacagtgagccgtgatcatgccactgcactgcagcctgggtgacacagctagaccctgtttcaaaaataaataaataaatctcacgtggcatccaggttagttaagcgtatcacatctcctactttccctaagatcctagaagccaaaggcgctgctctaaaactctagc

SEQ ID NO: 1796 - DNA, 1144 bp, Homo sapiens
ctgttacattattgaaaacaggtattgaaccatcatggtactgggttagaataattatatatcttgtttttacatactgtcttacttaaatgctatgtagttttgtctagtatcattaatttccttgagttttcaggttgttaggtttgtaactgggttcttgtatacatctgcctggggaaacagctagatctagaacttgagataagcagttaaaaatgaatttgaaaatgtgagccattcatattaaccatttatctcattccccccacccatatctccctcccaaaaaatctacttttgatatctagtggatcaaacaaagaaagaggcagaacctataccagaaactgtaaaacctgaggagaaggagaccacaaagaatgtacaacagacagtgagtgctaaaggcccccctgaaaaacggatgagacttcagtgagtactggacaaaagagaagcctggaagactcctcatgctagttatcatacctcagtactgtggctcttgagctttgaagtactttattgtaaccttcttatttgtatggaatgcgcttattttttgaaaggatattaggccggatgtggtggctcacgcctgtaatcccagcactttgggaggccatggcgggtggatcacttgaggtcagaagttcaagaccagcctgaccaatatggtgaaaccccgtctctactaaaaatacaaaaattagccgggcgtggtggcgggcgcccatagtcccagctactcgggaggctgagacaggagacttgcttgaacccgggaggtggaggttgccctgagctgattatcatgctgttgcactccagcttgggcgacagagcgagactttgtctcaaaaaagaagaaaagatattattcccatcatgatttcttgtgaatatttgttatatgtcttctgtaacctttcctctcccggacttgagcaacctacacactcacatgtttactggtagatatgtttaaaagcaaaataaaggtatttgtatatattgcttcatcatgacttttttcttcatcataactgatatttttcagatgcactttgaagacataaaggatgttaaagtagtaactaagcatatttctttttgttcagttacataatcctcagtatta

SEQ ID NO: 1797 - DNA, 1358 bp, Homo sapiens
cccagcctgataaacatggcgaagccccgtctctactaaaaatacaaaaatcagctcggtgtggtggcgggcgcctgtggtcccagctatttgggaggctgagccagaacaatcgcttgaacccgggaggtggaggctgcagtgagccgagatggtgccactgcattgcagcctgggcgacaagagcgaaactccgtctcaaaaacaaacaaaaaaaactccgtctcaaaaaaaaaaaagaaaaagctacacaaatagccaactggcacatgaaaagatacccaacatcattagtccttaggtagatgcaaatcaaaaccacagtgagataccactttatttatttaattttatttacttattccctcctaccccccttttggctgaagtgcagtggcgcgatctccgctcccggcaacctccatctccccggctcaagccgtcctcctgcctcaacctcggagtagccggaattacaggcacgagccacaacaccaggctaatttaaaaaatatttttggccttccgccacggccgccatggagagcagcagccatggctctgcgctaccttatggccgtgggcctcaacaagggccacaaggtgaccaagaacgtgagcaagcccaggcacagccgccgccgcgggcgtctgagcaaacgcaccaagtttgtagcgggacatgatccgggaggtgtgtggcttcgcttcgtacgagctgcgcgccatggagtcactgaaggtcttcaaggagaaatgggccctcaagttcatcaagaaaagggtggggacgcacatccgtgccaagaggaagcgggaggagctgagcaaggtactggctgccatgaggaaagccgctgccaagaaagactgagccccctcccctgccctcttcctgaaataaagaacagcttgacggaaaaataaaataaaaataaaaaatatttttgtagagacggggtctcgctttgttgccgcccaggctggtctcgaatttctggcctccagcgatcctcctgccttggcgcagcgttgggatgacaggcgtgagccaccacgcgcggcagcaaatctgagatttaacacagagagccagtatgtgcccagcgtatgtgtatgtagtgcacagaatatgtggaccaccctctataaaggttcatgcatgaggaggtcggctctctctcacagtctagcagttttccacacaaaagcggcacacatttttgcaccggtctccaaaatggtgtctggtttgggagcccgcagcttccggaattacaggctctttcctgcttccagggcaccattccaggcctggcctcaataggcccaaggcgcaggcccagaggaggccgggc

SEQ ID NO: 1798 - DNA, 1209 bp, Homo sapiens
tattcaagatagagttgctctggtccaaacgcctctgacacaaggattttaaagtcttattaattaaggtaagatagttccttgcatatgtggtctgaaatcacagaaagctgaatttgaaaaaggtgcttggagctgcagccagtaaacaagttttcatgcaggtgtcagtatttaaggtacatctcaaaggataagtacaattgtgtatgttgggatgaacagagagaatggagcaagccaagacccaggtaaaagagaggacctgaatgccttcagtgaacaatgatagataatctagacttttaaactgcatacttcctgtacattgttttttcttgcttcaggtttttagaactcatagtgacgggtctgttgttaatcccaggtctaaccgttaccttgattctgctgagaatctgatttactgaaaatgtttttcttgtgcttatagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctgtacgtatgagttttgttttattattctcaaagccagtgtggcttttctttacagcatgtcatcatcaccttgaaggcctctgcattgaaggggcatgacttagctggagagcccatcctctgtgatggtcaggagcagttgagagagcgaggggttattacttcatgttttaagtggagaaaaggaacactgcagaagtatgtttcctgtatggtattactggatagggctgaagttatgctgaattgaacacataaattcttttccacctcagggccattgggcgcccattgctcttctgcctagaatattctttccttttctaactttggtggattaaattcctgtcatccccctcctcttggtgttatatataaagttttggtgccgcaaaagaagtagcactcgaatataaaattttccttttaattctcagcaaggcaagttacttctatatagaagggtgcacccttacagatggaacaatggcaagcgcacatttg

SEQ ID NO: 1799 - DNA, 1126 bp, Homo sapiens
ccaggagttttagaccaacctgggcaacatgttgaaaccctatctgtacaaaaaaaattagaaaaattagctgggcatagtggcacacacctgttgtcccagctacttaggaggctgagctgggaagaccacctgatctccggaggtaaagactgcagtgagccgtgattgcaccactttactccagcctgggcaacaaaatgagaccctggctcaaaaacaaaaacaaaaacaaaaaaagagtaaattaatttaaagggaagtattaaataaataatagcacagttgatataggttatggtaaaattataaaggtgggatattaatatctaatgtttgggagccatcacattattctaaataatgttttggtgaaaattattgtacatcttttaaaatctgtgtaattttttttcagggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatggtaaaacccaagactgataatttgtttgtcacaggaatgccccactggagtgttttctttcctcatctctttatcttgatttagagaaaatggtaacgtgtacatcccataactcttcagtaaatcattaattagctatagtaactttttcatttgaagatttcggctgggcatggtagctcatgcctgtaatcttagcactttgggaggctgaggcgggcagatcacctaagcccagagttcaagaccagcctgggcaacatggcaaaacctcgtatctacagaaaatacaaaaattagccgggcatggtggtgcacacctgtagttccagctacttaggaggctgaggtgggaggatcgattgagcccaggaggtcaaggctgcagtgagccatgattgcatcactgtattccagcctgggtgatagaacaagaccttgtctcaaaaaaaatttggtttttcaagctttttgaggttttgacaag

SEQ ID NO: 1800 - DNA, 1205 bp, Homo sapiens
ctggacaaaaagagcaaaactgcatctcaaacaataaataaataaataaataaataaataaagactgttatatatgacattctttgacacctaatcaaagatatatggttaagcttatgcttatttagacctttctaatgctacagttcccaaagttctcctcccctaacacacaagcattgaaaatcatgaatcattctttaaaagactacatattaggaattcataggaactgagtttttaagatctttttcacagtcttaatttataaatcactgaatgagaataaaagatctaacatttctgtcttagtagatatgctttgtgacatatagtacattactaagccttttatctgtctgaaaaatggatccgaaccctgcttctaacttatgttttaagagacactgggaaggaaatgggtaaaaggacctagagggctttcgaatttgtcagctctctaaacgcaaattatttgaagacattgctaaggtcttcattctctttattttcttgagctgaaacagataagatagtcgttggttcatcagttgcccctggcaacactgccccatccccatcctctcccacctctcctacttctgatgccacgacctctctggagatgaacaatcctcatgccatcccacgccggcatgctccaattgaacagcttgctcgccaaggctctttccgaggttttcctgctcttagccagaagatgtcaccctttaaacgccaactatccctacgcatcaatgagttgccttccactatgcagaggaagactgatttccccattaaaaatgcaggtaatgtagcatctacctgactcactgggtactcgagcactgaagcattctcatcacttcccatgaagacactaatcccattaaactaggcattcctctttccctgaggttcgttgatagttgtatcttttgtcatttcccatagtgggaaaactaaggtccgtggagggggatgtgaatccataatttctcttcaacaaacaggcagcagagccattgtggaatttctagcctaagccataagatttgtggtttgtcctgatgtaagtgcattcactgcctttcagccaacctgctcccaaacatcaagggtctcaagtttctattcttattctgccattgggacccagcagggaattaattaaagaggccttagaaacacatagcattacc

SEQ ID NO: 1801 - DNA, 1209 bp, Homo sapiens
ctcacactgccggcagggtctcaggagactgcatgcacctatgttctgcagaacatgcctggcccagagcctccgcatcccacatttccaagggcaccattcatgtagcatgtgatgagaatccacctctgccctggcccctggcccaatggccctggcctctgttagccactctaccaggatggtcagatgacactgtgacccatgcctggagccgtctccccttggactgctctgatgcctggcaggctggctcgaaggagagaaaagccatcttattttgtggaaaccaaggagtgagttaggaagagctagagccttcacacctgagcctcttccactgatggtatcaggagcattaacaacaacaagagccagtaccttcatagcactcactttgtgcagggtgcactttaaacatcctctgtggcgggtggatgaggaacgtgaagcacaatcaggtaacttgtccaaggtcatgtagtcaggaagtgcagagctaggatttgaatccagacaacctgacaccagggtccctcttcttaatacctgtaccctgctgccaggtatcttaccttcatttctgggcctcactttctgcatctgtgaactggaggtgatggtactattgctgtcactgctgctgctactgctactattagctaacaactgagtatgtactagtgccccacactgcgctaagctcttcacatgcattatcttagttcgacctgtcaatcatcttatgaagtaggtgtatgcttatcatcgtggcttacagataaggaagctgaagctcgggttgcttgggaaacacggccaagctctgctgctgcaagtgctgagctcgggctggacccaggcagactgactccagaactccaggctccgatctcctgggcttcgttcactcccgacaccagcgaggcctggatattccagagtgtggaatccccacagaccatagcagatatgggagtctgagggagcccgttggatctttctccttcctcccacaggcccctcttgggtccacatcagctccccaggaactccacctgactatccttcaggtgactgcccctgcctctgccagtcccaagcctggctgcaaagcctcagtctcaacagctcccttccttcaaggaccagccccaggcccttctcggtaggagggcttcacagctaatagtccaggtgtgtgaaaaa

SEQ ID NO: 1802 - DNA, 1203 bp, Homo sapiens
ttcctaagcgagaatcgtacccgtagaccaacgagtcacagaagtctatttctttttcactgttacactaataaggcagatagaccgcatgattgaggttagtcaggcaagaccagaagctcagagtagaaaacatgtatggtagaaggctgggaaataaggtagtcctcctgttgcagaagtttgtcttagcactaaccctggatataatgtccagatgggtgaaaaacagaaacaaacatttcatttaaagttgtgagattattacttggccacttcagtgatttatgagtcatcctggatgaagtgctttcttaagcctaagtcaaccctcgatgactattttattttttgagatggagtttcactctgtcgccaggctggagtgcagtggcctgatcttgattcactacaacctccgcctccggagttcaagtgattctcctgcctcagcctgccgagtagctgggactatgggcacatgccaccacgcccagctaatttttgtatttttggtagggacgggctttcaccatgttggccaggatggttttgatctgttgaccttgtgatccgcctgccttggcctcccaaggggagtaatcccttggcctgtaatcctgggattacaggcgtgagcaactgcacccagcctattttttaatagtattcttgcatatataatgttaaaatagaggatgaagagtatcagtaattagaaatatgtttatgtatgcatttcaatattttaaattgcctaggtgtttttttttttccttggaagtttacattttcttgggcttgataggtgctttgaaagtacttgctgaatttattcagtggaaacctgtgaaattgggaagggagctaagttgagccagttatctgatggacatttagggaccctgaggactagagaatagtgccttatgtcattgtgtgtgtgtctcatagtgctttgcatattgctgatacccagtagacattcgttacttgattggagctagagtttttgccactaaattttgcttggttgcttctcatttcagacagtgccagtggcatatacttttcttgtttttcagctgctcctgctaaggccaagccggctgaagctcctgctgctgcagccccaaaagcagaacctacagcagcggcagttcctccccctgcagcacccatacccactcagatgccaccggt

SEQ ID NO: 1803 - DNA, 1215 bp, Homo sapiens
atttctcccaatatgtttcaggtttgggaatatgatactgccagtaaatctttttttccctatgacataatttatattagaggcagatctatttacttacatcccgttagtcaggacttctcaattccttgggctgttaattacctccctgctttaatgctgattcaaatcactctcagaccttttcttcatgccagactcccttaagtgccagcagccagaagttagcagttcctcaatgaagaaaacacacttagaaacaagacttagacacagattgattcccaatggaaaagagaaaaacaataaaggttactgtaattcaaaaaggaaatttgataataaaaaatcccaaacacccacacataagtgtgagaaaaacaatacggttgttaagccctgtggcagcttttgaaaaactattaagtagtatttggaaccagtagtgaagtgcaaatgaagtagcactctttttttttttaacatttgaggttatctctttaggtgttaccacaaaaatctggaagatctgggccttgaatttgtatttccagacactagtgattctctggtccttgtgggaaaagtaccactatgttttgtggaaagagaagccaatgaacttcggagaggaagatctactgtgaccaagagtattgtggaggtaagacacagctgcagatgttaaggaaattgctgagtgatggtaacctcatattttgtctgtagattctctgaattcatcttttcttcaacaagtattcatggtatttacctgcggtgtgccaggagctagaaattcagagatgagttagctcaaaataaggaagaagggcatttaaagaattatagtcagtgaactttggctagtagaggtatgtgttttgctttcttcccagtgataaaggtaatgaaaactaagagtctagaatgcaccaagatagtttttcagaagtgttatggaaacacagaatgacttgtgtgcctggggaggtgaagtcaatgaaaatgtcacagaaaagctgttttcttaagaaaagtttttacttttgagagaccaggtctcactctgttgcccaagctggagtgcagtggtgcaatcatagctcactgtagccttgatctcctgggcacaagcaatcttcctgcctcagcctcccaagtaactcggactacagacacgcaccaccatgcctggctaattttttccttttt

SEQ ID NO: 1804 - DNA, 1178 bp, Homo sapiens
tgcttttcttttggtagagagatggaggaaaaagtcactctgcttaatgcacctacaaagagaccaaggtaatgttcaagagactcttaaaaactaatatatccgaaattacaaccagggggttctttcttgagtgtaggcattatttgatccgaggatactttggcatcctttcaggagccagcatctgcttaaatgtcagacagtcatttctaagaagaaagctataatttcaccctcacactaaagtggccatcattaccatgatgaatgtggaaaagtgtaggtgttatgggtcagactggaatctgatctggccaagctgtgatgaagccctgaggcaggaattgcaaagtctgctgtgatagagcacattgaaacaagttgtcgagaaagaacatactttctcataccataattggcagttcttctcagggaacagactggaagcatttttctttgatattgtttttaatgttaaatgttcctttgttctgggggttgttggcaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtggtaagtgaacgctaagcattttggaacagtgctgtaagcctaattgtttactgggcccacgatgtctaagcattttattagttgaacctatactaagggagtggcaacatggggtgatggaatggaagctcttataagagcagggattttgtctgtttagttcactgatgtatgcccagggctggtacatattaggtcacctataaatgttttttgaatgaatgaatgagagagggagagaaaaattgaaagactcaggagactggggtttcccatttacagctggatgatttcagacaagtcactcaattactctgttatattaccatgaggttcagagcaactattacctgtgaaatagctttgtaaacaaaggaaggactataccatgtcaggaaacccctgaagcccacagcagtgattgaagatggctaggtatattttgtgtagaatttgtttgttgccctctagatt

SEQ ID NO: 1805 - DNA, 1138 bp, Homo sapiens
tcgctgggacgtgcctggcctaaggcatcctaccaacagcaccatcaaggcacgttggagctttcttgccagaactgatctcttttggtgtgggaggacatggggtaccacctacacccaacaagtcaatgagggacttctttttaatttggtaggattttgactggttttgcaacaataggtctattattagagtcacctatgacaaaaaataggggttacctagataatgccaaagtcagcatttgtcctgggttcccttgtgtgatctgtttggactatgttttcttttcttctcccacttgctcagcagcttgggcttccattctagttcttttaccaagatttttgtgtgaccatgttgacttcatttggattgccctctttcaatttccttgtgaaaacacccttaactttctctttacccttagctgaaatgtttacatagcttctggtgatatcttttcatgattttatatctcttaaaatggtgatggatgtgacacctcataaaagtgagctttgaactgtagataactcttaaagaaaatgtcattttagacaattaaaatatttgtgctcaactgcttgaacttttttcgtgtatgtgtatttaattctatgcaatattatcacatgtgtagattcatgtgaccaccatcacaagagacagaacagttctgtcacatggatcccttgcactgcccttttacagccgcagccacatccctttcttataccctcaccccaacctgtggctaccactgttctgtcctccatctctgtaattttgtcatttcaagaatgttgtatgaatggaatcatacagaatgtaatcttacgaggctgatcttttttcattcagcataattcccttgaaatccatccaagttgttgcatgtatgaatagtttcttcctttttttcttttaaaaatgttttatatatttagggggtataagtacagatttcttacatgcatatattgcatcgtggtgaagtgggggcagttccttttgattgctgagtagtattccatggtatggatgtaccacagtttgcttaaccattcacccactaaaggacataagagttgttttcagttttttgccctaataaagctgctgtgaacattcatg

SEQ ID NO: 1806 - DNA, 1218 bp, Homo sapiens
taagtcagtcaggcgcggtggctcatgcctgtaatcccagcagtttgggaggccgaggctggtggattgcctgaggtcaggattcaagaccagcctgcccaacatggcgaaaccgcatctcttataaaaatacaaaaaattagctgggcctggtggcgggcacctgtaatcccagctactcgggaggctgaggcaggagaatcacttgaacctgggaggcagaggttgcagtgaggcggagtttgcaccactgcactccagcctgggcaacagagtgagatcccatctcaaaaaaaaaaaaaaaaaaaaaaaagaaaatacattaagtcaaaccactgtaaattgtggaacatctgtgtttgttttggtaagcagttaatatattttcttaaatcaatttgagcattttgagaattgtttcaaagcttcattagggcaggtctagagttagccctaaacactaatgcctggttgttcaataagatctctactccagctgagtggagctgagcctcctccagttctgtataagtgctggggattgtttagctcacaccttttcagtagttattgaaatatcataatgcagtctatggccataccaccctgaacgcgccagatctcgtctgaaatatcataatgcgtaaccccctctaagtcaaggaggttgtgctcaagtctgcccaggcttgtggagtttcaccctacagaggcacagcttagtatccagtcggtctggacttctagagcttttcctctccattagctccccagtctttcagactttgcttctaaaattccagccacttaagccccactaaacttcagtctcccttcaactcagtgagaccttcgtgctatgtgtggggctcccccaagctgtgccaaagtccaggaatgacctctagtgacccagggcttactttatctgttttcctgctctcaggaatcaaagtcttaggctgcttattatccagtgtctggaaacagtagtaccatgtatttttcctccagttttctagttgtttatggcaaaagggcaagtctagtaccacatactctctcatggcgggaaatggagtcttaaagcctttttttggaacacctttgcttgtgactgcacaaagagaattcagtctgtaaaacttagataattctctgataatcacaagactagggaaaggatcagaaagaacatctgtgaaatattctgggatg

SEQ ID NO: 1807 - DNA, 1223 bp, Homo sapiens
cctgtaatcccagcactttgggaggccgaggcgggtggatcagttgaggtcaggagtccaagaccagcgtggccaacatggcaaaaccccgtctctactaaaaaaatacaaaaattagccaggcatggtggcgggcgcttgtaatgccagctactcaggaggctgagtcagagagaattgcttgaacccgggaggggaggcggaggttacagtgaaccaagatcacgccactgcactccagcctaggcaacagaacaagaatccatccccaaaaaaataaaaaaatagccaggcatagtggcatgagcctgtggttccagccacttgggaggctgagatgggaggattgcctgaacatgtgattacgccactgcattccagcctgggtgacagagcaagactctgtctcaaaaaggaaaaaaaaaaaaaaggatgatcaaaactatggcactaagaaatcatccctcccatttgtttttctcagaccttgtttaaaattctagcttatgatatgatgtctttactttaggtgatgacgaacagagtgattggttctatgaaggagaatgtgtcccaggattcactgtccctaatcttctgcccaagtgggctcctgatcattgttctgaagtagaaagaatggattctggattggataaattttcagattccacattccttttaccttctcggccagctcaaagaggtgagttctgaggagaccaagaacttaatgcttttatggttctccttgggcagagcaatcaccccctagcaagcatactcatgccttcaatcacacattaactatctgaattttggagctagctcaaggattttctagaggagtcaaagtaagtctcaaagcttaaggttctctccattccttcctaaactaatccatggaaactcctgggacatatatattatcaggagattccttcagcttgccattgccgtttgtgccagatttagtgacagctgcttatcctgatgtgaaactaagaggttattgagtatcggattttggaagagaacagatttcaataagaacattcacatacatattcttattttcagtaagagtattcacatataatggtgtttttaaaacggatgcttttaaaataatttaagtagttttattttaatgaccctattgggactttaacacaaatatgtttccttttccctttgctttttcttcaattatgatgtagcaa

SEQ ID NO: 1808 - DNA, 1116 bp, Homo sapiens
gaaaaccacccctctttcatctttttgttctttttttctccttaatatctagcttttatttttagcttttaattgtttataagagaggaaccactggaaagagtttaaaatccttgttccattttcaggttgggaagtgtacgtgtgtgggggtgggtattaaacaagacttgagcattaagcatttcccctcctgagcccagctcctttcctcacttgttgactaagccctgcttcactgagcattttctttttttctgcccacaacctgagtgccccatggaggtgaaggacatagcctgagtctgagccatcagtcagtagaacaaatgggcttgctctgcctaacatcgggccatctcggattccacctcttttataggaatgagtgatgaagagaggtgggttccgctttgccgctgtattaatacacatcaggggccagctcctagcactaaatcacgctacggcatacatctgttatcggactcttcaccagtgtgatgaacaagactgcagatagaggcttccttgtgtcattctttataggattttcctaaaagaataaatagctcagatctctgccaacactctcccctgtcactgtgatgaattcagcttctttcttaaacatgcagccacaaatcttttccctttttcccctcccccagtggtagaaagttttgagttgcaattgactgaatttaaagatattaataaggctagagaggtgaagagcaggaagaaacagcatgtcttccttgcctttttgtactaatagtaacaaaaggccaaggaaaaagactgtaaatgaccataggttgttaaatagacccatcttgaaagtgtagcacctttattttctttgtatcttcattctccctcctttacggctttctagcatgcaggtgtctagtgcacagaaccacaccctggatcttagtgagcaagcatgctaacctgcttctcagacttgatacaccagaacagggatttccctgcaagtgtctccctcatgctgaagtgaactagctgaatatgctcttaaagaaagtagtcagaaaagaaaaaaaagattatcttctccaaaatttgagaccaagtagctgtaaaaaa

SEQ ID NO: 1809 - DNA, 1225 bp, Homo sapiens
ggttgacttgggggagcactttttgataagctctttttcccctaatatctgctaaacttatagagggttatgtaggtatgcagaagccagaggtgacccacccatgttactgcaggtgaaaaggctatgtactctttcctcagagggtaaagcctcacagaagaggcctgggccccagacaggggtacattggggatactttaccaggtaacaagcagatagtgggggattaggagtgttagggagtctcagtacaaatgtgtgtttctaggctaattttagctaagactgccagccccttcttagcatggggaggaattggctgagattgagtcatctgagatcatccttttaaaaaatcttcataaaacccatagaaaaagtgatctagggaaaatttagtaatttttgttaactaatgtttcccccttcatccctgtaggactgtaggtaccatccagcactgcctccacctgacgtcagtatatacccacttcctgccccagcgtggccgcccagaggtcactacaatgccattgggtcttggaatgacagtagattacatcttcttctcagctgagtcctgtgagaatgggaacagaactggtaagcctgatggatcctgggttcctccacccccaggtccctgggaacagctaatggtaggtcaggcatttggtagcatgtcttcagctgctgggatttaaccagcaaaggagcagatttcatacctcccttgcactggtcatccttatcattctccccataggccacttgcctgccttgtctctttttacccttgcagcattaaagagaggagggtaggacagtcactcccaatccccattttagaggtaaaaatagagatctaggaattggttgagtttgtttaatgacagccactgaatgagggacttggttaggtaagagaccttattttctgtctcctctccccataccagtgggcacagtatagcaatctcccagccccatgcctgtattgtgtaaagaatgtttctttttggccaggcatgtgtattactgttatggccaggcacgtgtattactggttcacaccggtaatcccagcactctgggaggccgaggtgggtagatcacttgaggttaggagtgagaccagcctggccacatgatgaaaccccgtctctactaaaaatacaaaaaattagccgggtgtggtgacggtgtctgtaatcccagctgc

SEQ ID NO: 1810 - DNA, 1157 bp, Homo sapiens
cttttgactgagcgcccccgccaggaatggccgcctaaagaaacaggcatctcaacgctttattgctaagtgtgacggttagtggggagttcgactctgcagccaaaggaggtcaggaatcgttcaataacaatcggtctggaggtgaaaagaggcgaagaagacacgtaagtccctccaagacgcggggcaaagcgatggagagacgcgcgccactcctctctctgtaccttttgggcaccaggacccttgccacgggctgcgtgggccgccgagaagtcgatgaccccttccaggtctgcggtcccgggccggctctgacggtagaagcggaaaagtttccgaaaggcgtcctccccgggctcagtcgccagagtcgccacagagcccacggccgctgccatcttccccatctcgcggcctataccctctgatccggaagcagattctctcgtgttccggatccggaaattttttccggggccgcgacctcggctcgagaaggtgctttagtctgaagatggcggcctcagcagcgagaggtgctgcggcgctgcgtagaagtatcaatcagccggttgcttttgtgagaagaattccttggactgcggcgtcgagtgagtgatggagatgtgggagtagtggaatttttaggtccaagtgatcctcaaagcttctgctttttgcagggtacttaagtcagcgtggtggctgaattaggagactgctcctgagcatgcaagtgagcagaaagaaattttgtttgcagttaaccgtttagggatgtcccttgagcttttggggtcacgaatgcaccggctcttgcctttaggagtgatttggtgtaaagatttattacttggtaaccaagatttacaatttagaagggataattttgactgtagtgtggaggatggattcaaggtggcaagattgtaggcgtgcagaggagctaaaaggcaatttcattaatttacttaaaacgtgaggacctgaattagggcgatggtagaaggatggtggtcagatgcattaatgttttaaaagcaaattagatgccgtttcgtgatggcttaagtgggagaagtgtacggaataaaggaaagggagaaatgatttctgggtttttagcattggtgaattgtttgtttagaagt

SEQ ID NO: 1811 - DNA, 1232 bp, Homo sapiens
ggaatttatgtaagcctaaatggactgaattagatttattttaagttaagagtggatatataacatatcttaatttatattacttggattaaagctaagaaaaagcaaatattcatagactgtgtccatagtgccttgtactctgcaagtcattttatagatactgtttcactggcatcttataagggctttgtaaaatagcccttggctcagttttacagctgaggaaaatctgagcccagaaaaggctaagaaacttgatctgtattttctctcatgacaaacatctattcagttataaaacttcctgagcattctaattcagtgcatctgcttttatgggagaggacactagaagtaaatgaaaagttcattttaatatcatttagttactcatttgcctcatttgacagtatatatatgtgtcttaaaattggtaatgacacacagtagaagagtatttgggttattttactgttgatatctagtggtacttttcatacctaattttaatgtgtactttgtatcaaataattttatccttttattcttttttgatgactgttcttcctgttgccttcagacctggcattaggattttaggtcatcataaattaaaatttgattttcttcactcagagaatattaggataatggagttatctgttctctgaaatttgcggaatcaaacatgtaattccttttacgcttaagtaacattgccattatttctgatttgtattttttccgacttttgccggtttaccactcttcaggcaacctggtggtcccctgctttcaggaggccaccatattgatgccgaacttatttggacacctgatcagcatagcacatacagcccagaactcctgggctcaagtgatcctcccaccttagcctcctgagttgctgggactacaggcatgcatccctgcacccggctgatttgtattttttaaacagctgatgaaagtggcatgagtctgtcagctgtcatatttggaagaaaaggactatgtagatttcaaaaactagtcacaactttttgagcttacttttattggattagtaactcattgtaacagtggtatcattgtatcagtaaaacagttaaccttgagttaagacaaaattatgtttgaaaatgtccagtttacttaagaatgcatagaactatttatgtttagatgttaaggtaactcactacttcatgttcctaaattcccttgca

SEQ ID NO: 1812 - DNA, 1205 bp, Homo sapiens
ctctgaaagctttttcttggaaatggtgaacattttattaacgaaaggcagttatttgacaaaatctaaccttaatggagtaaggagtataatacctctccatgtactggcccagtatggagaagtggtgaatattttcactgcaatactgtatcagtctgttctcacgctgctaataaagacacatttgggacttggtaatttataaaggaaaaaggtttcataaactcacagttccgcatagctggggaggcctcacaatcatgacggaaagcgattaaggaacaaagtcacgtcttacatggcggcagacaggagagagcttgtgcaggggaattcccatttatgtaaccgtcagatctcctgagacttattcactaccatgagaacagtatgggggaaactgcccttatgcttcaattatctccacctggccttacccttaacatgtggggattattacagttcaaggtgagatgtgggtggggacacagccaaaccgtatcaaataccatctacttcacctttctatctcagtcattaaaatgctaattatccaagactatactttcagggatcatttctatagtttgttactagagaagtttctctgaacgtgtagagcactaaaatgctaattatccaaagagacccatgtcactgagatgcttttccccattctcccagccaatactacattgaaaacacaaagcatattacttaaacctatcttctaaacttatttttctctacttttcttattctatcattcctcaaaaccccatattccgattgcaagttttactaagacctggtggctatggcatgtaacactcagcaaaatgccttgaacacagtagatgttaataaatgtttattgaacgtagttgatttaatcacaagtaatgagacattgaatacttttatgctaagaagaatatgaacaaactatatttcaagctgattaatatggtaactgaaacagtatttgcttctttaagcatcttggtttattttcttatgtaaatatgttcccacgatgtacagggtgcacagagctaattaccttcctttgcttggtatgcaacagaccagaaaacctaaaattattctaatccaagtgtttttccaaatggcttctctacaacccacattgattcggtatagcaaaagtaaaatttacttggcaaagataatttttttgg

SEQ ID NO: 1813 - DNA, 1216 bp, Homo sapiens
cggcctcccaaaatgctgggattacaagcgtgagccaccgcgcctggcaccatcagtttttgatcctgatacttgtctgtcctcttggttctcctcatccctaatttaaccttgaacacaaaattcaacaggttttggcatatagaataaagattatcaggcaaaggcgcactcttgacctaatgatatatctacatttcatttcctgatctatcagcaatattaattgtctagaatgatgagaagtttagagaagttccatgactttgaaattttctttctttacctaggttatctaaattacaatttgaaactcatataagatcatgaagctaagcttaaataaaccgcattttgttgaaaatgaatacatatgtactatattgtattcatggtatgtggttgtatggatattgtttacatatgtttggataaataggttcaggtatctatctcagtaacgtaagaaaaaatgaatggtatctatggattgaactcctcatatatatgttcttttcttttctttttcttttttttttggagacagagtctcactctgttgcccaggctggagtgcacagtggtgcaatctcggctcactgcaacctccgccttccgggtttaagcaattctcctgcctcagcctcctgagtagttgggattacaggtgtgtgccactatgcccggctagtgtttgtatttttagtagaaacgaggttttaccatgttggccaggctggtctcaaactcctgacctcaagtgatccacccaccttgcctcccaaagtgctgagattacaggcatgagccactgcgcccagcctgaactcatatgtcctaaaccaaaggaggcatttatatttaatatgacatagtcactgtggagttttgacgtattactgcatttgtatttctatcttttttgcttttatgtgaaagttccacagaaacagacacttccagttgctcccagaactcgaacttctcaagaagaattgctagcagaagtggtccagggacaaagtaggacccccagaataagtccccccattaaagaagaggaaacaaaaggagattctgtagaaaaaaatcaaggtaataacttaaatgatgtttcactctttactacagttttttcatgaggcattgaatattttccaatggatttttatgaaatattacactatgaaaaaagtgatgattaagcccagaaata

SEQ ID NO: 1814 - DNA, 1198 bp, Homo sapiens
aatgaggtgggtatggacagtggaggcagctggaatggcaagtgcagaaaataggaacagttctatacagtgctctcatttactaataacataatgccttctaaataatttttttgggaaactacattatcacaaaattatacaaatttttttacaagtatttacatactgtatctgaaaacagactttaaagtcacaagattataaatgtacatatatattctcacattctgaaaaataacattctcagaatccacagaaaatatacttagttactactgaagataatttttgaaatgtaaaaattagatttaaatagtatattttaaatgacagaactataattacagagatcagatcagataggtaaactgcaagatagataggatgaaacttttggcctactgtattacttacagagtttttttgtgtgtggtttttaaaactgttaaggcaagaagtgtcaaatgctttagagttaaataacagatcactgatttcaaagacttggtgtatagtgttaaaaattaaagcttaaaaggtggttagaaaagtggattaatgcaaaaggggtaataaagactgcaacattctcaggaccaaattaaactgctaaaaaaaaaaaaaaagttcattgacttgcttagtcgtatactcaaatgatgataaacctacatgtgcaaaggctcacgtttaagattgtcaagccagcagtctactgttgtgttgccattgcttttccattgggagaagaaagaattaaccagtcattaaaccatttggtaagttgcactttgctgtgctgatcccacaggaaaggcttgaaacacgagaagcagcaaagacagagcacacaagtgcataaggctgttgtcttcggcttgggtgaaatgacagttcctcttcattctaaaggtttactccattgaatttaaggcatttgttcattccagtgttgagatgctttgcatctctgcagaagaaatttattttaaattgtttaaatatctggaaatacttttagctatcatttataaagatagttttgttctcagtttcactataaattatagaacaaatgggaaacaagggtttaatttagttcagccattttacaaggaaataataaaatactaaaatctgattgttttttgctatttaatagccactgcccagacacatatttaagagtttaatc

SEQ ID NO: 1815 - DNA, 1237 bp, Homo sapiens
tcatgttcctaccatgcgtcatgttaaataaattacctgtccttgcatggtgaccatatggtttgcacattgcttgtaccaagaatatattcttaaaaaatatttgaggtgttctttttggatttagagctgtagaaagcaaggatcttttttcctttttctgtttcttagtactttccccagtaaaacagattgagtgctcaacagacattgctgactagacagacatgtaagtgtagatgttttataaataaatttgttataagtctgatttttttaaccagtgggtttctatttaatttgtacagaaaaacccagatgctgagtttatctgaagggtttgtgttatgtggattttccttcttctccttaagtgattaaagtctgaatgttttaaccaccgtgaacttatttttgaataaaaggaaatatttccttggtatagttatgggattattctcaatttctgatatattgtgtgttcattaaacaagtagttatcatctctttgcactttgaatgaggttagattaattagaattttctgatcattgaaaatttagcattcttcaatgtatattcattttacacaactcttgagaacacttctgtaggaagactaaagttaattttttggattcttattgaatgagttagagttcacctacaaatacttggttggtccttaggactttttattttagaaactgtatttcttaaaactgtttactgccttcttaatgctttccaggaaccagatcctgaattgccagtgcatcaggtaaagaaaggtttagctgcaacctttagtttagagaattctttaatgctattgcttagttgttgctatagattagaaaatttgctgcatatcttcctgtgggtttataaaattagccatatctgtcagacattctgtgccttcttatgtaaataaatgattatattttcaatacttttgtgtatattgatagccttgtagaactaataatgcagtctactcattgggacttggagcttaaatggaaatgaccaagatggattagaaggatatgaaaaataaagaaggaggtgaggggaaccaagggcttagaaagggagcgggagagtcagcggaatgacaaatgtctgaaagactgtgatggatgggatggcatgtcttgagtcaagagtggactgtgcttgggaaggtcttggttttaactgacctggtggctctaagagggaggaggctgcc

SEQ ID NO: 1816 - DNA, 1186 bp, Homo sapiens
acacacctcacactttcctctataattttgctgatgctgtttccttcgctttaaataacttaatgccttcttcacctatatttttgccaattcgaattctattgatccttcaagtcccagaagagatgctacattcattctcaatcctttcctgagcccagtttgagagtaatggtttcctcatccaagctgccagaaatgtctttttcttctgccatttctaactttctaccttgatttctacttatttgttgttgtttttaataagaaaagtaaatgtgtttaagtcatgtctgctttatcatatgtatgctagagaaattcattccccccagatctttgaggtttactttacccaaattcattcattaaacaaatattccctgagcatctactatgggccaggcattactggaggcccttgggatacatccatgagcaaaacagagactaaaaaagctccctgccctggcagagttgacattctagcagaaggagatggataataataaagaaataataggccggtctgagtacagtggtatttacaactaactgatcacaaaaactaatagatttatttgttccttctccactcccactgcttcacttgactagaaaaaaaaaaaaaaagaaaggaaggaagaaagaaagaaagaaaaataatagacacaacaaatagtaaattacatagtatgctgaaagatgaagagcgtttggcaaaaagaaaaggtagggcaggatgaaggagattagggatgctagagattgcagggttggggcaggtgacaatttaaatagggtagtcagggtaggtttacatgggaagtaacattcaagcgaaagcttgagtgagatgggatcgtagcccatctcactacgtatgtatgtgaagtagtatgtggggctacttcctcacataatcttcctatattctatagactacaggtcttgaggtggaatctctatccgattcagcttggtatcttccctctcaaattacccagcaccaatgcctggcctggcataccggatcaaaagtatttgctgaatgaatgatagaataaatgaatgcatggacaggcttcaaatctgctgggaaaatatccaaaaatgtgaaataaaatgaaagcaggatgtaagaaaagagaagagaaaggttaatacaagagacaagatgccaaaa

SEQ ID NO: 1817 - DNA, 1220 bp, Homo sapiens
tttatttagaacagaattctctctgtgcagtgcacactgttgcctttggcatctcccctgatattactggcagtaataacagtttcaccaaagtgaagggatgtaactttgataatttaggagtgttctcaatcaggcctcaacaccctcctagatggaattgtctttaaaactggtgctggaagttgataaaatcaaggctttatttttactgtaaaggttctgatgggccttgttctaaactctttgtaaactataaatcactattagaattttgtttagagtctgaaactgcctttatcgttttgaatttttagagccgggggctgaatttcctgttcgtgtacaacatgtagctcttattctaggaaaaactccagtgacattcttgttcagtaaagtgaagtaggcctgatcctatttatcaagactgacttcttaggtttgctgaaaagacattcaatggctcaccaggcaaatcaagaaatgagaacaaggatgtgagggcgatctggctgcgacatctgtcaccccattgatcgccagggttgatttggctgatctggctggctaggcgggtgtccccttcctccctcaccgctccatgtgcgtccctcccgaagctgcgcgctcggtcgaagaggacgaccatccccgacagaggaggaccagtcttcggtcaagggtatacgagtagctgcgctccactgctagaacctccaaacaagctctcaagaaatgagaacaacaccaaaagagagcataagataaagggggtgtctcagtctgtttgggctgactgataccatagactgggtaatttataaacaacagaaatttactgcccacagttctggaggctgggaagtccaagatcaaggcagcagcagatctggtttcttgtgagggctcatgcctcatagatggcaccttctatgtgtccacacatggtagaagggacaaacaagctctccaggccttgattgtaagggcattaatcccattcactagggcagtgtcctcatgacctaatcacctcccccacctcttaataccatcacagtgggggttaggtttcagtgtgaattttggggggacacaaaaattcagaccatagcagaggatgtgttcgcttcttagggctgccataacacattgccataagcttggtggtttacaaaaaatggtacctattctcttacagatctggaggccagaag

SEQ ID NO: 1818 - DNA, 1146 bp, Homo sapiens
gccttagcctcccaagcagctgggaatacaggcacctgccatcacgcccggctaatttttgtatttttagtagagatggggtttcaccatcttggccaggctggtcttgaactcctgatctcatgatccacctgcctcggcccccccaaagtgccgggattacaggcgtgagccaccgcgcctggccttgttccttaatttcaacggtaaatataaaattattttctaaagattcgcagtagaatcctagtactccttggtaatgagagagaaatcaattaagggggacaattccatccccagtgcaatgtgttttctttttttttttttggagaccgagtctcactctgtcgcccaggatggagtgcagtggcatgatctcgcctcactgcaacctccacctcccgggttataactcctggtctcaggactcccggtctcgaactgctgacctcaggtgatccgcccacctcggcctcccaaagtgctgggattacaggcgtgagccactatgcccagccgtagatggggttttcatggtctccagaaggactttctgtgatgtgaccacattgaccttcagcctaggtggtcatgtgcttaatattgttatataaattatagcacttcaaaactttaacttaacttcaccctaagcaatgagagccaagaaatcagactatttttgtgtgccacttaaataaacaaaaatggaaataaataataaatgccaatgaaatagtcattaataaaatacactgtcttccatgtgttactggaaatgatgtgtggcccccgtggtacttgggaacatccaggttttctgaattcacattttaaagtctatgaggaacccacaggtgaatgtgtggcacatggagcatatagacagacacatgaggcagatgcatgagatgcaggcctagagatagacagagtcatccccgccccaggagggaagtttctgccctggaacactgagagagagagagagagacctggatccttgtgatgaattctccctgtttgcttatgttagtttgagcaggtctggatttaaacagtcccatttccccttcctctgcccctcattatatactcattactaatggctaataactggatgagagatacatgggggttcct

SEQ ID NO: 1819 - DNA, 1197 bp, Homo sapiens
gagtattcctcggcagtgcctaggaagtaccccaactgttaaaataataataaacagctcttctcgttgtaagctgagccctcaggagggccctcagagccgtgcccatgtgagtgagtgttggggtgtgcccgtgtactgaggagagacaacagggtcgtgttcagtgcactgctgttttcaaatcactgtgacagcctcgtgagcatccttatgaaataactggtttttaagtacaaaaccagggaaagcagttagtggttcacaccagcatgtaagccagaagagaagagaatgtagaataagtaagcacacatacgtgccgtagaagagagaaactgaaactgctctctttgcggttctaacccaggtacttgatgctaacagttaacctcactcagtcagcaaacgctggttaaacaacctgcgtgggaccaccgggatcagaagcgaaaccacatagctccctgctttggaaggaaacataaataagttaggagatggtaggtagtggtggacccggggacagatcttagttctgtgactcagcctttctgagctgcatccttctatttctgagatggagtcatcatgccgtcctcgggggattgcttttagaattaagtcacatggtagcatgccgtatattaaggtgcagtaatggtggtctgtaggagggaagggcagaattactctatggaatatggtcagtccttccaggttgtgagggttaaaccctgagcctggctggtcatttgcaggtcctgggcctctgtggttgtggggagctgagttagcaagacagaggaatcagtttcactgctttatctctgacccctgttcgtctgtggagagacatcactgtgcctttgaccccagcaagggcagagagtgtgcagtttggggcaggaagggaaagggatgcttgcctgccattgcttaaatccccagcttcacacctcagtcattgtttatacacaacaagaattagttcctgtatccagaaatcagaaagtgtcttctgtctgggcatggtggctcacacctgtaatcccggcactttgggaggccaagacggatgaatcacttgaggtcaggagctcaagaccagcctggccaacatggtgaaaccctgtctctactaaaaaatacaaaaattagccaggcgtggtggtgggtgcctgtagtcccagctac

SEQ ID NO: 1820 - DNA, 1623 bp, Homo sapiens
ccactgtcctgcagggccagagcacagccatggcagccacaggggacgtggccctgctgaggcacagcaagcttctggccgagccggcgggcggcctggtgggcgagcggacatgcagcgccagccccggctgctgcggcagcatgatgggccaggacgcgccctggaaggctgaggccgacgcgggcggcaccgccaagctgccgcaccagagactcggctgcaacgccggcgtgtcgcccagcttccagcagcattgtgtggcctccctggccaccaaggcctcctcccagtagccacggagccgggacccagaggggcagcgcagggcgcagagcacacccgctgggccagcagctcccaacggcgatgctactactaagaatccccagtgatctgattcttctgttttttaatttttaacctgattctctgatgtcatgatctaaatgaggggtagtgggggatggaagagagtaccaggtggtccaccgttggggagtggggccgtccgcctgctctctactgtgcagacctcctaactgagtttacacacgcttgtgtttgcaacactaggtctggatgggaggtgaggggtgtgcgtatggctgccatgccagtgtctgtgcacatccctgtctgttggtctccatggccactgtggaccgggacccttgggggaagcctgcccatgtcgggctgtgggaggctgatcggtgcatgtgagagtggcttcccttctgcctgactccccactccctgacctgccccttccttgtttttcctcctactggtctccaccaaggctttgttagcccccaccctgcctggtgtgcagctaacccctccctccccacagccagaggaggccacagacccctcaggggagttccgcgctggggtctgggctgtgctccctcactaaagggaaggaaaggaagctgggcgtcctctgggccccccaacacacgtcccatttagccctgcacagcggtctccttcccctaagccagcactgctgctccctggagcccgggaaggaggctgcctggctggaggcccgagccgatggcgcctgtgctgaggatttgtgctgtgatttgggcaaatcattccaggtctttgggcctccacccccttgtctctagtggacatttgagatcagagagcaccacagggctggctttgtgccctaacccctgggatgcagcctgcctttccataaagtcacctaggtgaggataggcgcgggagcctcggcatgacaccatggagatcggggccctcttcccagtgggttcactccttttcacacctgctgggtccctcctcacccagcaggcctggtccacctctcattgcaagccccaagcactgagccagcaggtgccagggagccacccgccccccatcgcttctgcacacctcagactcaccccatcaccttggcagcaaagcactggctctgccgtctgacccctgatccaggcagccccctctgcagagaaaagggttggggagaagcctctgcagtcctggaagatgtggggtgctgggtgagaggcatcagcccccacaagtatgtttttgtgtcttaagatagcagtttactttgaaaaagtg

SEQ ID NO: 1821 - DNA, 1212 bp, Homo sapiens
gagaagcttctgctggcagctcgtgctattattgctattgaaaaccctgctgatgtcagtgttatatcctccaggaatactggccagagggctgtgctgaagtttgctgctgccactgaagccactccaattgctggtcacttcactcctggaaccttcactaaccagatccaggcagacttctgggagccaaggcttcttgtggttactgaccccagggctgaccaccagcctctcacggaggcatcttatgttaacctacctaccattgctctgtgtaacacagattctcctctgcgctatgtggacattgccattccatgcaacaaccagggagctcgctcagtgggtttgatgtggtggacgctggctcgggaagttctgcgcatgcgtggcaccatttctcgtgaacacctatgggaggtcatgcctgatctctacttctacagagatcctgaagagattgaaaaagaagagcaggctgctactgaaaaggcagtgaccaaggaggaatttcagggtgaatggactgctccagctcctgagttcactgctactaagcctgaggttgcagactggtctgaaggtgtacaggtgccctctgtgcctattcagtagttccctactgaagacaggagtgctcagcctgccatggaagactggtctgcagctcccactgctcaggccactgaatgggtaggagcaaccactgactggtcttaagctgttcttgcataggctcttaagcaacacggaaaaatgattggcggaaaataaacatcagtttcttaaaaaaaaaaaaaaaagaaaagaaaagataacaatgtccttctttgcaaggcttctgtgaattcagtcctttctcccagtttcacaggcaaataaggacagggactcagttgaggtgactaatcctcggagccacagccccccaattccaggggcttggaaatgctgggatcacaattaaaggctttgaacttccaccagacaccaccaccagagctcactccatccgcaaatgctatgtacattcttggccacaaaaacacttccaggacaaaaaaatgtttcagagttcagaactattcaatcccacatttgttctctatgaacaaacgatgcaggaagaaatggaagaagctgaatctctctgagggcacactttattttgccctgatgagaacttagtagcacctaagtgcttcccaa

SEQ ID NO: 1822 - DNA, 1347 bp, Homo sapiens
aggctggtctcgaactcctggcttcaagggatcctcctgcctcggcctcttaaagtgctgggattacaggcgtgagccaccgcccccggccgcctctgagtttccagcctcgttggccctccagccttttaacctgttgggcctaggatcaggaaaggtttgttgaatggggaactaagaagtgaattcgttcgttcgacaaacgtttcctgagcagccgctgggtgctaggcgcagtgccagcgcggaatgtccagggagacctggtgcccaaagcttggacccatcgtgagaaatgagaagcagatacaaagcagtgtgggagtgcagaggagacaaagcaagcctcatcaggcccattgcttgctctgctctcccttgtacttaccagtgcttgacaatatacagttatttactagcttggttattgacttcctacccagcactcagttttattcactgctgtatcctcagtgcctaggacgatgcttggaacgtggtaagtgctcctattggcgggaagaataaatccggaagagcaggaccagtggacttgctacataatctgtagtcttggagccgcacagggttggtggtaccctcgagcacaccagacttgcagaaaaagcatactccagaggaagctgaggcatgcctgctcgagagccagctgttccatgtgcaattttcctctgatagtttctggtcactgttgccacggtgataatgactgggctatgtcattatctatccgccaacagtaagagaagctttgcagtcgagatattgtttagcagatggagtgttttctgttgaacactaagtactgccacaagttacttttttttttttaaactttgagtatttttttacaatgttgctggaggtgatctgtttatgctttgagagtgttcgaatttaaaatcagaaaatcatgtcagtgagtgagtctttcaaataatccttcggcatgaaacctgagcctagtaaactatgaaagtaaactcggcacattacccgaaagtctcaatgtcatattttcacccccatcaatattattgatgattgctcattttctaatgtgggacctgaaatttaccaggtgcttaaagaatctttttgtttttcagattcattgattccaggtaaatcagaggaacaagcaacatgaacagaaatatgtagaaaaagctattatgcagaagcataattgttgtttcagaagtccagcatctggtgcacttaacaatagagaatatattaaactctttccaaaataacctgttgttcctacctgtgttgtaagtgttttgtttgtttttaagtaaatattggtgatttgttgcc

SEQ ID NO: 1823 - DNA, 1347 bp, Homo sapiens; identical to SEQ ID NO: 1822

SEQ ID NO: 1824 - DNA, 1187 bp, Homo sapiens
ctcctagcataaagcctctttaagttctgggggccacatcttgaaagagaaaagtgtttgtaagggaaacacttcagactgtcccttcacaagtttacagggtcaaaattatcacagttccttttacttctctgtgaaagttgcttcttaagcttcgtcctctcactgtagagctgccatatcaaactcatcagctcccagaggcgcaggggataccaaggatctagtggaaatgggagggctccaggatctctttcctgtctgcaggtgagtaacagtgagccccagagatgctccttgaggctgggctgcaggaaggcaggtgaagagcccccctaggcttacccaggaccttcctggctttggcactgaaactcctgcatcccaggaaccccctcagtctcgagcagaccaggatggacagtcaccctctctgctagtcctccactcaacttttcttcaatagctgtcaccctggtggaggccaaccgtggggtcaaatagcccatttcctggtgtgtggcttgcctgccctgtcaaggcagcagtgccgaatagaagcagtagccagaagctgtcttccctttttctgaggattctcctgccaggtcctgaaacttcagcacgcacagggtatcctgggggctgttcgatatgccagcacccaggtcccacccacagagagtctgagtcagaaggccagggccagtgcttgaatttgtgcctcctggccggtgtcaggaggttctgatgcagagggtctacagaccaggttttgggaaacactgtcccaaagtgtaggagcccatgctaaaggctgcttgttccggatggctttgtcatgtcgggctagtttcaaagttcccatgaggagcttgtaataatgaacaagcaattcacagctaacacactggcattcagaagtgtttaacgcagcatactatttaatcctcagaaagtgttcatccattccacaaaccctggatgagaagctacattaagtaaggagtgaacaatgagaccctgggtttgctagcctcacaaagcttagacagcaggggggacatgggcatggggcagacagcctgtgggctggatgctggtctggtgacatgacagccacccccctctaatgtctgcatcacagaaaggaagccaggagcaaggatctcttccctgtagcgctc

SEQ ID NO: 1825 - DNA, 1193 bp, Homo sapiens
taactagaatccttaggtaaagtttgctgacttttaatgaaatttaaaaataacctttttgcccccttcagttacccaagtataaaatgtttatgtctttctgttacttacttgtttcagttccacacttgtaagtttacaacatgttcataagtgggttaccttagacataattagactttgtagagaagtttaattctatcattaagatttaaccagtggtgtgtgtattaatttgcacaaaagttaaagttttgctgtttacacttagatcttggtctttttaaaattgtctttgctatcagaattgtactgaaaataaatccaccagccatgcattccattttggagagaattgcagctgaagaagaagaggagaatgatggtcactaccaggaggaagaggaaggaggtgctcattccttgaaagatgtttgtgatctaagaagaccagccccatctcctttttcttctcgtagagtaatgtttgaaaatgaacaggtaaaagtgtgagcaagctacaaaggaataatactattattctctgtcatagagcaatgcttttgattttttatttttaaaaaaatgccttgtgtactgtttttgctaggtcttaaacttcaaaattgaataatacctattttttcttggtgtatattttctctagttaaatgtttcatgcttatttatttctcacataccaagtcctatggataggctaagaagatgctactactattttaaacatggatgcctttttttttgcactgaactattatgttttagatggtgatgccaggagaccctgtagaaatgacagaatttcaggataaagcaatcagcaattctcactatgtgctggaacttacgttaccaaatatttatgtaacactacctaataagagcttttatgagaagctttataataggtgagtttatacacatttagttgaatctttggaatcagattttctaattgcctccctgattttcctcttccccctttcctttccttgcctgaatattatatgccatctctgtgtactttgtgtggtgttgatggtgactattgccgttatgatgtgctattgtcatagcagagtttcctaactagcgtggtgccgggtgtgtgagatatttatttcctcagccctgaggttggctgattgccctctgtcagcttactgcaggtt

SEQ ID NO: 1826 - DNA, 1227 bp, Homo sapiens
atctgaaccatatgtaaaacctgacatgtagtaggtgctcaaatatttgtttgtttttcagtctgattcagttaacatttattgagcaactatcctgtgtcagcaattgaaaatcaaaccatgcataagacatgatccctgtccaccaggaagatcacagtctagcagagataagaggaagaaggcaaactgaactgtactccactgtagagagtgcagtaatagagcatggatctgaagaggtgtgattcattttccttaggtgtctgcctctgcttttcatttaaaaaaaaaaaaactcagcttctatttctaacacaaactttcacctcctatggcttaaatagatgtcataaaaatttaggatttatatagggaatgtacacacttaagtcagcaaaaactaaattaattttgccctatattgtgctggtgaaccatgatataccttataatcttgtcaaaaagaaaagttgtagctgtgttcacaggaaaaaaaaaaaaagaaaaacacatggcctgtcagccttttgcctaagatcaattggagtatcttttcttatcagtttaatatctgttatgtcctctatctaaggacaatatattaaatggatttttggagcagggagatagaataggctcttgctccattaacttcacacatcgacctggtattgcaaatacctccagaaatagtgtacccctaccaagaaaaaaaaaacacattaacatgttcttttatctcacagaattgagcatttattccctgtcaggtaagaaatatattaggtgaaagtggcctttcagattactaataataaagctaaacagttattaaaactaataaactattaaaccaattattaataaacaattattaaaattaacaactaattattaaaactaaattattaggaataatttttagaattgtttataaaagaagtgaaaaataatgaaaaaaatatgaactaatgatatattacctattatagtacttaatatagtggaccctcaatatatgtggaattaaatggggtaaataatagatgcatgttttagaatatgaaaatgaaataccatttttgtgtagcttttcaaattctttctctgcatttccttgagcttctaagtaaaaccttttaaatgttgaaaattctatagggagcattttagtggtgtttctgtgttatacattataagttgctgaagtattaaaggttgtat

SEQ ID NO: 1827 - DNA, 1235 bp, Homo sapiens
tagaataattgtactttaccagaaacctggttctcaaaaaatcttccagctttttaaaaaaaaaatgtgtatatatataagagtatgctctaaaatcataagctaaaactatatatgttaaaattctggttttaggattatagtgagtgcatgtagtatgattaagattatttaaaattctagattgtagactgaagtatgcaaacattttaatatgtttttaatttaggtcttgctatcacagatgaaattttgctgagtaaggcagagtggtccaaactttttgaagctccaaacttctttcaaaagtacaagtatgtattttaaggcatgtcggacatgttgctctcttaagtaatggtttaatggtagcacattatgacatttcttcttgctggactaatgttattggaagaattttctttcctgtcacaaggacatactgttttagtgaactccttagttttttttggttgaggtaatgaatgtgaagcccctttgatttttctgcccgatctaactgaactcctgctacatttgtagcaacataagttctgtaggcatacatcagtcatgacaaaaacagtacatctgtatacagtggcaagtggatgcaccctgaaaaatctgtagttaataattctctgctaagaaacagtatttttatctaattctggaaactcattaattgctaggaatctttaaaacaaagacaaagctaataaaatgtcaatatatagccaattaaatgttttcaatagttacagcacattattggcctgccattttcccccaatgttatagccccttcaaatatttctacagctagctttcatgaatctaagtgggtgttaatcattttaattaatggtttaaatataatggtttaataccttagtacaggttaaaagcttcattaattgtgttagttttgatgaaaaatgtaagttataatcttatttaaaaaacagacaaaccacagacttgcacttttatttgccctgggctgaaaatgtgccaaagtcccacttaaaattttttttttaatgcttgaagcttttctgaccatttgatcttgtgttggattgtgttttgtaataatctaagcaagattgctttatgctcttccccaattaaaaacaagaatgatgaccttcatgatgtctctgtgttttgtttctgtatcttttgcatgagaaagcaataacggagccagtaattgtgttctcgaagca

SEQ ID NO: 1828 - DNA, 1192 bp, Homo sapiens
actagcatgtcccgggaacctttgccccttccccttgtgctcagttgccttatgttttcaatctctgcactgtgttctatcatatcggtattgaccttaataaactcttcattttgttcctataaaatgtgcattctaattggatgcacctttccctctcagcttcatagagcaattctttgttgttattaaatagcatttttagttgtagttgatcattatgccattggacttaaacctaattatttccttgaaaatagttgcatatatgattttattgtttcttctccaaagttaagagataatcaaataggatttgagccattataagtcagaattaacaggtatcctttaagttttggagtaagtaggaatttgaacagcatctccgtacggaagttttccttagggaaaaatgttttaaacacttctaagattagaattctgaccatttctttgttttatgttatagtgaaaatgcctcgtgtaaaagcagctcaagctggaagacagagctctgcaaagagacatcttgcagaacaatttgcagttggagagataataactgacatggcaaaaaaggaatggaaagtaggattacccattggccaaggaggctttggctgtatatatcttggtaagtgtgtgactgcttctaatgatcaatccaaagatttatatgttttcttatgaaaatggtttctcatttatgagctgttatgggatgttcctaataatctgcagtcaacttaatagtttctgattaagcaaaaatgcatctctgacgtaggagtggaaattgttaatgcagtcacaacagaaaaggaggataaaatagctgtaatactatcattagtgagcactaggactttagatttttaagatactttatataatcttaatctcttttgagacccaaagaaacccatttacgtatctttcccctcccacctccacctatgtgggatttattccctccgtgtttgtctgatttagaggtttgcaaatcttttacaagtgtgagtttcttttttctttcagtgcaaccctcttagccatcatactggaactaggagaattacctagaaactgcatattaggcctgattaaatgtgcagataactagcatacttattctgaaatttttggggacccgttgtggaatcctgaaattatgttaggttaactaaat

SEQ ID NO: 1829 - DNA, 1213 bp, Homo sapiens
atgaaatgtactgtaatgatatcctgaaacacatacttgggaactgaagtgtattctatcaagggttacagatatacaaacctaaatattaatatatttataatattacttgttctgatatcaaatattttacttttttaaacagctgatatgaattcttcagagtcagttggcagtgatgcaccttgtgttgtaaaagtggtaagaaatattttagctaatttgtttcttttctgttgatttggtgtagtattttgtaaaatgccttttttgattaactagaattaattaaaccataagatactacatttttaataacttaaaaaatatttaataagacacaaaagtagctttatagttttaaatcacttgagtgtgaaaagttcctctcttgaaataaagtggcactggtattcgggggtaaatgaaggaaagcataaaggcatgcagatgtggaataaaaatattcagctcatttaagaaatttcagctacttttatggatactttttatatttatatcctataagactatactaatttaatataattttattgtattttattttgcatttgcttctggacttctacttggtcaattttttctgttcccaattttcttccattttagtaaattaaattatttattttattgtgattattgggccttttttgctataataatgttgaaattagtttgtaatgagtaaagattggcaacatcctatctgacataagcatacttctaatagccagatccatttatatgttggcgaactagaagacattttaccgttttttaagtcaattatgtgcctttttgcttaccaacatttgttactccccttcttcaaaattacttgatacatgtgaagaatatgttttggttaaatagaagaaccaacaggatgtattatctgggcaaattaacatataactcctcccttactttttctctacgggatacatgtattagggttctctagagggacagaactaatgggatagatgtacatatgaaggggatgcccccatgacttaattacctcccaccagctcccgcccacgacacatggggattatgggagctactatccaagatgagatttgggtggggacacagccaaaccatatcaaccagaactcaggaattacaattactctgaaggttttcattttgtttcgttttactctcttttatattttatctctta

SEQ ID NO: 1830 - DNA, 1220 bp, Homo sapiens
caataaacacatagctcctttgtgtttgtatatgtgtgtgtgtgtgtgtgtgtgtttgtgtaatgttttaaaaagttcttttatgggcctcattcattcattcattcattcactcttatttattcatttactcacttatggcatttccactcttaaacccttgagtggctttctactgcccttagaataaagccaagctctgttccaagacctgcagagctcagcctcacctgaacccatctccagtcttgctttcccttccctctccgttcccagtgtgccacctgcacagctttctgccttggtcatgcctgctcagtctgccgtgggggcagtggcacctgctcttccctctgcctgaagtgctcatccctgggtctctgcctggccagactcctctcttccttcaggtctgtactcagcaaggacttctgtgccgcccctcttgaaagaagtgtctccccagctccattactccttttgggggtcatcctatttgatgttcttcacaatgcttcttccaatctgacagtgtctgcttcagttgtctgttgacttgcctatggtctggaccctcccagtaacatgagccctgatgaggagggaactctggagaaggaaatggactctctggagctccttgaggacatgagctggctgtctttgtgacaccagtcctagcagagcctgtgctcatcatctggtgcatgcatttatggtgcaaggattcagtgttattggcctcagtgtacagcagagaaaagggaatctcagagaggtcaagcaacacacccaagcccacacagctgatgaacaatggaggtgggagtgagcgacagggcactcggagcacgcacttaagcacgtgctgctctgtcctcctcacctccccatcgacctgcatgcattgacatgctttacacctgaaaaaatgacttacactagaaaaatggaagtttcaagagtctaatcttttctgatccccccaatgacattagcttaggaaaatctcgcctgggcctcatgtaacttgatggagaaaggtaatgagacagcacagggtcccttgtcaagagaagcggcgaagagacttcatttgttcgagtcttgggtgtaatgattgagctagagaatccatttcagctgggaaaggtgggtgctgatgaagttatgggccggctgcaccttttaaaatgaaatatttaaataagtggaacctc

SEQ ID NO: 1831 - DNA, 1308 bp, Homo sapiens
tgcaaaaagaagaaaatatctgtacaaaaatcatactgtccagaaatgaccactattttaaatttttgcttatatatctgatatgatttggatctttgtccctgtccaaatctcatgttgaattgtaatccccgatgttggaggtggggcctggtaggaggtgattggatcatgggagcagagttctcatgatgggttataaccatcccctccatgctgtccttgtgatagtgagtgggtgagttattgtgagttctggttgtttagaagtgtgtagtcatgccagccttgtatcccaggaaggctgtgaggtggaccggcttggacgggtcatccttagggaagctcttcaccttcccacgatgcctgctgctgcgcttccgaggcaggaagccgagggacccatgtctgggagcggagaactttctgtgagacatcacgccatcaaattctctgtggcacgcgctgggcagaaaggctaccatcaccgcactgagatcaacaagaagatctataagattggccagggctaccttatcaaggatggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaaaaaaaaaaaaaaaaaaaaaaaaaagaagtgtgtagcaactccctcctctctctctgttctttctgctctggccatatgaagatgcctctgctctggttttgccttgtgccatgagtaaaactccctgaggcctccccagaagcagatgctggcactatgcttcctgtatgcctgtggaactgtgagccaattaaacttcttttcttataaattacccagtctcaggcatttttttatggcaatgcaagaaaggattagtacaatatccttccagtctttcttctctatatatccttatgcatacatttctatttttcctttataaaatggtattatacaggataactggctttgtaatttttttcatttaacattttct

SEQ ID NO: 1832 - DNA, 1145 bp, Homo sapiens
taagtttctgacagatactgctttacagttccagaagagaccctgctgtattaaaaggacaggaagaacttggtgaattttaaaatacagtcttatagtaatagccttgctgtcctttggaaggagaagaggtttataatagaggcctggtgaccccaggtcacctggggtcctttgagtactagtaaggcctttggtggtactttctcctggcctcccctctcctctccacacggtggtggaagtgggtgcttggtctcagacagtttggaaagttgggaaaattgcacagcttcacccttgcaacctataccaaacaggtgtatcaatactttcagctatttagtgtctaaatgtaaagtagcactaagcctctgccctgccctgtgttaagaatacatgccaagtttgtctaatgcccttttcttttttctttactgcatctcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacgtacgtagaaaaacatcggttggccctttcttgcagtacttgaactatttccagttgcatagtgtttaattggtgtgttaataaaacttctctccagtagtttgtcttaatccgtttatccccgtggcacagcaaatttaagccatggcgacgcttggtggcttaccagcgttttcaggtaaacataattgtgtcgttgggcgcattcacagtcagttctgggggatatggcctgaaatcctcattaagttaaataactactttcgtatcattcatgtctttcaccttgaaaaggttaatggcctggatcaatttgtttcatttaattcgttgctaccattagtttctgtaatgaagtcatgatcctcagtgatttcaagaatttctagttaagttctttaagattttcttgcatttgaggcataaaatgataaagaagacaggaattaggattcattagttctccagggaatagaggaaccattcttaatgaaaatggattatgcagaccttttttttattgaacttgt

SEQ ID NO: 1833 - DNA, 1193 bp, Homo sapiens
agctcatttaaattgccttacagccttctggcttacagctctacagttttgtgttcttagaatcagggctgtggggctcatcctttcccatgtctccttgtgcacatacgcgagctactcatttttgttttaatggaaattttgttaaagcaaatgtgaacatgagaggtggcatgtttgacttttaaggagaaaactgctctgtaaatcatagtagtggtaatagaagctctctgccctttgccatcgtattacctaatagtacctaatagtcaatatttatattacctagtgtcagtatatatttcactgtaactgacagggagtttaggattttaattcttcttccctgtcaccagttaaggtatgtactgtgaccatctggtgattagttttgatttcaagattggcgtgttaagactatttccagtgttagttatggcctgtttttattttctgagagacgtgtgaatgatatgtgtcctaaaagtagctcttgttttctaaaacgtggattaatataggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggtgagtttataaaatgttggtctcaaggggtctatgtgtttgaactgtggtgtgctgtagagggcgcagggtgaagaggtagacgtgtggtgggggagttctagttctgagcctgtgggcagataggcagcctggaagggccttgggctcatgttctaagcagctcctcccaccttatcctcctggggagccaagttgctaatcagtgactggggcaagtcagttcacatttctgagcctctgttaggagaccatagaacatgcctcacaggattttgagatttacctaaagataaggaggtggactcatggtttggattttgtaacttactggaggtgagtgggtggaggactggcggtgtgggtatgcctactagtgtctgaaatggatgactatgaggctgaaggtactaggagctcactgaaatggcaataccagtggcaatagggagaggagagagaaacagccacctactaaggaagaagggctttttctcccctcttggttcttggttcttct

SEQ ID NO: 1834 - DNA, 1152 bp, Homo sapiens
aatagctgattttaaaagccagcagcagcgacgccatgtacctgagtacaggtggcagttgcagagccgtgggctgtagaaggtcagatggggcttcccacaggggaaatctgggcatgctgtagctcagggtgactcccagctccgtcactagcagggcgacccccttccttctggagccttagctctgaaagcccccagtgggggtgccctttcagatgccccctttccatttcaaaggctctgactcttgatcttgaagccggacgcggcactggcactcggcttcagtttccactgtgacagatggaggtctcctttcgccccagcccaggtggccaagcccatcctggcctcagaacatgctgagcacattttgtagggtggcacctttttatccaagttactagctacacatcagtgtttaaagagaaaaaagtgacctttcattttttttttcttgaaacttgaggaaacaagatacatactactgattttttttttttcttaaaactaaatgcatgactgcagagcggtagaggtgtatatttttcatactgtggggcaaagtatttgtgctgctttttggagatggactggaacgtctggtttctgtccccgggcccggcagctacgtctattttctgtagaaggtgccacagtgagacctggagccaccccttcctgccctggcgccgtttagagctgggagcccgtggactcccggcctgtttctaccttctattcaaccactctgacgtggggagacaagaagaaatagaactttttgatagtgtggtaaaaacattgatttgaactattttagtaaaaggagtaacaaacaagattgtgatagtgtctactttgagctagataaataaaggcctctttgtgagcctcctggctgggtgctcagtgcttgtttctgtcgtgggtggcagggtcagcaggcagagacagggccaaggcccctcaagcaccgcagatgggggctcagtcggggccccttccacagacagagccgtggcccctcaaggtggacagtgaggccgctgctcctccagctgcctctgtctcatcacaggccagaagtggaaagggtttcaaatccaagcccccgggttcctgtgtgcgttctacgcagcaaggctt

SEQ ID NO: 1835 - DNA, 1207 bp, Homo sapiens
gggcaggacctccagcccagcccctgtcttcttcctctgtggtgaactgtacataggacgctgcccgccctggcccagctgccatgggtccgatgcactggcccaagccgccatctcccgcctcatacaccagcaacctgggaagacgagacgctgcgactgttcctgcagcagagcggcccggacgcctcattccccctctgggccctgggctccatgagcaagaggctgcaggctgcttctgagatccagcctgggaactgtccaggctcctctgtcctgcctgggatggaggggccactcatcaaaccctctactccccggctgccacccacactggacagagaccaccactacctgggtcttgacgcaggtggcaccacttcttgcccaaatgccgtggcctggccccaggccccccaagcactgggtccccggcatgtggacaaggccactcaccacatctgtggctggctggaggctgccctgggcccttcctgtgaccctcagccttggaggtcagggtgccctcacacctggggatctgtgctcagccacccgatgcccgctgctccttgcttttggaggtcatccccctcccccccagtctctgcaatgtccccctgccaccctgtccaggctatgcccttcttgggctcctcctgccccatgcctgaggcacgtcccttttcgtggtttacatgacaggccagtaacaggaagggcctggggagagtttctgggctgagccacatgtgattttcctgatgggcagcactgggccacagctggggctctggttggctgtgacctcccccagggcctggctgcatcttgggtccctgtggacagagctgtgtaggctgcagatgagagttctgttctttttgggaaggagcgtgtctggccaggttctgcctttagtttgtggtgtgacctttagcagttcactcagcctgtctgggctcttggtggaaacaggtctctgaggttccttttcggccatgcttatggctccaggtcatccagcgccacagggcaggggtcctcactgagggggcgtgagccaacagccgacggctgagggcgggccgggtggagctgagttctgctgccttgcagtcgctgcgggtggagagttgcctccccactctgagcccgtgtcctcagtagtaaaatgggcagcataaggccctcctcacaggat

SEQ ID NO: 1836 - DNA, 1182 bp, Homo sapiens
ggctgttgcaccgcgaagggcggcagccgcgcgacaccgggaagcgggaggcggtggcggcggcggcggcgcgctgacgtcacgcgccgcgggccagccagggcgcgtgcgagccgccccgcccccggtcccatcggccccaatccgggaggagcccggcgagtgggcggggccgcggaggccagcggacagatcgattggccgagaggagaatcgagagggcgaacgggcgagtggcagcgaggcggggcgggctgaggccagcgcggaagtctcgcgaggccgggcccgagcagagtgtggcggcggcggcgagatctgggctcgggttgaggagttggtatttgtgtggaaggaggcggaggcgcaggaggaagggggaagcggagcgccggcccggagggcgggaggaggcgcggccagggcgggcggttgcggcgaggcgaggcgaggcggggagccgagacgagcagcggccgagcgagcgcgggcgcgggcgcaccgaggcgagggaggcggggaagccccgccgccgccgcggcgcccgccccttcccccgccgcccgccccctctccccccgcccgctcgccgccttcctccctctgccttccttccccacggccggccgcctcctcgcccgcccgcccgcagccgaggagccgaggccgccgcggccgtggcggcggagccctcagccatggcctcgggcgacaccctctacatcgccacggacggctcggagatgccggccgagatcgtggagctgcacgagatcgaggtggagaccatcccggtggagaccatcgagaccacagtggtgggcgaggaggaggaggaggacgacgacgacgaggacggcggcggtggcgaccacggcggcgggggcggccacgggcacgccggccaccaccaccaccaccatcaccaccaccaccacccgcccatgatcgctctgcagccgctggtcaccgacgacccgacccaggtgcaccaccaccaggaggtgatcctggtgcagacgcgcgaggaggtggtgggcggcgacgactcggacgggctgcgcgccgaggacggcttcgaggatcagattctcatcccggtgcccgcgccggccggcggcgacgacgactacattgaacaaacgctggtcaccgtggcggcggccggcaagagcggcggcg

SEQ ID NO: 1837 - DNA, 1245 bp, Homo sapiens
agtctctttttcagagagtccttctctgtaaaacatggatagtaattacatatgcctgagatttataaaacaattaaatgactaatttctttatatatatttttttctcttctgaatttatctttcattcttcttttttgttttttgagatggagtcttgctgtgtcgcccaggctggagtgcagtggcgtgatcttggctcactgcaacctctgcctcccgggttcaagcgattctcctgtctcaacttcccaagtagctgggaatacaggcatgcaccaccatgcctggcaaattgtttgtatttttagtagagactgggtttcaccatgttggccaggctggtctcgaactcctgacctcatgatccgcctgccttggcctcccaaagtgctgggattacaggtgtgagccactgcacccggcttaaaataaattttaaagccttcgtttggtcagcatttcttgattacatatctttctcctttaggtcacggcagttgcacaacagaatcaaggagaggtccctgaaccccaagatatgaaagtggctgaggttctctttgatgctgcagatgcaaatgccattgaggaagtaaaccttgcttatgagaacgtcaaggaagtggatggactggatgtttccaaagagggcacggaagcctgggaggctgctatgaagaggtacgatgagaggatcgacagagtggagacccggatcaccgctcgccttcgggatcagcttggcacagccaagaatgccaacgagatgtttaggattttctccaggtttaatgcactgtttgtcaggcctcacatccgtggggccattcgcgaataccagacccagctgatccagcgcgtgaaagatgacattgagtctcttcacgacaagttcaaggtccagtacccacagagtcaggcttgtaagatgagtcacgttcgtgacttgccccctgtgtcagggtctatcatctgggctaaacagatcgacaggcagctgacggcctacatgaagcgggtggaagatgtccttggcaagggctgggagaatcacgtggaggggcagaagctgaagcaggatggagacagcttccgcatgaagctcaacacgcaggagatctttgatgactgggcaaggaaggtgcagcagcgcaacctcggtgtctcggggcgcattttcaccatcgaaagtactcgggttcggggccgaactggaaatgtgcttaagctgaaagttaactt

SEQ ID NO: 1838 - DNA, 1138 bp, Homo sapiens
agatgctttttcccagtatttaatttgcttttaagtattttcagaaggattttttgtagtttcattgtttaaatatttaaatcgttaaatataatgtatttcagcataaagtgagcagcttgaatctaactttgttctggacagttatttatccaattgttccaacattgtttactcatttggagacggagtctcactctgtcgccaaggctggaatgcagtggcgcagtctcggctcactgcaacctccgcctcctgggttcaagcgattcttctgcctcagcctccctagtagctgggactacaggcacccaccaccatgtccagctatcttcttaaatatttcagggtctaggttctttaatgtaaacatgttttgccacattttaccttttgaccacttctctgtgtcttaagatatttacgtgtaccttccatttttctcattgccataggagagattcacccaggatacacaacctcactatatctattcaccccgtgaaatgactaggtgggtgagaggcatctttgaagcgctgagacctctggagaccctgcctgttgaaggcctcattcggatttgggcacatgaagctctgcgtctcttccaagataggtaagggaagccgaggatccagttggtcccattctcccctgctctgagttcttacagctgtcgaagctggggtctttgcaggggtggtctgcctaagttagagccaggtggtgccagtggtggaaggagcagagtcagccagggcagcctcccgtctggacactggtcacagttgccccagggtaacaaagtcacagtgcgctgaatgcaccggctggcccaccactgtctgcttacacaaggcactttcataaaccttgtggctgtgaacagggtacttttttttttaaagatacatcatagaagtcaaaaaacggggcactttaataaaccttttaaactgtcaggtgggaccacaaaaggtagcagctgcctgtgataaccttaccagagcacgggttcactgctgagttaaaaggtctcccaacaactgcccagtgtgcgtgttccgtaaccaccacccctcttcctgtttctcagtctgtgttctcatcaaaggctttgcagctgcagctctgg

SEQ ID NO: 1839 - DNA, 1197 bp, Homo sapiens
taaaaacatacatgactggccaggcatggtggctcatgcctgtaatcccagcactttgggaggccaaggcgagcagatcacctgaggtcaggagttcaagaccagcctggccagcatggtgaaaccctgtctctactaaaaatacaagaaaaaattagccaggcgcggtgccacatgcctgtaatcccagctacttgggagcctgagtcaggagaatcacttgaacccaggaggcagaggttgcagtgagccaaggtcacgccactgcactccagtctgggtgacagagcgagactccatctcaaaaatatatatatacacacacacacacatatatatatacatacacatacgtatatatatatacacatatatgtatatatacacgtgtgtgtgtgtgtgtgtgtgtatatatatatatatatatatatgtacacacggctgagcaccttccagattttgctgcagttcccagtgtggactcactcaccatgtggcctttacgttcaagtcccttttccctctgtgatttcttgcccgtcccctccctccttcctgctgcgactgtgggactgtggcccaggtgtggacatgatcagtaaaatgctgaagatgcagatgttggaggatgaggacgacctggcctacgcagagactgagaagaagacgaggacagactccacgtccgacgggcgccctgcctggatgcggacactgcacaccaccgcgtccaactggctgcacctcatcccccagacgctgagccacctcaagcgcaccgtggagaatatcaaggtagctgggagggtggcgggccggccaggtctcaaggtcccaggtgctgggtatggtcatggaccattgttccatggaccattggttccactgtgccggacggaacgtactcacaccggtgtcacctcagagcaggtgtccagctgagcccaggcattgggcaagatgagttggcccttttgaaatggactgaaaacaccctagaagattgtgagataggcagacagcgccacagcgagcagccgcagcccttcctccctagagagccccgagagctgcgactcgggcaggggcctcagcgggtttctgagcagcctcagcttcacacaagctcggttccaagtcacgctctgccaaagctgtccgtgaccctggacagttcggaagctctggggctctccc

SEQ ID NO: 1840 - DNA, 1064 bp, Homo sapiens
tctggaccagcctgagctagagcagatgtggtgagggcggcgccaggggcataaagtgcagcctgggaaaggcagtaggtggagccgccagccgcctgtgtgggcagccaggatgcctagcacttgcacatttgttccatctgtgctgggggagttgtgagagctgacaccctgggctctgtgtgccttggctgcagggatcttgcctcggagctggtcccactacacggtgcctgccggcatgaccgtcatccagtgggtgtccgacttcagcgagaggatcaaacagctgcagaacatctcactggcagctgcatctggtggcgccaaggagctaaaggtgaaggcgctcctgacgagtctcgggtggtcagcagctgtcctgggctggggtgggagtggctctggggaaaaacacagggcccaggtctgacctgagctccttcccctgggggctgctgctttccacagaacatccacgtgtgcctgggtggcctgttcgtgcctgaggcgtacatcactgccaccaggcagtatgtggcccaggccaacagctggtccctggaggagctctgcctggaagtcaacgtcaccacctcacagggcgccacccttgacgcttgcagcttcggagtcacgggtgagtggagtctcacagaaaatactggctctttgcaggtgacctcggtggcctgagaccattgttcccagatacatgcacttagggtgaccggctggcagttgggtggagcctctgggcgccctgtgactggggtttgtgtagctgttgtgttcacctcagcctgggttttggcttccgcctcacaggtttgaaacttcaaggggccacgtgcaacaacaacaagctgtcactgtccaatgccatctcaaccgcccttcccctgacgcagctgcgctgggtcaagcagacaaacaccgagaagaaggccagtgtggtaaggaggcactgcctttcccaggcattctgcagggacccctgcggtaacaagggcagaggcggctcctcttctatgcctgggttccacttggaacgggaaatgagg

SEQ ID NO: 1841 - DNA, 1553 bp, Homo sapiens
gatctggtcatcttgctttatgaaactgcgctcctgtcttctggcttcagtctggaagatccccagacacatgctaacaggatctacaggatgatcaaacttggtctgggtaagccttatactatgtaatgttaaaaagaaaataaacacacgtgacattgaagaaaatggtgaactttcagttatccaaacttggagcaccttgtcctgcttgctgcttggaggtattaaagtatgttttttttagggataagtaaggtcttacaagagcaaagaaatgaaattgagactcatatgtcctgtaatactgtcttgaaagcagatagaaaccaagagtattaccctaatagctggctttaagaaatctttgtaatatgaggattttattttggaaacaggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacacgtaggcacagaaaacaggaatgcagacaacatgcatcccctgcgtccatgagttacatgtgttctcttagtgtccacgttgttttgatgttattcatggaataccttctgtgttaaatacagtcacttaattccttggccttacagtgtctcaaagttctttacaaatctacttaaagccatcctggctgaggcaggagaatcgcttgaacctg

SEQ ID NO: 1842 - DNA, 1176 bp, Homo sapiens
ggtgttcgttggggaccgcggcgggggactgggcccgggcctgcggcggcctcccggaagcgcgcacacgctcgtggtagttgccgcgctccgaaatgaggtcatcctttgtcagccgcccttctattttcggtttacttaaacttcgcaaatctccaattcggctttaaaaatatttggagaacgcgatggaatttcgtgttgcctctgtagacgtcctgcaaggttttaaaccggcgcggtgtcgttccagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgtaagtcacttattaacccagaatcggattttggtttcagtgtgaacttcttgggggtgctgtatgcttaaattaatattttttgttaacaggcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtaggcacctgaacattcactggttaagtgagcggtggaagggtggggtgctgcaacccttggacccctggggatgcggtgaagcttacagaatttgtgtttgcccaacgatcaggaacaagctagagcacttaattagtgtaatggcatgacttggtgggcggttcttttgggcgaggcaccttgcccaaaaggttctgctgtggtggcctttgcatctgtagtaacggcaaaccttgctttatagacacgttataagggtgttaggcatggcgttgagcactaaattgaatgtattaagt

SEQ ID NO: 1843 - DNA, 1141 bp, Homo sapiens
ggaaaataccaccttagtacaaacacattacatcaacttttatatgtaagatgtaatttagaaaaaatgtcaataatggttttatgacgagactgaaattgcagacatgttcataagcacaatgcttcttttctctttcttgtctttctgtacgtaagcaactagaagccatttgtgtcaaggtaacgtctggagaaacaaaaggtcaggaaaggccaatgctcctaccgaccacaatccagccccaaactgcaagaaagagccagctgccccgggggaattcctgcctggtggggctccatatcgccagccctcagctgctcagggtacagccgcttgtgagaaccgagccacagtcctgcttcctaagtgacttatgccaacctcctgctcaggggtttgtacagagaccactgccagccctccaggtggtccctgcaaagagagtcccagcccccaaggctccagatgaacagggctccatgttgacccctttgtctgcctctgacccgctggcagtaacatctctttcatccagttcagcacatccatttatttccaacttgcatacaagacatactgagaaactaaaaaaatcgttaaaagtaaagacacgttctggacgggtatctcgacctcccaaatataaagctaaagattataagttcataaaaacagaggatctggcggatggtcatctgtcagattctgatgattactcagaactctgtgtggaagaagatgaagatcagagggagaggcacgcactctttgacttatcgagctgctccctgaggcccaaaagctttaagtgtcagacttgtgaaaagtcatatatagggaaggggggactggcccgacattttaaacttaacccaggccacggccagttggaccccgagatggtgctgtctgagaaagccagtggaagcaccctccgggggtgcacggaggaaaggacgctcagcctgacctccctggggctgtccatgccagcggatccatgtgagggaggggcccgctcctgcttggtgacagagtcagcacgcggtggcctgcaggtaatgtttctgtctgggtatgtgtctttttatttggccgttctcggattgctataaagaaatacctgagaccaggtatt

SEQ ID NO: 1844 - DNA, 1137 bp, Homo sapiens
attatgtactttcaaaggatgaattttatggtattttaaatctatccagtaaaataatttaaaagtttaaaaagtcatggatacgtaatgaattaggaacaaaattcaggtcaggttttaaaatgacagtcacatcagagaaatctttttttttcttttttttgagacagagtttccctcttgtcacccaggctggagtgcagtggcaccatcttggctcactgcaacctctgcctcccaggttcaggtgattctcctgcttcaacctcccgagtagccaggactacaggcgcgcgccaccgcgcctggctaattttttgtattcttagtagagatggggtttcaccatgctggccaggtcggtctcaaactcctaacctcaaatgatccacccgccttgggctcccaaagtgctgggatttcaggtgtgagccacggcgcccggccactaaaaggtttttatggggtatataaagcatgattgttttattttacttttgggtgtgcaacactgtctagaatggtcagtctgtagacgttgaagagacattgccatctgaaccagaaaatggagctcttttgcgatcagagagataccaaggacctagaagacgcgcatgctcagagacccttgcagagtcccgcacagctgtcctccagcagagaagagctgctcagctacctggtggccctgctgcggcaggggagcagagggcgtcgccaagcaaagccaggctcaaggaggtacctcactcttaaaccctgtgcttgaaacccgtgtctttagcatggatgtggcaatcactatcagtttctgaatcacctaagcagttcacctgaaatgtcattgcattaagtgtgtgatgatgccaaggacagtaatatctgaactaattcgtactcttacctgtttaaagtgactgtacagcctttggtgcagctccaaaagctgcttgacttgataagttttggaataattataacctgtgtttatatggaagcagtttagaaaacaacggaagtggttttcaaaaccattctttttttttagacggagtctcacactgtcatccaggctggagtgcagtggtgccatcccggctcactgtgcttctccacctcccaggttcaagcgat

SEQ ID NO: 1845 - DNA, 1151 bp, Homo sapiens
cgttggacctcactggcaaaggctaggcccggagcaccctaggcgctggattttgggacaaaactatttttcagagcgttgtaccggcactttatatatattgatctctgtacggcacaatctctgcctcatctgtcgcatgcactgggggctgggcttggatggtcaggtgagttccaagtggcaggttttctgggtgcagctgggctcgggccttcagctcgctgtccagcccctgaagggagtgaggactaacctcccaccttgatctagagcctcggacaggtgtgcgtcccagatgggtgacagctgagtgccgcaggagctcggtaggtgcaggggtggggactggcatgtccaagcagcaggacagcgtataaaaaggcctggaagccaagagaacgagctctgcagcgtagggttctcacgggaggtcctgtgcggtcagccttttgcaccctgtggactccgggccagggagggcacacagggctggcaggcccgcggtggctggtgttgaggcatgaacaaattgtaccgggtatcccccaccccactctgaccaccagttcctccttggatatcactccccctgacaggcagcccacccaggcctggatttgtccctgtctcccccttttgcttttcccccatgactaatgggcaccaggtcttgctgctcctgcttctcacctctgcagtggcagcaggcccctggccccaggtgcatgccggtcagtggggttggatgtgccttcctccaggcctgccctctgtccaagcccggagtgggcttggtgggctccctggtggcccccagtgggtgccaggtggtgcccggggttattgaggggtggttgtatcactgtagggacaggcttcttgccccagcctggagagctgttttcttcaggaaggttctggagatggagacttgtttgcgaattcaccacaactccaggctgggaggctgggtctccgctctcagagccgagacaccagggaggatagccaggctgccctgcctgggaattctgctgggccgtcaaattcaacccgcaccaacgtgggcaggagggccacagtgtcctgccaggagcagagggctgaaggtctgcaggaggaagaaccactatcctggtggggggcac

SEQ ID NO: 1846 - DNA, 1178 bp, Homo sapiens
aatcaaatcctaactctctaactgaaactttgtaccatttgaccagtacctctcctttccccattcccccgctcccagcctccgtaaccactgttctactctacgcttcttcaccttctactttcttagattccacatataaataagaccatgtggtatccgtcacatatttcacttagcataatgccctccaggctcttctgtggccatggatgataatcatgtattgtatatttcaaaattgctaaagagtagatcttaaatgttttcatcacaagaaaaggaacttggtgaggtgatggatagattaactagtttgatttaatcatttcacaatgtatacatagatcaaaacatcccattgtatcttataaataaatacaattttttttgtcaattaaattttttaaaaattacaagaggctgaggtgaggttacagtgagctgtgatcatgccactgcactccagcctgggtgacggagcaagactctgtctctaaaaaaaaaaaaagtgaagttaaaaattaattaatttaaaaaaatcccaactcttccatcaccccagccctgcatccttctcccttcccccaagaccccctcccctgccactatgctctgattcctagagcggtgtgtccctgtcctgccactcttgctgtgcctgtggctgtccctgttccttgggtagcttccctgttactcctcaggggcttccctggccaccctctgctcgggcccttcctgagtgttacatcagcacctttcttgcccgcacccaccaccagccacagcttgtgtttgccgtgtgagccggagcacttgtttgtcacctcacggtcttcccctccatgagggcaggcacggcagtcttgctttcattcttgctttcatgcagtctacccagctgtgggcgagatgtgtgcacatcgctcagcatgtttgtagaatgaacacatgtataaactagacttgaatggagattattgttctctcctggccattaaaggtgcttcttcctgctgctcatttacatctcaggtgttaccatctctggccagtgcctgccctgttgttgtcatctaacagtcatgggaccacacctttgtgactctcagggccagaggtgtttgggaatgtggaatttttgagatttttagaacagaaatagtgaaagtacc

SEQ ID NO: 1847 - DNA, 1107 bp, Homo sapiens
aactgagtcgtttgtgcatgaattaagccggtctgcttccccgtcaccttcgtaacaaaacaacgtcccctctcccctcgcctcgagcagtttcttcaggacaccgtggctcgggctgctccctgctgccaggcacgctggttggctggcctgggcccggctcacgtgaagggcactggctcttgtgaccacactgagccacgtgcaagccgcagccgggcctggaagcctgaccctctggttctagggcttgtcccgcggagcctgcagagctagacgttggggtgtgtccgtgatgatatgggggccaggctgggagtagggcctttctagcagggttgggtggctcagtgagggtgtggaagtgggggacccacggggcctggctttgggactagacatgccagccccagctgggctggagggagcctgagtgagccccgacatacgctgggcctttcagctcgccgtgctctggtgacacacaggcggccaggttgggatttgtgtcaattctaggagccatcaagcatgaatgtggttctgtctcctgagcgcaagcctcgccggacccctgggcgaaggcctggacttgcagatgtgtgttccctgtgcgggtggacagagggggcccttatgacccacattgcagccccattccaccaccccttcctccccagagcagtctctgccgagggacagcacctgtgtcccttcgatgccacaacagccagttgaacaggggagccctttgctcaggcagcttctcctgcctctccctcctttctccttccctgccccatccccgtgcccttcttggcctgtggcgctggggagccatggtgtggcatactggggctcctgctccttgggccacttcctcagcccgggccccacaggcccaccacctgccagggctcccactgcactggctgtggcaggaggcttccccatgaccccgtgtggcccagctcggtgaggatgcagttctaggcacagcccctgggacagccagctgcctcccagaccacgtcagcctgctccagggtcctcagtcaccctgggccaggggccacgtgtcccatggatgtcgaccatgccaacgtc

SEQ ID NO: 1848 - DNA, 1191 bp, Homo sapiens
gggtgacaggctgggctgacaggatgctctctttgccagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcattagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctcta

SEQ ID NO: 1849 - DNA, 1231 bp, Homo sapiens
tgtaagggagactgggcacggtggctcatgcttgtattccccgcattttgggaggccagggcgggcacatcacttgaggccaggagttcaagaccagcctggccaacatagtgaaacccgtctactaaaaacacaaaaactagcttagcatggtggtgtgctcctgtaatcccagctactccggtagctgaggcatgagcgtcgcttgaaccttggaggcagaggttgcactgagctgagatcgtgccactgcactccagcttgggcaacagcgactctgtctcaaaaaaacaatataaggaaccttttagtccttgtactatattttatcaaatctaagacatctttcaaaagtgtattgttaattaccattaaaggtgaaaaataggctgccaattaaactgtgccatatcaattaagacattatctgagggtagatgaagtaatgactaaaattctgctggaaacccagcaaagtttcttttactggcattgtttggtaaagagggcccccttcattaaacttgaatattgcaagcaacactctgtggcagatgatcaaaactgtctgacacaatttgagcttgctatagcaagaaagtctaacctattccggtgttctctctcccatgagacaagccgttatatagacttaaacagtgttccacctgttggctaaagctgggttgagttaatgactttgttcatgagggatgacagggatccttagggccacctctccctagtggaggcatcatcacttcatcttactctttcttagcagttacaatacccctaatattttgtgtcactccattcttagactaacattcttacgtatgaaatacatgatgaatttgatctgtgaagcctcttaggtagcattgtgtgtgctgtgtggtttttctgaggggatccataggaaaataagggcagggttttaaacgttaatgatgggcaatgaggtaatgtaagttatggggttaaatttttatttccctttttttctgtagagaatagtgacagtggtacaggaaagaaagaaaaagaaaagaaaaacagaaagggcaaagacaaggaaaatggctccgtatccagcagtgagacaccaccaccaccaccaccaccaaatgaaattaatcctcctccacatacaatggtgagtgcagggttgatggcctagtgggcactaaagttgtgtaaagtatatggcatttggttgaggtgggtg

SEQ ID NO: 1850 - DNA, 1231 bp, Homo sapiens; identical to SEQ ID NO: 1849

SEQ ID NO: 1851 - DNA, 1911 bp, Homo sapiens
gttaagggactgggccccggcccgtgggggctcaggactcagcaacacctccccaccccgagacgtgaggtgggggcggggctctctggcgcctctccccgacggccctgggagctggagctctttgttttcttttctcactcctccgccgctgggattctaccaggggctggtgacgccaaagcttctccaggggcagggctcctacccccactgtggggggcgggtcgggctgtcctggcggtccctggccccgccccacctcaggccacagcgcatgatggcagctggggttctcctgctgtgaggcgtcccggttcccccgcccgccccgtgttggcgggtggagtcttggcagcagcctccactcctgggcatggcagggagcagcacctcagggacttgggaagttcctttggtctgggggcggcctggggcttttttctgggtatgccctgagaccagccctcccgcaggcacaatgacaataagaccttcctggtgtgggtcaacgaggaggaccacctgcgggtcatctccatgcagaaggggggcaacatgaaggaggtgttcacccgcttctgcaccggcctcacccaggtgccagggacggggcaggcccagaccccagggccccagcagggatgtgggtgccccagcatcagtccccccgggggatttccggcactggggagtctcagggcctgtaggggtttcaggcaggccttctccctcataccctcttctccgtctgcagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggtgagcagggcaggtgctgcggcttcccgtggcctttgggcagccctgtttcctccgccctgacttgctgtctccccaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcctgcgtctgagtggtgcctctcctttcccaggggggagggggaagggcagcagccaggccccaggagtcttgagtcctgggcctgctgtgggcctcgccttctgtgagatgggacaagagccaggaggtggccactctgttctgcctgccctacctagtccatgggccccttccctcgtgtctatcgggctgtgcaggcaggaacatgggagagagcgagggaggagctccaggcctgagcatctgagggcattcaggcctgggtgtggagcctggcacgttcctcaggcccatcctgcagggtgggggaggtagggatagtggaggtggggggttgacctcagaaacttgagagctttccggtccctccaactggcttcctcctccagtcttccaagctgcaacactatcagatgcaggcatctccctgcctccttcctaccccgccaacacctactctctatcttctcttccctgcttccttccctcccagcctcggccttcaggctg

SEQ ID NO: 1852 - DNA, 1219 bp, Homo sapiens
gctccaaatgatcctccaccttgacgtcccaaagtgctgggattataggtgtgagctgcgaggtaccacgcctggccaggatggattgattgatttcttttctttctttctgtctgtctgtctgtctttctgtcttgtcttgtcttgtcctgtcctgtcctgtcttgtgtcttgatggagttttgctcttgtcgcccaggctagagtgcagtggagtgatctcagctcactgcaacctcagcctctggagttcaaccatttctcctgcctcagcctcccaagtagctgggattacagacacctgccaccaagccccgctaattttttgtattttttagtagagacagtgttttgtcatgttggccaggctggtctcaaaactcctgacctcaggtgatccaccctccttggcctcccaaagtgctaggattacaggtgtgagccactgtgcccagccatgtatttctttttttaggataaattcctaagacgggttagagtataaacattttatagtccttggtacctgctgccaaactgccactcagaaaggctgtgtctgcccatgcttctgccgcacaggcgccaccctggaggtggggggctctattccgttggtggagatagagtatgcattgtgttttaatttgtatttctttgattatgtatttttagtcatttgtatccttctgtgaatttcctgttaccttgcacatttttctgttaggattttaatgctttagtattctatgtttgttttcttttgaatttgagttcttggtgggcttctttttgttttttttgagacggagtctcgctgtcacccaggctggagtgcagtggcgttgtctgggctcactgcaagctccgcctcccgggttcacgccattctcctgcctcagcctcccgagtagctgggactacaggcgcctgccaccgcgcccggctaattttttgtatttttagtagagacggagtttcaccatgttagccaggatggtcttgatctcctgaccttgtgatccacccgccttggcctcccaaagtgctgggattacaggcatgagccaccgtgcccggcccttggtgggcttcttaaacccacttgatttaacaaatcacagtgtgctagtcccactcccagagtttctgattcagcagggctagggtagtctgggtttctaataagttccagttgaggctgactgctgttggtttg

SEQ ID NO: 1853 - DNA, 1192 bp, Homo sapiens
ccaccatacccggctaattttttgtatttttagtagagatggggttggccggctggtttcaaactcctacctcaggtgatccacctgccttggcctcccaaagtgttgggattacaggcgtgagccactgcgcctggcctttaatgtattttgaaagaaagcgccttataaatttatgccagagtgacaatgaaactgtagccatttgaatgttacacaaacccaggactggctacatgagtttgaggaggaggtgtttccctgcctctctctttgcgctgtgggtgaccactgcctgtctgctgtcattacatgaacccttaagcactctgggtgtttcatatagaaataatcctacttttcaatagtattgaaaggtgtcatttatctttttggactgttgatcaacttcttttgatacttgtttaataaattacatccaacttgttccttccttcttaaatcatatttatatatgcatctctttcaaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctacttatcttgtggcctctctgagcctcttgttttcttatttggaaaatggagatgttaattatgtaagctctaacttacagttattatgaggataaataagagaaagatttaaactatgaagtcctttagaaataaggtagcattcaatgacatagtagttgaaattataagctgtaggagaatattgcatcaggaaataatcacaaggcaaagtacataataagccaattgaaaaaaaaagccaattgattctagttaggctagtatcaaatgcatactgcataatatttgtctcc

SEQ ID NO: 1854 - DNA, 1178 bp, Homo sapiens
attctttttagttgttattccccccagttatgttcacacttgtgactgtattctttttgtaattgagatacttttgtggtgacttaatttatgatcagttcataggtatttggagttgtgtattttcatgtgtgtacattaaagtttgacattttgtgtgaaacagtttttattacaactggatattgattttattttcctgttcggagggactatttggccataggtcacttactttgtttttaatcacaaaagccgtacatgttcatggcagaggctgggacgtgtttcaaggatctaaagcaaggctgtggtcatggctctctgctattctgacctctgggtgggcacagttatgcgtttgcattggttcccatctcaggggtgtgtgtttataaacagatcagggagcatatatgattttgtattctggtattttctctaagtgttatattgttcatccttaacattacttattaattaatttctaagaagatgattcttgccaggcatggtggcacacgcctgtattgccggttgtttgggaggctgaggctggaggatcacttgagcgtaggagttctgggctgtagtgcgccatgctgattgggtgttgcattaaacgcaacactgatgtggtaacctcttgggagccagggaccactgtgttgcctaaggaggggtgaaccagccaagttggagcaggtcaaaactcctgtgttgatccgtgtgggattgtgcctgtgaatagccactgcactgtctagcctgggcaatatagcaagatcttgcctctaaaaataaattttaggccaggcatggtggctcacgcctgtcatcccagcaccttggggggccgaggcaggcggatcatgaggtcaggagattgagaccatcctggctaacacggtgaaaccctgtctctactaaaaatacaaaaaattagctgggcgtggtggtgggtacctgtaggcccagctactcgggaagctgaagcaggagaatggcgtgaacctcggaggcagagcttgcagtgaaccaagctgtgatcgcgccactgcactccagcctggacaacagagcgagactgtctcaaaaaaaaaaaaaaaaaaagataataataataaaaatttttaagagattatttctttttttttttggagacagaatcttactct

SEQ ID NO: 1855 - DNA, 1290 bp, Homo sapiens
cttggagggatggagaggcggcctcgtgccatgatctgtatttaatggtttttatttctcgggtgcatttgagagaagccacgctgtcctctcgagcccagatggaaagacgtttttgtgctgtgggcagcaccctcccccgcagcggggtagggaagaaaactatcctgcgggttttaatttatttcatccagtttgttctccgggtgtggcctcagccctcagaacaatccgattcacgtagggaaatgttaaggacttctgcagctatgcgcaatgtggcattggggggccgggcaggtcctgcccatgtgtcccctcactctgtcagccagccgccctgggctgtctgtcaccagctatctgtcatctctctggggccctgggcctcagttcaacctggtggcaccagatgcaacctcactatggtatgctggccagcaccctctcctgggggtggcaggcacacagcagccccccagcactaaggccgtgtctctgaggacgtcatcggaggctgggcccctgggatgggaccagggatgggggatgggccagggtttacccagtgggacagaggagcaaggtttaaatttgttattgtgtattatgttgttcaaatgcattttgggggtttttaatctttgtgacaggaaagccctcccccttccccttctgtgtcacagttcttggtgactgtcccaccgggagcctccccctcagatgatctctccacggtagcacttgaccttttcgacgcttaacctttccgctgtcgccccaggccctccctgactccctgtgggggtggccatccctgggcccctccacgcctcctggccagacgctgccgctgccgctgcaccacggcgtttttttacaacattcaactttagtatttttactattataatataatatggaaccttccctccaaattcttcaataaaagttgcttttcaaatttttggctcactttgctgggtggaagagtgggtggccagggagggagtggggagtcctgggagggaagcagcatcctcagagcagctggtcctccccagctcctcctggtgggcaccgccaccccaacaggtttggggacaggctgtgtggtgggccgaggcgggagtatacaggcctgttcccaggggcagcctcccatggaaggtgttccacccccatctccagaggcctggcctgaggggagatgggaggccctggctggccctgcccccgttgggatccacctcttcttcccttgaccccacccagcttcaccccagccat

SEQ ID NO: 1856 - DNA, 1164 bp, Homo sapiens
gcttcagctgactacatgtcaaagagagacaaagttaagagcagcctttcatggtgtcaagaagcagttagcatcttgacttcccctccactcactcgctgacctgctgcagcctccccgggcacctcaggcatagaaaatgagctcagggatctgcccaccctggaccccagtcccgttggtgctgtccgaggagcactggaactggaaggccacctttccacactgcacttccgtcatcccctcctgcccaaagtagctgagttcgctgccgtccaggacggcactggccgtgtagaaggtgtcttgttcaacctggaccgggtgttcaaaccagaccgggaaggtgttactggatccgtctgacatgaacttggtcaagttctgagccagaaccaccccgagccgcttgagctcaatcttcacgctgtactcagccttcccagagctggagccatacaggcccagccctgcaataaatacccttctgtccactgcaaactggatgctgtcgcagcgcccgcggtaccgccactggttgctgcggtaggcagaagactggaatcggtggcacctctgcggggcgaggcccttcctcttggtcaggggaaagtccaggcggggcttgttggtggccgtgtaccacaggaagatgctgtgggtctcctccagagtcaggatgtctgactgggcagcgccgttggcaaactcctctagggtcatggttggaattcggaccagatagagggctcgccccagaacatgcctcttgtttcgtggggtgattggcagcccctgcctcttgcactccgcctcggcccagttcaggacggcctcgaagaccaccgcctctttggtgttgagggcctcccgagtgacaatgatctccagcgtctgccggtctatctcacagaagccttcggaccgtagggccatctcggcctgtgcgtcaatgacctcccagcagcgctgcgtcagctcgggctcctcaaacagccggctctgggacagcaggacgcaggcgttcttggcttccaaacttgtctccagaaagttgacacaggcttttgccaatgctgggacgatgtacttcttagcagcgtacagagtggccagcaccgtgtcggcttccagatcgatctcatcactgtacatgtacctagg

SEQ ID NO: 1857 - DNA, 1102 bp, Homo sapiens
cgtgaagattgagctcaagcggctcggggtggttctggctcagaacttgaccaagttcatgtcagacggatccagtaacaccttcccggtctggtttgaacacccggtccaggttgaacaagacaccttctacacggccagtgccgtcctggacggcagcgaactcagctactttgggcaggaggggatgacggaagtgcagtgtggaaaggtggccttccagttccagtgctcctcggacagcaccaacgggactggggtccagggtgggcagatccctgagctcattttctatgcctgaggtgcccggggaggctgcagcaggtcagcgagtgagtggaggggaagtcaagatgctaactgcttcttgacaccatgaaaggctgctcttaactttgtctctctttgacatgtagtcagctgaagcttgactgtgtagagacattttccacacagccagaacccagggattggagtcttaggcatctctggtacagtggggtgcacgtctcaggtggaggaagatttacggctcaagacaggccccagatcccctcccagtggcacccatgccacctgctttgaggggttggatcttcctgctaccctcttggattctaagtggttccaagcttaacttgagaccttcccttcaaatctaaaattggcaaaaagtcacttaaaatagtggacttctgtaataaaggttgcctaaaataacacccacgtgtcagtaaatgactacagcagttgtacagtggggtattctctttctcatgcaacagaacagctccctcccatcccgaggagaaaacctgtcatgctgaacatgctatgtggttaggagcaaactgcgccccagtgaagcccatctgtcccctgggttgctggctggcttctgggccaccctaggaaacaccaggtgcctggttgtctctatgtcctaatgcatcactagcacctcagagtcctaccctatgaacagactgtcgggggagcattctgctgggcccagcgttctggaccctggggactgtcactagctgtgacactgctgcgggacagcctgttgcaggagtggactatagggtgaaacaggctc

SEQ ID NO: 1858 - DNA, 1128 bp, Homo sapiens
tgtttgggattcagttacattcattgtgaagccagaggccgtgcctgttctgccttgtctgtgctggtggctgcccctggatgacgctgaggtccctgcctcatggtttccctggagggcctggccccaggctccagcgattggctttctgcttctgcatcctatccttccagtgtcctccgacaggccctacacacttgccttcccccaagtggccaaggttgtctgcgcgtcccgattgcagcagcctccagtcctgtgtctgtgctttgtcacaaatgcactggcccctgtgccaaccactgagggccgacgctgcggggcggggggcactttccagctctccccatctttgggcatgcctggggcctcaccttactgttctcgttggaagatcaggccgcagcgtttgggttggtgaacctggtgaacaatccacatgtccaccatgctcattgggagatcaggctgcagcgatcgggctggtgaacctggtgaacaatccaaatgtccacctgatgtttccagaggtaccagggccaggtcttaaccccgaagccctgcagggcagaatgtggtggacgtcgtaggcatgctgtcagttggcagagcttcggagtagagtgtccagcaggttcagctgcagcctccccatgggtgggtggactgaggcgtgggggccttctgcagactggctggttgcagtgccttggggcacatgggatggtacctgcgtcccctgcagtccagcagggaggtggatgtgttcacatgtggtcaccatgcaggagtgatatctgagtgggctggcctggggcaagggggacggccagcccatgctgtgtgtgcaccacttgcagaggtttggaggtacatctgtgttctcgcccggcagccatttgacagcgtccactctggacttgcagtgtgttagggacatggttagaaaatgcagaaagtgcctgtaatcccagccgggcgtggtggcgggcacctatagtcccagctacttggaaggctgaggcaggagaatggcgtgaacccaggaggcggagcttgcagtgagtggagatgggaccactgcactccagcctgggcaacagagggagactccgtctcaaaaaaaaa

SEQ ID NO: 1859 - DNA, 1099 bp, Homo sapiens
ggattgcagctgcaactgcaattcccagcccccgacccccgtgaagatcgccgtggcgggagcgcagcattacctcagtgccatcctgcggctctttgtggagcagctgtcccacaagacacccgactggctcggctacatgcgcttcctggtcatcccactgggtgagcaccacgccgtccacctgggcctgggcacagatgccacgggcagtgtggcgtggcatggagtggtgtggcgtggcgtggcgtgttgtgtggcgtggcgtggcgcggtgtgtcgtggtgtggcgcggtgtggcatggcgtggtgtccctgcttgctacacatttgttgtttttaaatgtttgtttgatacagtaacactttgttaattttaattatatgcaagataacttgattgccctaaaacagccatttgggtcaagataaagccatcgccctctgaaggggcctgagctgggtgtctcctccatcagtcgctgtgataactctatgccagtttcgatttccaaagtcagaagtgcaaagcagggctcgttattaatcctctcaaatcgtccaggtcctgtgtcgtcgaactccattacttctttaggtccatacgatgtgtcttaccacgaaacaaacccacccagccttaatctgttgaccagcagcaaggcctggaggcgacacctctcccgtgtggccctcacgatgccgacgtcagagccctgagccagccgaggcctctgcacggtcacatgtgccctgctgggccttcctcagtggcactcagggctctgggacctcagctcagggctggagctccttcagcggggccacaggcatccaccagggaggggcagtggtggctttctctttcggtggcaggaaagtgggcttgtctggaaggcagcagcacaggcctggggtcgggtggcccagcttttgtgccgcggtgggagccttgcagctccgagtcccccgtggtgacaccagccccacccctggcatgcaggctcccaccccgtggccaggtacctaggctccgtggactaccgctacaacaacttcttccaggacctggcctggagagacctgttcaacaagctgg

SEQ ID NO: 1860 - DNA, 1196 bp, Homo sapiens
ggagtccgtgctgcccgtggcccctggtccctggtccctggggagctgtgtgcctggggggagtccgtgctgcccatggcccctggtccctggcgcctggggagctgtgtgcctggggggagtccgtgctgcccgtggcccctggtccctggcgcctggggagctgtgtgcctgggggaagtccgtgctgcccatggcccctggtccctggcacctggggagctgtgtgcctgggggaagtccgtgctgcccatggcccctggtccctggcacctggggagcggtgtgcgtgggggaagtccgtgctgcccatggcccctggtccctggcacctggggagctgtgtgcctgggggaagtccgtgctgcccatggcccctggtccctggcacctggggagtggtgtgcctgggggaagtccgtgctgcccatggcccctggtccctggcacctggggagtggtgtgccttgggggagtccgtgctgcccgtggccgctggtccctggcgcctggggagcggtgtgcctgtggggagtccctgcttggccgacactgtggtcagcgcatctcctttccccagctctgtgggcaccttcgcacgggccctggactgcagcagctccgtccgacagcccagcctgcacatgagcgccgcagctgcctcccgagacatcaccctggtaagtgggcccagggcgggacaggtgagacctggggtggcccatggcccagagtggctgcgcccttcttcctaccagggcccagcacctgccccaggtattcaggacccctgcagaggtgctgtcccacctggactggcctttcctatccaccccaaactcggccagactgtgctgagggtgcagggagggttgtgctgctgggcctgcagtaggggatccttgaggtactgagggagggggtaccgtgccacaggtgcaggaaaagccaccttggcccgggtgaccctgctgtctcctgccgcagttccacgccatggatactctccacaagaacatctacgacatctccaaggccatctcggcgctggtgccgcagggcgggcccgtgctctgcagggacgagatggaggagtggtctgcatcagaggccaaccttttcgaggaagccctggaaaaatatgggaaggatttcacggacattcagcaagattttgtgagtaccgtgggtggcga

SEQ ID NO: 1861 - DNA, 1146 bp, Homo sapiens
ggaggcaactgcaggtggggaggggctggacaggctgcttctgttccttaagggatgggcctcagctaagcagcgtttctggagctggcaggttgctccgatgcccctgggccctggcacctgactgagttgagtatgacatcctgtcctctctgagctggtcctgctgggagccgagccatcctgggaccagctcccacatgcacacgcccacacctacacacagggcagtggggaagggcagtgagtgggggagggcagcggcggtcctgggcccagctgggggtgaccaggagcatggaccccgcttcttggcccaactcccgcagtgccccttgggctcctcaccctgcactgtgggaagtcagaggcctctggcaccccatccccaagcacatgccagggtggctggggcccagccagggcagtgggtggtgacctgtttctggccggggctggcggctctctcagagccttaggaaaaagcccggcctcctggtggggcagtgccggccacagcgtggctgccctgcagaggggcttgtgccgctgctggactgacagccttgcgaggctttgcttgtctcggcacggcaggcaagtgggtggacagccccggcccctgtgcagggaggtgactgtcgggtccaaggctcctggcctcctgcctggagcccaagccaatgtgtctcttgctggccagagagctgtggggccaccaggcggcccaggacccggggatgcgaggccccacgtcccccaggcccatcctgggtgtgggctgtggcttggttggcagatggccccggcccattgtcccaaggtggctgaggccgtggtgggcggtgggagtgcaggacgcgctctctcggggcctcatttctctcctccatttctcatcaggtctggcaaaccacggacaggccaggcacatggtaagaggaacaacccatgatggggtacggtgcgctcacccatgagctctctggggtgttgggaagaggcctggccagccctgccaggtgccacgtggaagcttccaggaggcctggcaagaccagaggggctgcagcatgtgggggccatggcccctgtgccaggcccagcggtgtgcggccgaccagccctcagggctgccctgggcca

SEQ ID NO: 1862 - DNA, 1169 bp, Homo sapiens
aaaggaacggccagaaatttctcctccatctgattttgaacacaccatccatgttggctttgatgctgttactggagaattcactggcatgccagaacactgggctcgattactacagacctcaaatatcaccaaactagagcaaaagaagaatcctcaggctgtgctggatgtctacgactccaacacagtgaagcagaagtatctgagttttactcctcctgagaaagatggcttcccttctggaacaccagcactgaatgccgagggaacagaagcacctgcagtagtgacagaggaggaggacgatgatgaagagactgcccctcccattattgccccaccaccggatcatatgaaatcaatttacacacggtctgtaattgaccctgttcctgcaccagttggtgattcaaatgttgatggtggtgccaagtctttagacaaacagaaaaagaagactaagatgacagatgaagagattatggagaaactaagaactattgtgagcataggtgaccctaagaaaaaaatatacaagatatgaaaaaattggacaaggggcttctggtacagttttcactgctactgacgttgcactgggacagaaggttgctatcaaacaaattaatttacagaaacagccaaagaaggaattgatcattaatgagattctggtaatgaaagaattaaaaaatcccaacatagttaacttcttggacagttacctggtaggagatgaattgtttgtggtcgtggaataccttgctagggggtcactcactgatgtggtaacagaaacctgcatggatgaagcacagattgccgctgtatgcagagagagtttacaggcattggagtttttacatgctaatcaagtgatccacagagacatcaaaagtgacagtgtacttttgggaatggaaggatcggttaagctcactgactttggtttctgtgcccagatcacccctgagcagagcaaacgcagtaccgtggtcagaacgccatactggatggcaccagaagtggttacacggaaggcttatggccctaaagtcaatgtatggtctctgggtatcatggctactgagatggtagaaggagagcctccatacctcaatgaaaatcccttgagggccttgtgcctaatagcaactaatggaatc

SEQ ID NO: 1863 - DNA, 1177 bp, Homo sapiens
cacagacagagagagagagagtgtgtgtgtttgtgtgtgtgtgtgtgtgtttattggtgagtgtggagcagatgagcccagtcagaaccgcactgtattttagtggtcttctgcactgtggagggtagaggaaacctggcttgactgttaacttggctgaccctacctctgggccagttctctctagtcatggacagaaaggcaaaattcccgactttgtggaccctatattctagttgaaggggagaaaagaagcaaaaacatggaaattatctggtaaattagccagtaacgaatgctatgaaaaataaagaagtacatggaggattgagattgtagatagaagcaggtgtttcagtttacactgtgaacaagcctcactgggaaggtaaatttaaacgaagcctagagagaagcagttgagccagatatatgagcaaagacctttccagataataggagtggtcattgcagaggctcaaaggaaggatccctggtgtcctcatggagcagttagtaaggaaatgtggctggaatggagtcagcaagtgggagggagggatagagaagaggacagaggagagatgtgagtggaattccttcctccactttttactaattgtgtaataacagttgactcaaacttcaaaagtctcaatgaaatcagtacttttactatggcctgtttatctcataagatttttgaaaggataaaatgaaataatatggagaaatgacttataagcttttgttgtaatttgttatatacatagggatggatagacggatggatagattagatgatagatagatagatagatagatgataacgttatggactgaatgtttgtgtacccccaaaaattgatattttgaagcctaacttccagtgtgatggtattaggaggtgaggctttggggaggtgattaggtttagatgaagtcatgaaaatgaaacccccatgatgggatttgcgcctttatgagaagaaataccagtgctttctctaattgccatgtgaaggtataccaacaaggtaacagtctgtaagccaggaaaagagtcctcacaagaaacagaatttgtctttatcttggacttcctaacctttagaattgtagaaaataattgaatgttgtttaagctaccagtctgtggcattttttgtagcaatca

SEQ ID NO: 1864 - DNA, 1199 bp, Homo sapiens
aacggcaggcacctgccccgcctcggggctggggggctattccagcggcttcagctaactttcagagccattcgtttcccaacaaagtctgaggcgttcctctgctgggtacaccaaggggctctgcaaccctcctgggggggggggtgcccagagggcttccggaagtcccaggtttattctttcgggtcacagacagcagaaactaaaaagagggattaccctttctgtccagtcgcaagatggcgaccgagcctggtgggactccgaggggccgcaggccacctcctcttcccaatggcccgtgcgccggcggcgacggcaagcgggagggaggcggggccggcgaaggaaggaggggcggagcgcggcgccctcccgcgcgtcttggccccgccccacgtccccgcgtcccggcctggagccctcgcccggccgggcggcgcgcgctgcctgccgggatactcggcccgcccagccagtcctcccgtcttgcgccgcggccgcgagatccgtgtgtctcccaagatggtggcgctgggctcggggtgactacaggagacgacggggccttttcccttcgccaggacccgacacaccaggcttcgctcgctcgcgcacccctccgccgcgtagccatccgccagcgcgggcgcccgccatccgccgcctacttacgcttcacctctgccgacccggcgcgctcggctgcgggcggcggcgcctccttcggctcctcctcggaatagctcgcggcctgtagcccctggcaggagggcccctcagccccccggtgtggacaggcagcggcggctggcgacgaacgccgggatttcggcggccccggcgctccctttcccggcctcgttttccggataaggaagcgcgggtcccgcatgagccccggcggtggcggcagcgaaagagaacgaggcggtggcgggcggaggcggcgggcgagggcgactacgaccagtgaggcggccgccgcagcccaggcgcgggggcgacgacaggtcagtgttgccgcggcctgcgccaggcggcgctggctcccctccgtcactcggccggccttcggggcccgctgtggcgaggtcgacaccccccttccccgccccccgccgccgaggcgagtgtttgggggcgcgtggtccgaaggggctggtgccagaagtaggcccctggtggccgcggct

SEQ ID NO: 1865 - DNA, 1198 bp, Homo sapiens
agatactccattaacctcatctcctacagagaatatttaattaaaaaagaaaaggcaacattccagatcttctcattcggtagttatttgctagagtttcttcagtgaggcacccaaaagcttgtcttgtgttagacagatttgtgcttctttcacttaattctgaagcatcaatagaactggcgacttcctgaccgaccatcatgactagacccgggggcagtgaacatattgtgggtgcctctgagtaacttgtgtttttttcttgttaagtaggtttttaaaatgcgtgtgtgtgtgcgtgtgtgcatgtgcactgtgacacacagaaaagcacacaaaaaataaatataccttatgagatgtttgttgaaatatctcataaagaacacgtgtaacatgatcatgtagattcatgaatagaatatttccaggaaccccagagctccctccttttgaaagatggctaaatgagttttctcattgctcctgtagaagacgagaatatgccatcccaaaatatgtctctttagcataaggattattttgacctggttattttgtgaaactgcagacacaggagaaactctgaaaataaaagtcgaagtgacccttttgtaaggggaaatttacatttgtagagaaaatctccatttgcttggatgtctccttttctgtaccaggaagagaaagaggactctaaatcaccagactcttatcaatgaagaggcagccgctgaaatctgcatagcaaacctgactcttgggtaccctgcttttcctaggcacttggccatgactggccttccccacacccttctttctctgtttttagcttaagatggtatttaagaccaaatactaagacatctctttgagatttactcatttttccctaggtatctcccatgtatatttgatgtatttatgttgatacagtcagtgctgcataactagatttcagacaataccatattgcctagggtgaagtaggctgtaccatctagacttgcgtaagtccactctatgatgttcatgcaaggaggaaatcacctaatgatgcatttctcagcatgtaaccttattgttgcatgacacgtggctgtatagtcgtttgtttttctctggttagtctatcttttgttacaatggatcccagctaagaactatttagagctaagttattttcctccccgac

SEQ ID NO: 1866 - DNA, 1198 bp, Homo sapiens; identical to SEQ ID NO: 1865

SEQ ID NO: 1867 - DNA, 1113 bp, Homo sapiens
gaataatttacaagcttttaggaaacatttgtgtactagatataaaattttaaaaatttagagctgggtgtggtagtgcatgcctgtagatctaactactcaggaggctgaggcaggaggatcacttgagcccaggggttcgagtccaatctgggcaacatggtgagacccccgtctgttaaaaaaaaaaatctttaaattaaattatgactttagtgttcatacacccaaaatttctaggtactctgtagtgcagggtataaaacttgacataaaaaccctgtccctccagtcacatgatacagaaagagcgcaaggacaagggttaacaggcttctgtttgagaaaattattatgggtaaaagatgtgtagatgagaatagcatcatggagcagttagtttgtttacaaagaaaaattttagtagtgaaaatgaaaatttctcaatccttcttcaaggtccagagctaatgggtgttggttccttgctgaagaagtacacagccctcctgtgcacgcacattggagatatactgcctgtggccgccagcattgcttctaccagctggcggcacttcgcggaggtggcttacattgtggaaggggactttactggtaccttttgtttcctgcttgtgtacatgtttattttaggagatagatgaaagctaaagtgtcttctttgctgatcagcatgcctgcatttactctctaaattttctgggcctcctgccctttcacctttgttttttttttttagttactgacagttctgttgttaagccagctggtatgggactcatatcactttaaatgtaattggtaatttagatttatacttccattattgacatttcaataatgaggtcaaaggtaattgtctaattttattttgacagcataataaaaattaggtacctatttaaggatcttaaaaattctgatattacctggtatgttttaactttttgaggttagagcattattttttagtgttttttccctgatgataaacatatcaataaacatttaattttctgaatagaagactcttagttcatagttctgtgattgaaatacagtgttttggaaaatatttttgtaatttaaagg

SEQ ID NO: 1868 - DNA, 1143 bp, Homo sapiens
aatagaatattttgctaagtgtttaaatagaaacaatgttttaaatatcagttatatctaactgagagaacaatagatttcttcttaggaaaccttcctcactgaagagtgtgctatgcattgttaaatctcggatgggagaatatgatctaatagttaattaaaagcaccttgtttctttctgactgaaaatctgaatgaggaggagaaaaaaaaacagatcctttttgtatcctagtattatgatctttgtagactgtgggtcctaacgaattgtagctgacaaaatacagcagttttaataacacacccaaagcaaatgaattgtgcttaatattaaagcaaagcagattatcctcaagaagttaatgttaaaagctgtctgacctgaatggcctaggaaatatctttcttgcagcggaagtcataggcttgaagctgcatctgcatccctcttcccttgtagggaagaaggtgattgatgtggctgcaggctccacccactgcctggctctgactgaggacagcgaggtccacagctgggggagcaacgaccagtgccagcactttgacaccttgcgcgtgaccaagccagaacctgcagcattgccaggactggacaccaaacacatagtgggaattgcctgtgggcctgcccaggtactgaatatagagcttgatttggtattttggaggattttggtttccagttgttcattaccagtatgtagaaaataccactgagttttgtttgttgttcttgtgtcctgcagttgtgctaaactcatttattatgagcttcactgtagtttccttgggttttcttcatggacaattaaatgctatctgtatagaggggcagtttcatttcttcctttccagtctgctcgccttttatgtcttttcccggcctgattgccctggccaggacttgcagtgtgaagctgaataggagaggtgacagtgggcaccctgccttgatcctgactgtaggggaaggcagttcagtctttcaccatcaactgtgatgttagctgtgggtatttatgtagatgccttattatcagattaagggagtgtctttaattccccgttttagaagcttctaaaaaatcctgactggatgttaaaatttgttaaatg

SEQ ID NO: 1869 - DNA, 1237 bp, Homo sapiens
gtccatttcactgccgttttccaaagagaacacatccctttgtgaccctaagctaggttagagagccttgcttgacagtgttggatatcagtattgtttttggaagattaatttattagtgtcctttcagagcttgcggttgcctgtgatcttgaagtgaaatacttattcggtgacttttgtctggaatgcttgggctgattatacaagcattctccaggactgttcaaacccacatcatgtatagtgtatagtgaaagcaactaaattatatttgaaaggaacaaaataatattatctttacaacatgtgagaccaaatgggggacaagattggtgtcaggaacaatttggctgagtctgtttctcatttgtatgatacgttttcacccagcctgtattgtggtcactgaatagctatttttcatctggtctgctatattactagctcttctaagcaccagctaatgctattttcccgtgcaaaagaaaaacatggtttagaataaggacactggagctctttattgttgacaatgagcctttatttctcacatctaattagaatgtttcaggaggcgagtggtgagcacggtgtcgggggccgcattagctattgatttatgtgctgttatagaattaattgagtctggacatggagactcattttcttggacatgtagcaggtaatcatgcttctcctgtacatttgaattgctttccagatggtgtgttgtacaggatttatctttaatatgattgactagaagcaaaggacctgagtgtgtttgcatacatgctctgcaatgcaaagcccccagcccccactgtagagatggttaactctctcctggccacaccccccctgggctcatatggggacctgggccttggattgacactgtatgcagcaaagacagcgtcaaagggtcctggataaaggctctgggaggggagaaaaggcctatagtatattctgagggaaacagaataaacagcattacttattatgcaaaaccaggacataatgtgggttcagcaggggaatagttagtgtcttagtcagctcaggctgctatatcaaaaaacaccatagacttggtggctccaacagcagacatttatttctcacagctctggaggctgggaagtctgtgatcaaggtatgggcagattcagtgtctgctgaggtctgtctgctttctggttcataggtggccatcttctttctgtgtcca

SEQ ID NO: 1870 - DNA, 1200 bp, Homo sapiens
gtcctcattatgtcttcttaatgaaagctgctcattttcttcgtgagagcaaacaacctgatcttctgaccatttgtcttggtcacctgggctacccaaactgagtgagaagtcaggaatgagccggtaggttcctggggagaggcgtgtgtcctcgtgagttgccggtgcctcccttgactgcttttcccggagctctgtgtgccctcgttctccttggtgtggatgcgtgttgttctgatgatgagttagcgggggtggggatggcgcactgtttgaacagatgtgccctcacatggctgcgggaggacgtggtgggaggtgctgtggtgaagtggccccacacatggctgggctttgtggggttttgactctgtccttcccaatgttcctccccacagtggctgcctccgggtgatgatggctgtgtgaacgactgccatggcccaccggaagcttgagagcgtggggagcggcatgttggaccatagggtgagaccaggtcctgtccctcacagccaggagcccgagagcgaggacatggagctgcccttggagggctatgtgcccgagggcctggagctggctgccctgcggccagagagccccgcgccagaggaacaggagtgccacaaccacagccccgatggggactccagctctgactacgtgaacaacacctctgaggaggaggactatgacgagggcctccctgaggaggaggagggcatcacctactacatccgctactgccctgaggacgacagctacctagagggcatggactgcaacggggaggagtacctggcccacagtgcacaccctgtggacactgatgagtgccaggaggcggtggaggagtggacggactcggcgggcccgcacccccacggccacgaggctgaaggcagccaggactacccagacggccaactgcccattccggaggatgagccctccgtccttgaggcccatgaccaggaagaagatggtcactactgtgccagcaaagagggctaccaggactactaccccgaggaggccaacgggaacaccggcgcctccccctaccgcctgaggcgtggggatggggacctggaggaccaggaggaggacattgaccagatcgtggcagagatcaagatgagtctgagcatgaccagcatcaccagcgccagtgaggccagccccgagcatggg

SEQ ID NO: 1871 - DNA, 1149 bp, Homo sapiens
gaagccaggaagcggccctggtgctgtggtgcgacctccaaaggcaccagaagacttttctcaaaactggaaggtgctgcaagagtggctgctgaaacaaaaatctcaggccccagaaaagccttttgtcatctctcagatgggttccaaaaagaagcccaaaattatccagcaaaacaaaaaagagatctcgcctcaagtgaagggagaggaaatgctggcgggaaaagaccaagaggccagcaggggctctgttccttcaggctccaagatggacaggaaggcgccagtacctcgcaccaaggccggcggagcagagcacaataagaaaggaaccaaggaaaggacaaatggtgatattgttccagaatgaggggacatcaagcataagaagcagaaagctaaggaggcagaccctgccccacccaccgaggaagacatgtggtttgacgacgtggacccggcggatatcgaagctgccataggtccagaggtggccaagatagcgaggaaacagttgagtcacagtgagggcagcgtcagcctcagactcgtggaagagccggccttcggcggcctgacaagagccttagccttggactgtgagatggtgggcgtgagtcctaaaggggaggagagcgtggccgcccgtgtatccatcatgaaccagtaggggaagtgcgtttatgacaagtagtcaaaccaaccgagcccgtgacggactataggacagcggtcagtgggattcagcctgagaacctcaagcagggagaagagcttgaagttgttcagaaggaacaactgtcagaaggaacaacggtactgtcaccgcttatcttcagtgacaccctggggtgaggggctcagcaccttcctctcggggagccacattttcctcctttgtcttaggggacataacaagctctgctgggcttgagggacccagaccaggtgtctgcagtcagctcctgagacacggctggccggcacaacaggtgttacatcaggggtttcctgtggccgtttggactttgagcgtttatctaaattaaattggcccagggttggctggtgggtcacccagcagaggcttctccccatagcacgaggatgtgtcgtctgggcacggtgaccgcggttattcctgga

SEQ ID NO: 1872 - DNA, 1177 bp, Homo sapiens
cccttgccttgccttttcacccttaggcaagtcatccgacacgaatccagtagttatacactactgcacagatgttggagttcagtggcatcttctgcttagtgatgtttttgatttttggttaaatctcaccatgacatgcctttcatttttttgcatatgtgtctctttgtgtatttgatatatatcctttctgctgtaataggattcattctgttgtcacattccatgttgtagaaattggtttatatgtctttctgatctccactaaacgtttctccagggtagacaccatgctttactccttataatgtctccagcatttgctgagaaggaccagctctgcctcctcttcttcctcgttctcattccagttcacctggtgtctgacctttcttgttgcttattcttagtgcttgaacctaatgacctgtctttagaggggttggggagtgggcactggtgtggagagaggagggggcctccctctgcccctaggtagagtctgggggttcaagagtgtggtgctcggagggctatggctatgactgaagtgtagggagtagtgagagaggttaaagaggcattaaggggcctgaaggtagacttggattggacttcctgctgaggaatctgaactttgtttagtagacaagagggacctattgaaaggtcataagcagggaagtgatatgaagagattacctaaaactgctgcacattcaggtccttgaagactgaaattcgtatttaaaaaagtatggcataaacaggtaattattctatctagtaggaaaatgtaaggtcagagaggagagtaattaattctgccttgggtttgatgacaggaagctttcacaaatgaggtgatgtttcaactggatactaaagggtagctaggattgcaccatgcagggaagttgggaagatggaattttagacgtgagaagcagcttgagtgaagaatcagaggcaagcatatgcttggcatattgggaaaatcttgaccctgctgatgttgatgtggtgccaggtctgaggagaccaatggcttgagaggagactggataggatgggctgaaagcaggtcaccaaaggtttttggtgccccactatggagtgaagattttatgctctagatagaggggagctgtgagctttaaaaaagcagctaaaa

SEQ ID NO: 1873 - DNA, 1435 bp, Homo sapiens
cattctgggcaacactgtgaaactccgtttctactaaaatacaaaaaattagccgggcatggcggtgtgcgcctgttatcccagctactcgggaggctgagacaggagaatcgcttaaacccgggaggcagaggttgcagtgagccgggatagcgccattgcactcacttttcctttttttttttttttttttttttaaagacagggactcgctttgttgcctaggctgtagtgcggtggtgcggtctcggctcactgcaacctccgcctcctgggctcaaacaatccttctgcctcagcctcccgagtagttgggactacaggcgtgcgccaccatacccggctaatttttggttttggggttttttgtttggttggttggttttgtttgtttgtttgttgtagagacgaggtttcgccatattgcccaggctggtctcaaaccatcctcccgcctcgacctcccaaagtgccaggattacaggcgtgagccaccgcgctcggcctttttaaattttatatttctctatttatttgtacaactttttgagttgaccattgcatcttctattttcatgtttgccctttttcgcgctggccccaccccatttcatcactcctgtactgacatacattctgtgttcctggagcagaaatttgacccgatgggacaacagacctgctcagcccatcctgctcggttctccccagatgacaaatactctcgacaccgaatcaccatcaagaaacgcttcaaggtgctcatgacccagcaaccgcgccctgtcctctgagggtcccttaaactgatgtcttttctgccacctgttacccctcggagactccgtaaccaaactcttcggactgtgagccctgatgcctttttgccagccatactctttggcatccagtctctcgtggcgattgattatgcttgtgtgaggcaatcatggtggcatcacccataaagggaacacatttgacttttttttctcatattttaaattactacaagattattaaagataaaatgatttgaaaaactcttattttgtgagttgttggaggaaaggattggcagtatttttttaaagggagggagatgataaaggagagtaccccagagagttgcaacaataccacttggaagaaaaacttcagtcctgctgttgcaagagtggtcatgtgctgttcatgataggagggtattggggaagaaagattaagactttcacagctgtcagcattcactgaaaaatacctctgttgtcacttaacgtaatttcttgtcccttgaaataagattttgattaaaaatggaagagtacttgtaaaagtaataggcatattacagacagaggtcagtgaattgaaagtcagaagaccagtatttgctttttgtataactttgagaaagttacttaacctgtttagt

SEQ ID NO: 1874 - DNA, 1162 bp, Homo sapiens
caacgccggcgaccagcacggaggcggcggcggcggcggtggcggtggaggaggcggggcggcgggggcggcggcggggagaactaccatgacctgcacaaaacccctgcctccccagttgtccacagcaggggcctgattgacgatgtggtggaagctgaccttgtggaggccttgcaggagtttggacccatcagctatgcggtggtaatgcctaaaaagagacaagcactggtggagtttgaagatgtgttgggggcttgcaacgccgtgagctacgcagccgacaaccaaatatacattgccggtcacccagcttttgtcaactactctaccagccagaagatctccctccccggggactcggatgactcccggagcgtgaacagtgtgcttctctttaccatcctgaaccccatttattcgatcaccacggatgttctttacactatctgtaatccttgtggccctgtccagagaattatcattttcaggaagaatggagttcaggcgatggtggaatttgactctgttcaaagtgcccagcgggccaaggcctctctcaatggggctggtatctattctggctgttgcactctgaagatggaatacgcaaagcctacacgcttgaatgtgttcaagaatgatcaggatacttgggactacacaaaccccaatctcagtggacaaggtgaccctggcagcaaccccaacaaacgccagaggcagccccctctcctgggagatcaccccgcagaatatggagggccccacggtgggtaccacagccattaccatgatgagggccacgggcccccccgacctcactacgaagggagaaggatgggtccaccagtcgggggtcactgtcggggcccaagtcgctacggccccccagtatgggcaccccccaccccctcccccaccacccgagtatggccctcacgccgacagccctgtgctcgtggtctaaggcttgcatcaatctaagatgaactgtgacctagtcttcaatgtcttctgcttgtatggcaatgtggagaaggtgaaattcctgaaaagcaagccgggggcgccatggtggagatggctgatggctacgctgtggaccgggtcattacccacctcaacaacaacttcatgtttgggcagaagctgaatg

SEQ ID NO: 1875 - DNA, 1231 bp, Homo sapiens
caaggattataataagcatacggttgttagaaagcagctttctttggttatctactggtagcactcagggcttcttatgcctcttggattaaaataaagcaggccatattttggtgagacagagccctgttcacagcagctatgctttttcatttcctctgcctttaaggagcatatgttcccatttccaagcatcttctgatgttttgtatcattcaggtatctcctggaatggataatgtataagtgatgaggctacattgccctggtttgcctgtgctcattctcttctcacatatgtggaatatggaaaatgagtcatgaatgcaattcgcatgtctcgtactcttctcataaaacagaaatcttcatggatacgtaatggcaatggtgaacattctttcattctaatttctaattgactctggaagtcaaattcttataaaaattaaatttctcctatgaattccctttattcattaacacaagtcaattacattcacttgtgtgtgtgtgtgtgtgtgtgtgtgtgtgtttctctctcccttacattcttccaatctactcttaagatctgtgtgaattctattctcttaattttcttccttttctatctgaatccctgacattgagatatttcttgtgttttggtcaccttttctcacacaggattgtactagcaaattgtcttgttaaccctttcttgcttctctttatatattcccttttgctgtttccttcccatttgttgctggcagcttgctaaccattaccaccattttaaatttaatcttatagctggtatttcattccaagtgatcataagttaaaaactaaagccaattttttttatttagtaaagaggatttttttttaggattcatcaactcatataaataggaggctattttagtcatctttgataaccagctgcagtattttaagagtactccatattgattaagaaggtattaaaagtgaagtcattggttgtgtgctaatggcaggtatataaagccatattgaactcaacactagattaaaatatttgatgagccctaattacctttcattggtttaatgtgaagtattttttactacttcatatttcttttatttattttttattttagagacaaggcttcactttgtcagccaggctagaatgaagtgggcactcgtagctcactgcaaccttgaactcctggtctcaggcgatcttcccacctct

SEQ ID NO: 1876 - DNA, 1127 bp, Homo sapiens
caagaaagttatttatcttacaaaaggactcactttagcgaacagcaaattcccttcatgattcaacttaggatatttcaatttgcatttacttcagtaaagcacagtctatgttgaattcccttgctgacaggttttatgcttacaataacttagggctaatagtcctaaatgtccaaaagaaagtaatgtctccagagagtgtagttctaggttcttctataacatctttagcattccattcacttaaaatgaaaacagacaatgtgttcaggaacttatgggagagaattaaaagaaagcataaccagtcaaatgccaaaatgctaatttcaatctctgtttctacattgctccagtcacctgacttgttaaagatctcgcctgggatgaggcagctatccatcaatgttcgtagaattgtacaaataccacaacaataaaatgaagataggtttattcattccttgtagtagtatgttcccaggccatttcaaaattggctagttaggttggaaagaagatgaagactttataaaatagtggcttatgcatttcttccttaatttcctgtttgtgctctacactgtatgaaaattttacacctacaaatacctgaactgacaaagtctttcctttagtttctgctaggtcagacttggtgctaaatggaggagagtttgtcagtatagtttcctcagtatccaggtcaaatccaagtttcactcttttttttttttttttgagatggagtctcgcactgtcacccgggctggagtgcagtggcgcaatcgcggctcactgcaaactctgcgtcccaggttcaagcgattctcctgcctcagcctccctggtagctaggattacaggtgcctgccaccatgcccggctaaatttttttttgtatttttagtagacttggggtttcaccatgttggccaggctggtctcgaactcctggcctcaggtgatctgcccacctcagcctcccaaagtgttgggattacaggcgtgagccacagcacctggccaagtttcactcttatatggggagccagagtcctgagttgaatggtgatttctatccacacttttgatctctttgagataattttcattcctcctat

SEQ ID NO: 1877 - DNA, 1165 bp, Homo sapiens
tggcagggagtttcaggaagaccaattaccattcagtgttaagaactttctaatagctgttcaacaatagggtggccttgtagaagatagtaattccctgtcactggaggtgtgtcagcagatgtcagaaaggttgtaaaggggattcctgcattgtgtagaaagttggatcaggtcacccctaaggtcctttccaattatgaaaatctgtggttggctactggagacctatgggggcttgctgctgttaagtcagccctggtctccccagcatttgggagggagagctggtgagttcttctttctcctccctagataataatgacaaacacctgatcacctaccagtcagtggtcagaggcagagccctccaacagttcttatcttagctcaaccctgagggacagactcttgggttggaagatcacaaaaaggtcgctcttgtgctgttttatgttctctgaacgtgtaccttgagacaaggacctgtatgtaggtggctgattttagggggtgagcaggagtgagggagggaggagaatgagacagctccctgtgttgagtaggtccactgtgggtagttagggctgtcgccctgggatcactctgaggagacataaagattatggcttaggctaagcgcggtggcctgtaatcccaacactgtgggaggctgaggcgggtggatcacctgaggtcaggagttcgagaccagcctggccaacatggcaaaaccatgtctctactaaaaatacaaaaattagccgggttggtggtgtgtgcccatagtcccagctacttgggaggatgagacaggagaattgcttgaacccgggaggcggaggttgcagtgagccgagatggagccactgcactccagcctgggtgacagagcgagactccgtctcaaaaaaaaaaaaaaaaatattacagctcagaattttgccactgactgacggggcacatctgggctgcagttccaccagtgcccatccttcattggttgaggtttgctctttggaggtattaagcccctgccactttcaggcagccctgcaggggctaagaaaagcctcacgcagaggagagaggagggaaactgagcatgtaccagaagcatccgctgcagctgcggctggtcacagaaatgggctggagggatgtg

SEQ ID NO: 1878 - DNA, 1223 bp, Homo sapiens
gtggcaagtgtctctgactgataaggcaaaaacgagcagggacttctcacatttgccttaactgtcacagggcctcagctggttgtctgctctttccttcctggatcattttcccagcccttagttcccataggaaactttctctcaaataatgatttctgctgggcatggtggctcatgcctgtaatcccagcactttgggaggccgaggtgggcggatcacttgaggccaggggtttgagaccagtctgggcaacatggcaaaaccccgtctctactaaaaatacaaaaaaattaggtgggagaattgcttgaccccaggaggtggaggtttgagtgagccaagatcgaaccactgcactccagtctgggtgacagagcgggaccctgtctcaaaaaaaaaaaaaaaaaagaaaaaaagtctgcccttaagaggtatgaatgattgtgatttggtgctttggacaatgccatgtagagtgcttctttgggggtgagggatagacagaccctaggggctctgagctgaataatcctcttgttgtcccttacatttctctgccagttacacaacagccaatgcggagtctgacaatgagcgggactctgacaaagaaagtgaggacggggaagatgaagtgagctgtgagactgtgaagatggggagaaaggattctcttgacttggaggaagaggcagcttcaggtgcctccagtgccctggaggctggaggttcctcaggcttggaggatgtgctgcccctcctgcagcaggccgacgagctgcacaggggtgatgagcaaggcaagcgggagggcttccagctgctgctcaacaacaagctggtggtgaggctccagctgcctgtctccttctccttccctccctccctccatctctctgttcctgacccctggggaatgaaggcccgtgtggttactgcccctacaaggtgacatgggacgagaaatggtgagacagctggttttgcatctgtcccccaggtcacatatcctcttccaaggaggcccagcgtggatcctagggccagtgtactgcttgccccagagctgcctcccctcttgggagggggagtgtagttctctgctttctgtagagctactgcagaaagagctctacctctcacctctagggggaaatgtggaaagaactgtattttttttttctcctcatttcccttgaggcagagtccaagctgccag

SEQ ID NO: 1879 - DNA, 1177 bp, Homo sapiens
gggctagtaagggagattgtatacctgttgtccacagtcttcaggcagctccccaggtctctgaaccccagagtgtcatcattggagagagcagtgactgcgagagatggtggaggccgctaagcatggtagaggctagaggaagtctatccacaggcagttgtgttcccagcaattcctcccatcctgcatggttcacaccaagagaaccttcagatcctaccagcaaccgtagcaccttccacccaggggactcccagaagccagtagagagaccaggagccacctcaatcagcaggacagcctcactgcccctcttgcagagtcccctttgcccatcctgaatgcacagtctccctgctcatgcccttcagtcccctgcttggctgtatgcactgtctatattgcactgagagaggaagggacagcaggagtgaggtgaagagggcggagagagggggcaggctcggcaccggccctcccagcccggccagcctgagcttgctgccctccagtagagacagaggggcagtgtttgcatgggaggtgtttctgcctgtccctgcctgatgtccctggtggagcaggtacctccgggcgggcaagcctctgatttgcacacctgaaaatcgcggaattgagtttcgatagattgatttttaaaacttttttggagtagggggtataggggaatcatttaatttaaatcattaagattcccctgctcaaacccagattcctgtgtacagatgctatttagagggaatcagaaaaatgccaagccttttctctttgaatgtgctatttttataactgaacttgtacatatgtataaagagagacacatcttccttttactaactggataaaaaaatcttaaataaaatggagtgagataattttatgtaaattgaggtgtctgtggtctttgcagctgcccctccttggaggcaaactagagcccttggtggatgtggcaggatacagggaaagcagagccctcgcctgtgatcagagaggacaggggttggtgggacaaggagtggactgtgggtgtttccttagtagcagaattgattgggcttatgaatttgcctctggccatcagaaaggaagcttgaccaactgtctgacatgcagtggtcaacgcccttgtctccatggtgggctctttatg

SEQ ID NO: 1880 - DNA, 1148 bp, Homo sapiens
gaggctgtctgggatacagctgacttagaaagcaggatttactctaagtatattggacatttttgccctcttttggacctcataagtacattgcttacatacttacaacatgacattgtatgattctgaatatattaatatcttgatcctgggctcctggccaaagaagcctctcaaaacactgaaaaatatttcactaagaacagtgtcttgcaaacctcttaagcattcaatcctagacctggaagggtatcatcaaaatgaaaattgaaaaatagatgaaagtttataactggaaaaagttgttttgtttttaaactataagagtgcctagaaatgaatcccaggcagaaaaaccatttttcctgtttctctgttctttcatgctgagattctagcttttggcttttcatctcgagactatgagcccagagtctttatgtataattccaatataagttctgcttttttacaaaataaataaataaataaaaatttttaaatcaaaacggttatctgtgagtataaaaattggtctgtatgaggtttttttgttgtttttttttgtttctttttttcgttttgttttgtttttttttttttttgagacagagtctcactctgtcacccaggctggagtgcagtggtgcaatctcagctcactgtaacctccacctcttggattcaagtgattctcccacctcagcctccagagtagcagagattacaggcaggcaccaccatgcccagctaatttttgtatttttagtagagacggggtttcaccatgttggccaggccagtctcgaactcctgacctcaggtgattcacccacctcggcctcccaaactgctgggattacaggtgtgagccaccgcgctttagtcttactagagaagactaaatatgctttacttatctaagagtatgcatgctgttcaagacatatagaactggtcatatttctatagtctagacttactttttaaactttttatagaagtatagctgctattaattttgcaggtctgcgacacacatcctacatgggagatgtttgctctgacccacgatctgctgggatactgccatgtcaagtcatagaagggagagagacccaattttcatccacctgctttgtattcct

SEQ ID NO: 1881 - DNA, 1262 bp, Homo sapiens
ttaattgactcacagttctgcagggctggggaggccttaggtaacttataaaatcatggcagaaggggaagtaaacacatcctccttcacatggtggcaggaaagagaatgagagccgaatgaaggggtaatctccttataaaaccatcagatcttgtgagaactcactgtcactagaacagtatgggggaaaccacacccatggttcagttaacttcacctggtccctcccttgacacatggggattactacaattcaagatgagattttgggtggggagacagccaaaccatatcaggacccttcagtggtttcccattacaattcgaataaagtccaggctgggctaggtggctcatgcttttaatcccagcactttgggaggctgagatgggcagatcacttgaggtcaggagtttgagaccagcctggtctacatggtgaaatcttgtgtctactaaaaatacaaaaaattagcagcaggtggtggcacacgcctgtagtcccagctcctcaggaggctgaggcaggagaatcgcttgaacctgagaagtggaagttgcagtgagccaagatcgcgccactgtactccaccctgggtgacagagtaagactccatctcaagaaaaaaaaaaaaaaaaaaaaagaataaagtccaaactcctgcacatggcctatgggcctacaatatcggacccctgtcttcatcttccatctctcctcctgtcttcatcttccatctctcctcctacctccttcctccacaccagccccttttctgtcagatttaacaacctcatttccatctcagagctttgcacttagtgttgctctgctgtaatgctctgcccccatgtcttcacctgctttctctttcctgtcattcacctctcggctcaaaagttgcctcagagaggcctttcctgattcctgtaactaaagttggaccctctaatccagttatttcaacaccaccatcctataactttcttcatagaacttatcactaactaaaattactttgttcattcattcatctgtttattgtcactctactgccttccctggaacataaattatataaattctttttttttttttttttaagatggagtctcactcttactgcccaggctggagtgcagtggtgtgattccagcttacggcaacctttgccttccaggttcaagagatcctcctgctgggactacaggcgtgtaccacaacgcccggctaatttttgtatttttaggagagatgg

SEQ ID NO: 1882 - DNA, 1380 bp, Homo sapiens
tatcttttattttggaagaattagtggtgaattctttatattgaaagtgagtttttcaattttaaagttggaaaatcatctggcaacatcatgactatactaaaaaccaatgaattgtatactctaaaattgctgcaatattatgttttatgttatgtgaatttaatctcaaaacatacaggaaaatatcagctggcagtttaatggccctttccggtttgtgttgcaattcttagttgtgatggatgtgtgttcgctttacagggttgttaatcaccgtgtggatttttagagtttttgagtgtttttgaggaatggctcaggaaatctgatgtgttacttggattcctaacatctttttttttttttctcttcaagtcttgttaatggatcattttgtacttttaaaatccctttctcctctctctctccagtcttattgccagcagttttgaagatgactcccgtgtagcctcaccgttagaccagaacggaagcttcaatgttgttattaaagaggaacctctagatgattatgactacgaacttggtgagtgcccagaaggggtcactgtgaaacaggaagagacagatgaagagacggatgtatactcaaacagtgatgatgatcctatactagagaaacagctaaagaggcacaataaagttgacaacccagaagctgaccatctatcttctaaatggcttccaagcagcccatcaggtgttgctaaagctaaaatgttcaaattagacactggaaagatgccagtagtctatctggagccctgtgctgtcaccagaagcacagttaagatttctgaactccccgataacatgctttccacatctcgaaaggataaatcttctatgttggcagaattggaatatttgcctacatacattgaaaattccaatgagactgccttctgcttaggcaaggaatcagaaaatggtcttagaaaacattcaccagatctcagagtggtacaaaaatatcccttactgaaagagcctcagtggaaatatcctgatatatctgacagcattagcacagaaagaatactcgacgattcaaaggattcagttggagactcactttcaggaaaagaggacttgggcagaaagagaacaactatgcttaagattgcaacagccgcaaaggtagtgaatgctaatcagaatgcctctccaaatgtccctggaaaaagaggaaggccacgaaaattgaaactctgtaaggcaggacgaccacctaagaacacaggaaagtctttaatttctacaaagaatacacctgtaagccctgggagtacctttccagatgtgaagcctgatctggaagatgtggatggtgttctctttgtttcctttgaatca

SEQ ID NO: 1883 - DNA, 1270 bp, Homo sapiens
agtttagaagattcactatcttgtagctcaatattcttggccatttttagtgtttttatggagattcataaatctgtcctagatttctttaagcattttatgttttcttatttctaggtggaaattcagaaagttcactgaaaaatcgttctgctttctgtagtgataagctagatgaatacttggaaaatgaaggcaagctgatggaaacaagcatgggtttttcttctaatgctcccacatctcctgtggtgtaccagcttcccactaagagtaccagttatgtacgaacacttgatagtgtactaaagaagcaatctactatttccccttctacctcttattctttgaaacctcattctgtaccccctgtctctcgaaaggcaaagtctcaaaacagacaggcaactttcagtggccgaactaaatcatcttataaatccattttaccataccctgtttcaccaaagcagaaatactctcatgtgattctaggagataaggttaccaagaattcttcaggcatcatctcagaaaatcaggcgaataactttgttgtgccaactttggatgaaaatatatttccaaagcagattagtttgcggcaggcacagcagcagcagcaacagcaacagggaagtcgccctccaggcttgtctaaatctcaggtgaagctaatggacctggaagactgtgcactttgggaaggaaaaccaaggacatacatcacagaagagcgagcagatgtatccttaacaactctacttacagctcaagtaagtagctgctgttttctggaggtatattagtgcttggctagaaagagcgaggttagtgaggggaaatgggaatggtactttttggcagggtgatcagctagtttttagcatttagaaccttcatgggaactaaggctatgtcttccccatttgttctttaccaactagatactcaggtgtagatttctcctgccatcagagagagagagtacaattgcacttttgaataacctctctctcctgtataaaggcaactgaccattctgaaaatctctgatttcattttccaacatatgggcaagtacattggctgatcttgttaaaacaactttgaaaattgtgcttttattttttattttttgagatggagtctcgctctgttgcccaggctggagtgcagtggcaggatctcagctcactgcaacctccgcctcctgggttcaagctattctcctgcctcagcctttcgagtagctgggactataggcaca

SEQ ID NO: 1884 - DNA, 1198 bp, Homo sapiens
ggcatcaagtattagggcactaataaacaacttagtacagggatagacaagcgttgggccaaatctggccatgcctattcatttccctatttgtggctgcttttgtactactatggcagagttgaataattgaaaaagagacctcatggcctgcaaagttgaaaatatttactatctggacctttaccaaaaatgtttgccaatccctgctttagatggttctaaaggaaagatatggtagttaaatatttggaaatcatttacccccttatacatagaagaacacacatgtttagaaataaagattcaaaaaaaaaaaaaaacaagccacctccaggaatttgaaagactttcttgtgggcgaggtgacagatgtattctgtggggtctcagaaggtaagctaggtaggctctgcgaggggaatgttatatacaaggagcaggatttttgaaaaataatagaatgagctgcctgagggactccctgtctttttagctattcagtcaaacgccaaaagataagtgattctagaaaagaccagggattctacaataccatgttagctagatgactcaactgtcccttcccactctaaactgaacagttctgtgtaggatacaaactatagatcatgttaacaaacaggtatattggctgtcaagtctttcaaagtattagagagaaggtagaatcttgtcatgttcagctatagttgcccttagttaagagttgtagcatctgatgaatgagaaggagcccaattgtgaacattcacaacctttcccataggagtcctgcagggaggtcttggaatgaatttgccaggcaatatatatttcacagacaacacagggcagcattcttttattcagcagcaaatatttattgagatctgtctatgggccaggtactattctagatgtttgggatttattaatgaacaaaacagacaaaatgttgttccctgtggaacttatactctagcagtggagcagaggacagagcatagataataaacataatttttaaaatgaggtagcaatggtgacagctattatatagacatcatcaatgtaggagtgtcatgaccaaggtttacttcctagggatctacggacatcctcttcctttggaatgacatgaatgagccttctgtctttagagggccagagcaaaccatgcagaagaatgccattc

SEQ ID NO: 1885 - DNA, 1307 bp, Homo sapiens
attagctgggtgtggtggtatgtgcctgtagtctcagctactcaggaggctgagacaggagaatcacttgaaccctggaggtagaagttgcagtgagccaagatcatactactgcactccagcctgggcgacaagagtgaaactccacctcaaaaaaaaaaaaaaaagagttaatctaggagataatgaatggcctagtactagataatatatggccccacaagctcttgacttctgtccttggggaaagccattttgttaaccacactagtgagatttacatgatgcttaatggagaacagagaagatcttgttgcaaaaggtgtattaaatatttgtgctgtttctgtatgagattgagaagcttttcccacctctcacccctatttcctataaggatatccagagaagccaaactgttctgtgggtttgggaatggtcatttcccgggaaaatgcatctggatcgatgactaaacctggcccttttctctgggctgtagtgaagccgcattttcacgctggctggcagtgtgctgagagcctcgaatgctctgcggcgtagtgcccttctgccctgcctgacgatgtatcgaaaagatgagagtgaaggagactttgtgcagcaggaaacgggtaggtgaggtgttgggcagttgtgggaacttctgagagtattacagagtggtagaatcggtaagaactctgatttggacttcgctttggtggaactgtgtgcctatacctgcctgtgtgtgtgcaagtgtgcaggttcctttgtatgtatgtgtacgtgtgggaacctgtgtttgtcatatttttcttcatttcacaaaggctttttttgaagcagtggcagtatgcctttgtttcaagaacacatgaaattcttttaacaccagattagtgtgttaccccaaatgaacggttctagccctctattaagaaataaagggaccataagcattttggctgcttatggctgtgtgttactacttacaagagtcttgaaaattatacagaactttgccttctttttttaatgtcttccacaatgttgtgactgattataaccctgtttcccctcagagaagagctatggctcagggatctgtgttgactctggcatttagtggctttgtgaaggaaagaaaccattaaatgacctgacaaaaactgactcatgtctttaaagtagttgaagccacttttagaatgttactctcggttgcttttgtctaattctaatggcttaaagccaagaaaaccatagtataaatctttttgtgtacctatgctagtgtttaa

SEQ ID NO: 1886 - DNA, 1196 bp, Homo sapiens
tctagttttcattctcataattatccccagctgacgtttaaaaagaacaaagagtttctggggagtatgtaatgctgctgttatccctggagaaattggactccttcttagtgctgcagggcatatggaagtgagatgttagcaaagctcatcggtgttcttaggataagccctttgggaagttgtcagagactgagctgctcagacagaaaatttaaagtagcttattttctggtatacagggtataaattttcttagtgaaagtgcctgaggcagaagtggctggcaacttttaccttagcaagaaaactaaacaccaaatggctgtatagatcctcccattagtcagaagcacagagagaggttggaggtcaggaagagaccagattgattaaaatggtcactatttgagtagaactgatctgatatatggattggatgtagagtgaatagatgaagctagaaatcaagtagtagagcttagggtcgcagcagagggttaaaggacatgactattagattgaatcgtagacatggagatgaatgatgaactcatctgaagataggattgctgattttttttttttttttttttttttgagacggagtcttgctgtgtcacccaggctggagtgcagtggcgcgatcttagctcactgcaacctcaacctcctgggctcaagtgattctcctgcctaagcctcctgcatagctgggattacaggcatgcaccactgttgggaataatgcttaaaattttaaggaaattgaacacttaaaggatttttagtaaagcaattttacttttgtgcagaggggtgcttctccttggccagttgccatgagaacacatctgaacaaaggggcatgagagcctttatttctgacacaagtcctgctcctgtaccctttctccttccccattggctggggttgggtcgtacattctaaactaatcctggttggctaaacatctgaacctttttggataaggtgggcacataagggagaggggggaaggggtgtctgcaatgagctagagagctagtttttttttaaataaggaaaggaatgtgagctggtactgataacgctggtactgtggcatgtctgggcatgtaataaaggcagaaaggaagaaaaaagagaaaaaggaaaaaaaggggtggggggttactatgaattgaagaataaa

SEQ ID NO: 1887 - DNA, 1206 bp, Homo sapiens
actggggtgggaaatccccaagaggagagaactatagaaggggactctcatatttttgaggtccacacaagtcctgggctcacctccaagctgcacatgtgcagaataggctcaaagaggcatagccaaagttttgagaagtaagcttcatttaaaccatcactcaagtcccaggctaaccccccgaggagtacatgtgctgggcagatcaaaacaccacagcacaggctctgaaaactaacattggaatcaccatccacagaggatgagacagaactggttgaacctgagtttattgccttctaaaacactttaaaactgttcatgtttccagaggtttttaacaggaccagaacctcccaatgtaatattccaaatatacaagataatatccagaattacttgacatacaaagaaccagaaaaatctgaccgattctcaagggaaaaacaaccaaatgccaatcctgagatgttttaaatgttaaacttatcgaagagttttaaagcagctagttagccttaaacataaggtgaaggtaaacactcttgaaagagttgaaagatagaagttatcagaaaaataggaactaaaaaaaccaaccgtatggagataatagaattgaaaaaatactggatgaaacaaaaattaactggatgtgctcaatagtaaactagaaggctgagcacagtggctcaggcctataataacagcactgtgggaggttcaggcaggaagatcacttgaggccaggaattcaagaccagcctgggcaatataataagaccccatctctaaaaaaataaaaaataataataataaaaattagctctgtttggtggtgtgtgcctatagtcctaggtacttgggaggctgaggagaggatcgcttgagcccaggagtttgaagttacagtgagctataatcatgccactgcagtccagcctgggcaacacagcaaggctatgttgtttcaaaaatacatatactagactggagatgaggtaaagtgtccatgaatgtgaaattaggtcagtggaaattattcagtctggagaacagacagaaaagagatgggggacaaaaaaatatatccttaggggtctatgggacaattttttttttcaacctgacatttgtgtcattgaagtcccaaaaggaagggaaaaataatgcagaaaaaatatttgaagaaataattgtttg

SEQ ID NO: 1888 - DNA, 1185 bp, Homo sapiens
gggggctagctccttctctcctccattctcgcttctgggcctcacctcagcccaggttctcttcgcccactcagtcctgacttcacgcttccacctccagctcaggcgccccctgagcccggctacccctacgcaggacgagctcagggccggctcccagcctcactgcgccccatttcccgccccgcccgacccccaggtttcggctcaccccgggacccggccctagcccctgcccccagcccaggaccgggcccagccacgctcgcccagacactcgccgcctcggccccgccccgcgctccggccactcggcggtaacgagttggtcccgcccgcccgacgaaggcgacgcgcagccaatcagcggctgccacacagcggcccaagccgggtttgggggttgggacctccggctgcaggtccgcctgggccagacgcgcgagcgcaagcagcgggttagtggtcgcgcgcccgacctccgcagtcccagccgagccgcgacccttccggccgtccccaccccacctcgccgccatgcgcctccgccgcctagcgctgttcccgggtgtggcgctgcttcttgccgcggcccgcctcgccgctgcctccgacgtgctagaactcacggacgacaacttcgagagtcgcatctccgacacgggctctgcgggcctcatgctcgtcgagttcttcgccccctggtgagtccattctgccgaggcgggggaagaaaggcggggctgggccgggggcgagagcgcggggaactgttgggcctacgcagcgccggggcccttcattcctgtgggcccctgctgcggcgggcacatttctcattcccgggagctggaggcgcctcgccgagagcgggggagtcggtgctgatcggcccaaggaaaacccgaaggctgcgctcacgcagggcctcatccttatctcggtgctcttgtggcacttcctatttgcagagggttttgccaccccttcccccagtccaatatgtagctatatcttttctgcgtgagtcagtattaatgctcctccagtctacagactaggcatcccaaagccttgtagtggaagcggacgtttcaccaaatgcagaagtcctggatccctagggtatttcctttcatcttacctcacgccgcacagccattggtttctagccaaggtcactga

SEQ ID NO: 1889 - DNA, 1196 bp, Homo sapiens
acatagtccttgctacctggtaacacttgtcatcgtgaatccatgcatgaaccgcttgttttgttggccttttagattattgggaattgtgggtagcggtgcagtaactagacctgcctttcccataggccatgtctgtgattggagacagaaggtcccgggagcagaaagccaaacaggagcggtaagtcttcaggggcagccaactttaacagttcttccctccccggtccccagacaaaaataaaaaccattattaagcctttataccgttcttcaaatttatcaccaattcctgcagatctaggcgccacaactttactcttgttagcagaaggcctcctggcaacacctgctgccaagactccaggggaaaggagtattagtgggagtttttattttcaatcaagggtttatcaagatttatttacagggcacttctgggaatgacccttcctgggagtttatggtgttggttgagaatgaggactaatatatttaaatatttttgcagggagaaagaactggcaaaagtcactatcaagaaggaagatctggagctaatagtgagtggtagtgcctaactagtgtatgcggaggggaggctattctgcttaatttgggttgtttcctgaaacaagcggagtcagtatatttggtggcacattaatgcctgggaacctatgtaacatgatttttttctgcagatgactgagatggagatatctcgagcagcagcagaacgcagtttgcgggaacacatgggcaacgtggtagaggcgcttattgccctaaccaactgatgcgtgctttctcaaatatacctactggattaatttatggcaataaaatttttttttgtctttttcagttttatcatcttgggtcaagtagagtgtatactatatcctatgttgtggagaatttatatgttggagactaactgaatttaagtgacccattaaaatctagcacacctgtatgaaaaatcagtgtagaagaatacctcatgtgcagatgctaggtggcaggccagtctcattcatctgactagctctcaacagtattcaaggtacatctggagtctcagcagagttactgtactcaaatggcatgtgtctccaagacagcttatgaatatctaaaaggccagctacctgcctaggagccactatatatatagatagatgtaggtt

SEQ ID NO: 1890 - DNA, 1196 bp, Homo sapiens; identical to SEQ ID NO: 1889

SEQ ID NO: 1891 - DNA, 1219 bp, Homo sapiens
agtgctgaagccttggtcacccaagcgttccctctgcatgatggccgtgctcccagactatccaaaatgcagcagcgcatggaaagagactggctgctgaggtgttattggtttgcaataccctgataaggagatttcattcccttcttgctggcagagttatatagagtaattacataagtactgctgtgacactgggcggaatctcattaaaaactgtataaagaacaattgggttgtgctagagaatattcattttatttcagttgagtataatccctgtaatagaacattagcctgagcataaatactggtgttgctccagctccctgatagaatgtatttgggatgtatatttagtgcagcatttgcttatgtggggcatgacagaaaatcattatgaggcaggtccagattttcccacctggtgaggaagttgctcgctgtgctgagcagatcgttgtttgttttttacccctcctaggagagctacttgttcagcttggatgggacagtctatggcagtttgaccacatggcaactctgaaacacacacacacacacacacacacacacacacacacacacagacacacacacacacacacaacacacacacacacacacatgcacatacagactcgggcccaaaaaaatgtgtccccttagcaggtttagccttccacccaagatgtaagagaggcctggtcaggggagaatttgtcttgtgttgttgttcgttcattttcagaaaagtagcaggcaagtccttgtttaatgtaaggttgtttttggttgatggcatgtgaattgtcccttcagccttgctgagcatcactcatcacaacaaacaagagctatcctaagtagtttgctaatacagcagtttaaggctcaaaagcattaaaggacaataacatctaatacagttataccactgtactgtgcatgacttactttcacacatattatctggtgtgtggggaattcagtaatccattcttaattatccagagcataatctgtttggtatttgaagtctaagagcactatgaattattttctttataaaatatttttcattatagttctagtgttctatagcattatagggcaactacaatcaacagcaatttattatatattttcttttcttttttttttttttgagatggagtctcaccctgtggcccaggctggagtgcagtggcgcgatctt

SEQ ID NO: 1892 - DNA, 1185 bp, Homo sapiens
ggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgtttcactgttttgctgattctaatacatacacaaacatcacacccatgatgtaaatacattttaacactaaaatctgagtaagtttagcactcattttaagttaagctaaactaaaaaaccaaatttttttttttgaaacggagtctcactctgttgcccaggctggagtgcagtggcgcatctcagctcactgcaacttctgtctcccggattcaagcaattctcctgcctcagcctcccaagtagctgggattacaggcacgtgccaccacacctggctaatttttgtatttttggtagagacagggtttcaccatgttggccaggctggtctcaaactcctgacctcaggtgatccacctgccttgacct

SEQ ID NO: 1893 - DNA, 1211 bp, Homo sapiens
gccaaaaagaagaagaaaggtgtggttcctggagggggattaaaagccaccatgaaagatgatctggcagattatggtggttatgatggaggatatgtacaagactatgaagacttcatgtgacattttatcttttcttggtgtcatctttatgttgcccacaatcccttgaacatgtagcacaacttcctttcctttcagttctgccaaatgctacaatcagaagtgcagtatcttttgtgctggttatttaaccccttgacacttaggtgctaatgtgcaaatgagggaacttggatcttgctgccaaggggttaaaattgggaacctaagttgctactaaatcatagttcaaaacctaataatgttgtcgttgttgctatctgatttcatagcagcagtcactaaattggaaacaaaaggttgcaacgtgacaaaaaaaattgtgtagtatttaccagcaccattcagtaatacagccttaaccatacctccttgaactacttcataacttgtcaagaaaagcagtttgcagcaagggcatgtggtgtgcacctagtattaaaattgctttgtcttaaaattgaacatgaggatattaaaaatacattgtgaagaagactgcttatctcagagtgaagatactgcggctgaaaagcactagtttgatataaaattaaaatgaccaaaaccctccaactttgaagctaaagaaggtaaacctttccattattgcattacatgttgtggaatctctcgagtgcaaagactgtctagttatttatcaggctatttctactgatgaactgcttcaggtgggggagggaaacttatttttatttgcctgatttaagtgtctgagaaacaaatctttgttctcttaggctgcaatggaacaactttaccagggttttggcatttcctttcctttcctttataaaacatgctcagcaaactgcaccagttaactacagtttggtaaattgttatgttaacaattatgacatctgcaatgttttataaagcaactaatttaataaaatcactgttgtgaggacttaaattttgtgttacctcccaagagatactttttgagagtatagaacacagctcttgggagtacagttctctacgttctctactaaatcttaataaatgcttgacatagttacagctttaaaacatgagtgatttgccaggtccttatgttg

SEQ ID NO: 1894 - DNA, 1175 bp, Homo sapiens
gtacaagaaaacagacacctatgaaatcatctaacctgctagcatgtcctttagacagcaacctgtctgagggtccttcagaagcacatttacaatttcataaaacttgtgttcgtatgccaacttgtaatacaggtaaacatcttcacaatatgtgagtaatttcttcaggttttccatgaccatgtcagtaggctgatgttgtttatatctagataaagaaacataatgtacaggttaagatactgttttttgttttgttttgtttgagacagtcttactctgttgcccaggctggagtgcagaggagcagtcttggctcactgcaacctccacctgctgggttcaagtgattcttgtgcctcagcctcccgagtaggtgggattacatgagtgtgtcaccaccctggctaatttttctaattttagtagagacagcgttctgctatgttggctaggctggtgttgaactccgggcctcaagttacctgcctgccttggcctcccaaagtgctgggattacaggcgtgagtcactgtggctgcccttttttttctctcttaaataaaagatggaggtctcactgtgttgcccaggctggagtacagtggtttttcagagtgtgaactcctgggctcagctgcttctcttgcagcctcccgagtaactaggactacaagtgtgcaccactgtgcccaccttaggatactgtattttgagtgagggctgtcagctctgaagtaccacttactattacctatagaggagagggtgctggagtctgggttatctcagactagtattaggggtgcttgataaaatatttctttaaaaatgagtatgttaatgcttaccttatagagtaagtttagtactccaaaaggcacctctgatgttttagtgtttttcgtttctttttttgagacaagagtcacactctgttgccaggctggagtatagtggcacgatctcagcttactgcagcctctgtccccaggttcaagtgattctcctgcctcagcctcccgagtagctgggactacaggtgccagctaccacacccagctaatttttgtatttttagtagagacagggtttcaccatgttggcaaggctggtctcaaactcctgacctcaagtgatcctcccgcctcggcctcccatagtgctgggat

SEQ ID NO: 1895 - DNA, 1200 bp, Homo sapiens
tacagatttgagatatgggaaaggtgaagttgaacaaggacaaatatgccatattttcagaaagcagtctgttgctgaggtagaatggaggagagagactctgcattgcaaacaaccctgcagtgttgatcatggggaaaaaagaacccatgcaaacattgttttataaagaaaatagcctcaaatataaccctgcctccatcctcatacaagtctcttgcaaatagctgattcaggaagaactcacctcattcaaaggtgtttaaagaaatacaaaataaatagcatctataaaacaacaaaatgggagaaaatgtccaaagcaaagcacagaaagttatggagttagaagatatgaaaaagaaattaatagaaataaagactggagtgagaagcgtcaacatctgtctgataggaatttcagaaaaagaggctacagagaatggttgaaaggcaacattcaaagagaagatggccgtattaggtccagacaggcaagacccaggtttggggagatcaggcatcagcaatagggaacacaggctatgtgagaaactatggagcaaagggctacagactcaatcaaaagcattttcacaacaaaagtgagaatgtagacatggaatgagggcaatataaatagttattaatgagaatggaatttgatcatgaggcaaagaatgtttagccatgttcccctggctagaataaatctgaatataagggaaactaagcccataaggagaggtaaatgtaaacttctaacgaggaatgggcagggttaggaatgaggaacagagcagttctggatactccaattctcaagtggatatatagcagatggaaattgctctggccttcaggatagagttctttgaattccctgatttcaccagtgacttgagtgtcagagcaagttcgtactcctctgagctccagttttcctctcaagaacagaagagtaacctctggacaaactctcagggattttgcctcagaatacatcttctgtctatatttaagttttttatccttcagaggaagatgatatgcaagttgaaaagtagaagctagggacttctagttgcactttgtcctggtcccataaatgtagtggaggtccagatgtgagcagctcttgggcagagcctctatgttattcatttctatgacccaggaagtatgggcatagaaacaaag

SEQ ID NO: 1896 - DNA, 1199 bp, Homo sapiens
gtatgagaggctggaaggaagtgggtgttgggaacatggggagatgcgtttgctgaatttttttctacgtggaacctggttctagggtgtccacaatctccacagaggcggcattgggtcaccgctggaggatgcagcaggagggaggacccgtgaggagcgccccctgtaggaccggaaccctggagggttcgcggcaagggtctccggggcataggaaacgggcatcccccaagggtagtctgagttccgcccagccccattcctggatgctcacgccgtctcccctaaactcccactgcgctcaccgggagcccatctcatcatcaccacagcccgtggctaatgggccaaaacagaagaagaaaagcaactggcggagtacaacgcgcctgcgcattatcagactcagggacaggctggaacctcgccccgtaagtaggccatttaatgacgcgcaaactgggaaggcctatgactgttgaagaggataatcagaagccaacccctacgggtccccggtagctcgccgtgatcgtatagtggttagtactctgcgttgtggccgcagcaacctcggttcgaatccgagtcacggcattgtgggaacaatggcacggcaaggggctcggtatttttttccccttttttgtaacattttatataaatcgtaattcactttcttgaaacgaaccaacgtttctctcctttgaaaactgaggcactccgaggaccgccacctacagtaactctcatgtaatgctctgatacagcttcaacccagccgttataatccctttcttaccaaatatagttgtctgaataattccacaccagcaaaacagctcccctatgaccctgtgatttttttctcttttcatgtacatttttttattgagtcatttatttttatttttacttatttatttatttttgagacagtctcccctgtcgcccaggctggagtgcaatggcgcgatcttggttcactgcagcctccgcctcccgggttcaagcgattatcctgcctcagccaactgagtagctggtactacaggcgtgcaccaccatgctcggataatttttttttgtttgtttttttaattttaaaaaaaattgtttttgagacggaggctctgggtcatttatttttaaatagggaatacatgcacaaaagtctagtaaaaagtacagctctt

SEQ ID NO: 1897 - DNA, 1166 bp, Homo sapiens
tggctgtacgcacggaccgcaaaagaagggacatgaaagtgctttgcaaccaaaggattcctatgaggccgggcctgcaatgatgtgaagcccctgaggacgcccgaatggtggcccaaagtctctctgacgctcaccatgccctgactatcatgctatctgaacgactttggctgggactggagctcttaaattttacaagaaggaaaatcagttctgacccaccaccatacaacttccttgaggcgcgaggtaaggggaaccccaagagcagcctccacggtggagaaatcggccaccgtgtctggtgcgcaggcaagtgtggaccaaaatcgagaaagcagagattaatgctcttgcgtgccctcagatggctgcgagggtggagataggctagaacaaacaatgacaaatcaatgacattgcaagggggcggggctttcaacagagaagagttcaggcgacaagccgaggtcctgtgtccctagtagctcgccgtgatcgtatagtggttagtactctgcgttgtggccgcagcaacctcggttcgaatccgagtcacggcattgtgaggacaatggcacggcaaggggagtttgttttattgtaccaatccgtttttaatcctgagttcacaacattgtggaaaatggaccccgattcccttgtgacatttgagagcgacgtttacgctggctctggctaaattggactttggaaagatataggcttccgggtcctctgagcctgggcgcgttcttgaagacaaagcacagaccactcgccagtttaaaaagtgttgtagtagacatacgtacaaatttccacagaagcactgggagcggattcctaatgataggaaaagaaggcttagcaaaggaagtgaggatcaaggtagctcttaaaggcacagtgagaatttgtcaggcagccaggatgatttcgtgtacagaggcttgaagggagtcttgaaaaggaaaaatctttttttttttttttttttttttttttttttttttttttttgagatggagcctcgctctgtcacccaggctggagtgcagtggcgcgatcttggctcactgcaacctccgcctcctgggttcaagcgattctcctgcctcagcttcccgagtagctgggactacaggcacccgccaccaggc

SEQ ID NO: 1898 - DNA, 1197 bp, Homo sapiens
agcctatctccaccctcgcagccatctgagggcacgcaagagcattaatctctgctttctcgattttggtccacacttgcctgcgcaccagacacggtggccgatttctccaccgtggaggctgctcttggggttccccttacctcgcgcctcaaggaagttgtatggtggtgggtcagaactgattttccttcttgtaaaatttaagagctccagtcccagccaaagtcgttcagatagcatgatagtcagggcatggtgagcgtcagagagactttgggccaccattcgggcgtcctcaggggcttcacatcattgcaggcccggcctcataggaatcctttggttgcaaagcactttcatgtcccttcttttgcggtccgtgcgtacagccaagaggagacttcgggctagggagtccacagcgctcccggctgctcttgcgggtgaacgtgggtgcgggaggaacctggtagataatggacgcttaggaaagctggaatggccgccatctagacgagaagggcaacactgggtcagctgctcgtcgtggcgtcccggtagctcgccgtgatcgtatagtggttagtactctgcgttgtggccgcagcaacctcggttcgaatccgagtcacggcattgtggaaacaatggtacggcaagggcctctttttagacttagaaagccacacattcttctgggaagctaactctaaaagctgttacctggccagggctgaaattataacggacaatgaagtgtgcacaaaaagttcggtgcacactctggggctttcctttctcatctgctagtgaatcagtcacccccaccttccccaatatgtgattattttatttttgtgtagtttctgtgtggtactctttattttacccttgtgaatgaccgaatcatatattggatcctctaaaaaccttcacactagctaaaacatcaatactttgggacaaaggggtgataggaacaatgtgcaaacattaattaagggttagaagaatgcagattagaccatacgctgaaccgttttgcttcagatcccgtgacaagtgaaatatatgactgcactagaggtgctggttccagtagccactatgaggggtgctaatgagaggtttgtggccttcatctccacagtctcctaggtgagagggggttttctcctggagggttttccccta

SEQ ID NO: 1899 - DNA, 1149 bp, Homo sapiens
tcctttcctcattaaggaaaacatggcatgctgtgttggactgggaaataccgttggtagtggtgcttctctctatgggggaaggactgcaaaactgtccatgtttagacactcaggagtgctttgcaggcaagctaagaccttttccaagagaaagggtggtggtggtcaggggaagtaatatttattgaatgcctactaaatgccaggatcaaggtactattaatagtttttttcatttaactatctcagcgttatacctattatgtttgttatcattatctccattttataaatacggaaaatgaggctaacatttttgttcatggatctactgcaagtgaataagagaatacaaatttgaatccagatgtgctagctttgaaatatattctcctccagagtgttgatcttggctcacagatggaaagaaagctgcagaacaaattgttaaaatctggtaattcaggcacaaagacaaaaaccaattttaaatttctattcaaaataccttagatgaagtaaagaaggcaggaaacataatatttcttaggataatcatgtagctagcaagggtatgtgggctcttctttgatgccaagttgacgtgaattctaaactctttaccaagggaatctattaggatatttagggaagctttttcaaaacacttaagcttggaacctgttcctgaaaatcctgattttcccacccaggagaaataattatgctgttgggcagttaactagacattacagaaaagacaaagctttctttagtacagatcaaggtcctgatggagcttgaaggcataaaggtgcaattccaaatacctcaactgctgtagatgaaggggcagcatttgctctagatcctcatcacagcatttcctggtattctttcaggtaggtgaccaaagctcagcctgcagttcctctgaccaggcttccagctcaggtcctgcccatagaggtggtccacctgatgcagctggccaacttctgtctcctaccacaataagctctagtgaacccctgagcccagtagcctcttcatccaagcaagctctcaccagcttgcttctgtgactcacgaaaaggaggaaggaaagaaatggcccaccaaagagagatggtgatggagtccact

SEQ ID NO: 1900 - DNA, 1201 bp, Homo sapiens
aaacaacaacaacaacaacaaaaaaaacaaaaaaaacaaacaaaaatacttaataaagtgaacaattccaaacaaccagaatgtgtgattttcatcattattttggaggtacttaggctgtcgttgttacaaaaatatttggaaatgttgacttgaagtagatgtagtattgttactgaggagcagagaagttgatgcatttatctgtcaagcccagttcctacccaccttcttggtgcaaaaagctgccaaatacctcatatatgtataaggtgggtagtgtttggaaaggaggattgggaggtgccctttaaaagtggtatacacaaagtgcagacctgcagtttttacattccacaactgtgagttcttatcttttctgagacttaaagatttagcatgattgtcaaggcacattggatggataaccagccagaagctcagatgcttgcagatgctgctgtcagtttgcatcatcctttcgcagggggatggcgccctcaccccttctccctcctttctgcaccttggtggtggtggtggggtgggggtgttgggaatctccatgtgaaaggacgtggtgaagactggcagtctgaggttgggcctcagaaggagggcagtagataggactcttaaccaagttatcaaggacctgcggtttttcatttgcgctgtccaaatcccctttctcagtaaatttcagcgttttctcctcccatccttgtgacctggtgtggaagtggagagaggtggtgggtaagacaactaccttggcatgttctggcatcctcagacaggcctgggattgagccccgtctctgccagctacaacttgtagctgtttgacctggtttaagttatttatccccactgagacttactgcatctgtaaatggggcataataatgtatctactgagtagtgttttcaagacttagattaagtaatatattttaaatatcttatgaaaacatacacagaacaaaaactaacaaaaatatactttccactaccttctttttgatttataacaatttattaacaatgactctgacttccttctatatcacactatccttatctataaaaaagggtaaactaaataacttataatgcttgcacactagtaaaggctgaaaattcttccacttccagtgctataaccaagaaataaatgaggttgctatgtatattctaa

SEQ ID NO: 1901 - DNA, 1178 bp, Homo sapiens
ttaggggacacagaataaaccacaaagtgtgatatcacagtaaatattagaactaagaggattctcttactctagtgtgctcattaaacatgatattgcaagcagagctatcaatgaaggaatcttgtgaatgattccttctgtggactttccaatcctgaagtcactgacagatgtcagttttgaaaactgtcagttttggattttattggattcacatcgggttactttgaaatagtgactaaaatgagaagtaataaatttaagttcatagagttgttcatcagatctcactatacaaaagatacccatgactttaacaatctcagctcagttaccattagaatcacgtaaggagtattgctgtggtcctgagaggagaacatatataacatagtgggttgttctttatttgctatggtgcaatacggactcagtaggaaagcaactgaagggtgtcataaatttatgctgcagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatggtatgtctgtcatctgcatttctctctgggccatgcagggtgcagactggccatgatgtaagtaagactgtaggccttaaagacagtaacacaatttaatttaattgtaagtctaattagaatgttcattaaaaattattttatctcaggagcttggtagttattttctttttaattatgtcatgaatcacagatgcccaaggagtagacacaacatcttagggagtctcgttaaataacttcctctggtttctgggcttgttttttccatcatttatcaatatgcacagcatgtagcaattttctacctcaaaatacttgtggagaagcttgtaatgaattgctattgttctatctattaatgagtgtctccaccacagaggccttccgccagatatgtccttatggaagtgggatcatcgtgggacctgatgattcagcagttggtcagttgcctgtgctggattctcagcatttctcagtattctcaatctgcttcttctctagttattcttatttttctccatctatcttggaaaattaagtgctac

SEQ ID NO: 1902 - DNA, 1632 bp, Homo sapiens
ggacccaactttccgctatcttttgggttcattccaaatagttttgtgccattgaaaaacttgaccttcaaaaaaatttgtttttcagaatagaacacaataggacagtgactgcacagttgtgaaaaaggaagagaatcattaaagaaaaagaaaaaagattttaagaccgttgaaatcaattatcaagaacgtcctaaaacacctatggctttgactttgttattgatccagattattttccttgcattggggaaaatatctttcatatttgtttgctgtaaagatggttttgcaagaataagtcatgaccaagacaaactgccaatacaaaagcccactgatactaattatataatgagaaaaaaatgtatccaactaggacacatatcttttgagttatttggactgaaagcttaagaaaacttggaaaattctattttgtgatctagtcaagccacagttatcaaaggctacattttcagtgtaagataaatggatgagtaaactcaaatatgtatcacgtgtgctttgtatcttaagatgtgtttccaagagcatctgaaattttgtttgtacatgtatcttgatcatttataaagccactgtgatctataaatcaagaaaatccattgtcataaccatttttaaaagtcaaaaattaagacatccttaattaaaaagtttcaaatctagacactaaatgtgtgtgaatgtacaaagaaaacaaaccattgcttatgctgttatatactagagaaattttgttttgcttgctgttttaacttgacagatgaaggactttagttgaacttcatattgtaagaactgttaataaaagttgtcaagtaaaaagcgctatatctaaaaagactttatgaacagttattctatcaacttttaaaggttttaaacctgcccagaaattaccttggtatctgaagtttccctctgtctcctcctctaattaagcttgttatttgtcatgcaccagcattggagataataaaatttcttgttctgtgtattttgtttggctaatagtattgcatacatactttctctgtatactactttctattgtatgtgttaaccagtattaagggaaaatgatccagcttcagctatctaattcacaaattaatttctggaaattaaactttgtaaattaagtttttgcctataagaatttgctggtctgggaaaacctgccctatcaatgagtatgttgccgtggttaccttactaagatgctgaagttctaggagagtaatgattacatcagaaggctaggttcagcaaaataagtgtatcagcaggttttatcatgatcagtaaaaatgttccaaatgcttctgctccattatagcagtaaagaacgaatatccaatgcaacaggacaattcagagccttatttattttatggtcatcctgtcttttggggagagagatctgtaaaagataggactgtgacaaggctgatcagaattgctcagacactagctgggttaggagggagagatggtggaagtaaaatgttggtgcttagacttaatcctactgcctcttccactgctttctcaattagcgtgcagctacggtcagatgagtgtggataggtaattaattgc

SEQ ID NO: 1903 - DNA, 1244 bp, Homo sapiens
tactaaaaatacaaaaattagttgggcacagtggcgcgcgcctgtaatcctagctactcgggaggctgaggtaggagaatcacttgaacccaggaggtgtaggttgcagtgagccgagattgtgccactgcactccagcctgggtgacaaagcgagactctgtctcaaaaaataataataataaataaataaataaatattttaggctttgtgggccatatgttgttttttgcatctattcgactctgctattacagcatgaaagcagccacagatagaacataaataaacattatggacattaaaacttgaatctcaaatcggcacatcatgaagtattattcttttaattttttttccaactatttcaaactgtaaaatctcttcttagcttgaagccatacaaaaccaggcatttggccagattaggcctgcgggctatagtttgccaacccttgctctggttgggtgtgagtgcttcacctttttaattcatttatctgaattattcttttagccaataacttaaacttctcatgtgtatctttccaactatatatatatatactttcaattttgccattttttttttgtttttgagactaagtcttgctgtgttgcccaggctggagtgtagtggcgcgatctcagctcactgcaacctccacctcccggattcaagagattttcccacctcagtttcccaagtagctgggattacaggcgcacaccaccatgcccggctaatttttgtatttttagtagaaatggatttcaccatgttggccaggctggtctcgagctcctgacctcagatgatctccctgcctcagcctcctaaagtgctgggatgacaggcgtgagccaccgccccggcctcaattttgccctactttttcaaacttagacactttcaaagttctaaggacagtacaaggagttcccttacatcctgcacctagattcatcaatttattttcatttgttctatcattctcattctctgtgtgtgcatgtgtgtatgcatttgcatgtgcacctacatattatttttattttaaaaactatttccgagttgcttgagagcaagccccttgagattttagttcccttgagagcaaggaccttggctagagttcctgatatgtttctgtcttaagaaaatgtttgctaatcagtgttctgattttatgaatattgttcccttttatatagtagggtacctttgtattctaatgttttag

SEQ ID NO: 1904 - DNA, 1120 bp, Homo sapiens
ttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgctactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaag

SEQ ID NO: 1905 - DNA, 1099 bp, Homo sapiens
tgtcataaatcaggtctttgcagctaagggaacaaggttagcatcaggtatacacatggaagtttagtcttggagaaaaagagaatggagaaagaaagaaatttagagatgaagaaggaagtcaagggcatttatttcagtgcttttaaccagagttagaaataacatagaagggataaggatgtattttagaatggagtagtacagaaatgtcataaaagttactaaaaatggactttacaagaaaatatagactgtctcgatgggatgaatatagaggatttggattaagattggagaaggagcataatttatgcagtcacaaattgggggttggggaagagcctgtgagagaaagtctgaaggaaaggattttttgtttttgtttttaaaattggtccatgtaagagctaggcagattatcaggaaagtgagtttggttttagacacattgaatgagtatcctcctgggatattccagtgtatacagtggatgtatatggtttggaactgggttgagttcacccagaagtagagctctggaagtcatcagtaaacagataaatactaattaatgccttgggagtgtatgagctcatgcaagagagagtgagaagtaaaaagagaaaagcattgaaaacaccaactttggaaacactaacatttgggagacaaggggggaaaaagacgctgaaaagcagaatgtgaaggagtagtcagagaggtaggagaaaaaccgtgagagagtggtgttacagctaatgaaggaagaatggactaatgaggggtagataaatgaattttgtttttaatgtgtggaataaaatgtttctatccatgagatgtccatgattctttttctaccatattccctctcttggggaacatggccatctttatccatcccctactcccacgcaacactgtcccaaagtcctagaatttctgtctccttaatttttttttttttttttttgagatggagccttgctctgtctcccaggctggagtgcagtggcatgatcttggttcactgcaacctctgcctcccaggttcaagcgattctcctgcctcagcctccagagtagctgggattat

SEQ ID NO: 1906 - DNA, 1200 bp, Homo sapiens
gtccctgttttggaggagctaggagcgttgccggcccctgaagtggagcgagagggaggtgcttcgccgtttctcctgccaggggaggtcccggcttcccgtggaggctccggaccaagccccttcagcttctccctccggatcgatgtgctgctgttaacccgtgaggaggcggcggcggcggcagcggcagcggaagatggtgttgctgagagtgttaattctgctcctctcctgggcggcggggatgggaggtgaggcacgactgcgagcgccgggggcgccgcgaccacggcggagcggcggccgggccgagcggagcccagtcgcgcctcgcggcgtgcgcgtcagtcagcccagccggccagcggcgccactctggcgggccgcgctccccgctccctattgtcccccgcgccccgaccgctttcccttcggtggcgggccgaggaggctcccaagcctccggcgaggccttccccgccccccaccgccctggcggccccgggaggcgggggtcgcctcccagagaagcgaagtcggggcatccgcgtcgcctggtgagagcggtggaacccaggctggtggctgcatccctccagtctgctcggcgggcgccggtgcaggcagccgcagcgaggctggcggtctcgccgtcctcgttcagcgctcatcctgctcaccattcctcccccagcccctgcccggtggcggattccgaagtcctctccgccgccgagacccgccgcgcagactcgtgggaagttgtgttgtttgcagctgggctcgtgtattgttctttacccggcgcgccggtcctgaccgaccccattctgcagaggggccgcccgtggagtggcagcagtcatcacccgcttatctgagactagtggcctcggttcttcctgtgtcctgtgtttggagagagatcacaggagggtgtgttggtgttcttgaaaacattctgtcgcccaggggaaagggtttggtcgggagaagggtaaaccatttggggatgttctttgatttgtaggctggattgggtctcttagagtagaagttcggtccctgggtgacccaacttgaagagtttcgttaaactttcaggtggagtagatgtacagtgtagttagtggattgtcaaaacagtgccccctcccccctgcacatgaaagtcaaatttgctaaaagcatgtcatt

SEQ ID NO: 1907 - DNA, 1101 bp, Homo sapiens
ttgtcaaacttccctcccatccctcattattactctgcagacggccctcctaccccttccttattactctacaggcttttctgccctctcattattactccacagatgtccctcctacccctcattattactctgcagacttccctcctacctcctcattattactcctcagacttccctcccgtccctcattattactcctcacacttccctccgacctgctcattattactctgcagacttccctcataccctcatcattactccacaatcttccctcccaccccctcattattaatccacagacttccctctcattttatcaatcagttattactcctcaggtctccttcccattctttcattattacccctcagagctcccctttgcccctccaaaaatgttgctgtaaatattcttatacaagagtttatccagagcagtttctcaacatctgcactactgacatttgcggctgggaattctctgttgtgtgtgtgtgtgtgtgtgtatgggggtgggtgcgggaggctgtcctatgccctgtaggatccctggcctctacccactggataccagtgacactcccttcaccccactgtcataattattaaaaataactccagtgctctaaccctaatccagatcttctagctttaaagttattcttcctatatactatgctgccttaagtcaccattcatacattctttcaaaggtgtgtaagttcaacttgttcctatttagtgagatctttacacttatacctgaaacatttattaaatatgttcataaaaagcatttagcaaaaacaaaaaggaaaacggaaacatggagaacatttctttttttccacttcgcttaaggacaaaccaaagtaaaggctacattcatttccctacaaaacaaacttaagatttctccctcaagaagttgggctggacctcaacagggtggggctggctgttaggtctgtgcacatcattcacacctacaggagcaaggaggaaaagggagggccttcctggggcctgagttctggaaagaacaaccacacccagttttgagctgtgctctcaggagccacagcctgctggcct

SEQ ID NO: 1908 - DNA, 1208 bp, Homo sapiens
tttggaaggatatctgtttattaagagtaaataagccctgtacagaacacaggcgctaggttgagagactcgtcttttgtaggacatttcttcctgctaaccagttcctggagggcttgttttttttgtaactttacacaaggggcactaatggaaaatatagctttctcaagacatctgatgtcagtttcccattgttttgcttcacaaacatcaacaaagtaaacctgaacatgcttagcaatttcccaatgttctttgctgacattacttttgacatactgtgtcaaaattcttaaggtctcccctcctttggtaaagtaggcaaaaccttacaaggaaaacactataatacgtggaaatatactgagttagatttccagtcacctgctctatggctctgagatgcactatatccataatggttcctaggactgtgtccacctgatggtttggagtacggaaaaccaacccttatggcttaagagtcatctcccatggaagacgatgctggccttctgaacgctggggctcatgggcttgttgatgtggctttctggtgtgccaggatcccctggcagctcctgtatacttcagtcaagcagtccagccggggcttggcactctggaagacgggtactacttgggatatcccatgtggttccactggatccttcaataagatgcagaggtagtaaatcaccttctgcatgtaaatagcctcattgatgacaatatccttgaccttgcccatttctatgaaggtagtgctttcttagcctgaagcataagatgaagtcatctgaatgccaagggaatcaatgattaacagtctcctgatcaatcttcacaaaatggagataaccaagcagacctaagagggtgatgaagatggcagcagagaggatcatgctgttctcgcagagggtgaagagtccgtaggctgccagccacaccgtgcaggtgacagcggtgagcgaacgcagcgagagcccagggcagctgaggcagaattcccggcaggaagggaagtagtagcggcgctgcagggccaggcggccaccgcagatatccgaaaagctccgctcatcctccatgacaccccaactctgccgcccgcaccgcaccgcgcggcactccactgcgctcgcctgccctagccgtttcatgcaatatcagaattctaaatacttttagaaactctgcct

SEQ ID NO: 1909 - DNA, 1174 bp, Homo sapiens
ataaagtacacctagaagagggccaaacaagtgcatggtttgacattttgacttggggttttatatgttggcatacttctggggtcttacatctatctcttttcccctgattcttcccttggtgtgggctgtccgcatgtgcactggcctgccagcacttgggaggtgagcatgtacagtgtgtctactggagttgtatgaatgctcacttgaggcattcttcccttacctgttgaatgtcctgggaggtcatataccagctaaactctgccattttgcctctgaatgtgcatgcttgagccccctagaccaactcctgagatcttatcaggaggctgctgatcaccagattcagatgtttctatctattggaagactgcctttccctggcaccagctgagaccaattattattttagagagacagtatgacaactgcctgaccatcacctgatggtttcttgacattcctggtggggtggaggggagccgtttcctgccctgctcatgcctgacgagtgacctactataacacttcaagataggcagaaagtcagggaaagttctaaaaaggttgactagagtaagggagaggatggggagcctgatacactaaaaatcttagagtgctttagtctgagaagatggagaatgaaaggagaaataaccaaagagagactttttaaaatcataagagtagaggtaacataaacataagttttttcacaaaaagctagaatagggagggtgtagagacatgaatagaggggcaatttcaacattacaaatgaatatgtttagaataagaaactgctttccattgtaaattgatgcaaccaatttactcaatctccccattgcatgtctctgtcactttaggtgtaacccattcttctcccaaaatgtggttaaagttacaagcacagtcataggaaataaaaccatatcaaggattgttgtggtatttttctgttgttcttgtcaacaaaatgactcaaactctgtaaaatatttgaagagatttatctgagccatgtataagtgaccaatggcccgtgacacatccctctggagatccttagaacattgcccaaggtggtcaggctataagttggttttatacaatttaaggggacataaaacatcaatcaatgcatgtaaaatgtacattggtt

SEQ ID NO: 1910 - DNA, 9440 bp, Homo sapiens
actggaaccgcttgcctctcagggcgatatctttgagacattaataccgtgatccacaatgagaaaaacatattaattacattgtgaactagtacacacacacacacacacacacacacacacacaaacatttcatgtaaaatatttacccttcacttgtgatgcgtgattgtgtttgctctattatttaaaatacagattacgagccaccacattggtttcatgatctatttatgagccactcctcactatttgaaaaccttgtcctgggcatgaagtagaagcagcctttctgggggaccatggcccagcagtgggggaggaaggaagtgtttccacagtaactgatgttaagctccaggtgttactcattatgacttcagggaggaggagggggagggaaaataatgtaaatacttattatttataatcatacagtatctttatgccacttttagcacatgctcattaatatgctagtacatttagaggcacatctgcctagactggcttagaatataaattctgggatccctcttttgcttggagctgacatcagtgtgtaagagcccaagggtggcattctttcattcaacatatatttactgagtactttctatgtgctagggcctggggataaagcagcaaacaagagaggcgagctccctgcctttctggatcttatatttgagtggtggcatttctcttaagaagctcactgaaatacctgggtcacctcagaccaggcatttatggtggttctcttctaaatgtgttttgaacttggccttttcatctctctaccttgtatgtgccttcacctttcccctcctcctctgcctcacctagtccccatctctctctctgctcattgaaatcctaccatcattttcactccagataagatccaccttctccctcttgaagctcccagactcctgtttgttacagcagtcagtcatatgggccttgctcatttagtgaacatgtaacctcttcctctgccaggcctcttttacgctgtctgatagttattttccaggtatgagcctagtcttaaggagatcaagaccacagtttatgtttttactccatgcacgataccttgcataaaataggtgcccattaagcatgcagatactctcttccacattgtcctgcagaggtgtttgccttctcagtacaccagctaggcacttcccaactctgcaggcacatctcctgctgtcttatatttccaatggggccttcggtttggactcagctgcacttgtttgtgtgacttctgcctctcttgaatccactgatcccctcaattgcacgatcaggcctactctagtcttgagcaactcagaccaaagctggacgtgttgggagacaatatgtgtatgtggtttttacaagcctgctgggaggagtgagacagacctgggccaagacccaggtgtgtgctgtgctagccgtgtgaccttaggtaaattcattaatccctcagttcagctaccatgggctggatccaattaaaagaggacaaatcactgaaattcagccccatcagccacttgttgagctttcctgacgttacctcccatacctgtctggcttcttccttcccttttccctgtctccctgctcccactattcttgtactgccctctggctgccccatccaggcactgaggctggggttgctaccttattcccaccttgccctggtgctctcagagacttcacttttcaccaacccatcattccttgccctcccttccctttactcactttctcctttctgccaaaaaaaaaaatcacatcggagaagcttgtctgcaagggttccattcaacttgctgtacattaatgctccactatggtgacccactgctgagtctttcacttgtaatgtaatctaataatttacatgcactttgcaagcaatactctaaaagactcgcaacctgtttgaaattgctctgctgttacagtatttgagctgatgagagaacagcgtgagaaagagtagtttttggtaccacagtggtattaggtaaacccaggaaaataatgtcagcacaaggtgagggtgtgctgatggattataatatcctttcttagagaatcaattaaacttgcttagggtcttttatcgattttggcttataactggactaggataggtcaaagtattcaaggagtagaggcatagctggctaaaaatagtgaagcaagtatggaatcctgtctttctgagatggctgtgaaatgttttagttttgatatactgcatgacttttacagaattaattggcattgtgattaggttgttttatttcttcactcaaacatgttggaagccgattctaatatgcggtagtaatgaaaatagagtaatgctgtaataatagtgccattgtaaagtgaattacaccattaagcatctattttgtctaatttgtattgtggtagtgtgagtgatacacacacatgcagacgtagaggagctggtctttaagaaatagactctagctgagaagagaaaccccagtcctataatattgaacagtcagtgaacaaaaataattggttctgtgcaaagtgaatttatttatacatatacatatatatacacagccacatatataaatatacacacacatgcacacatacatattgtgtcaggcagatcaagaagatatatgactttggcataaaaaaatgcttggcttatgttgccttttaacaagttgattatgaatggggacacatattaattatgacaagtcaagtcaatgatggcatcaatgccaggctttgaaaacaaggctttctacgtttgtttcaacctcttcatccttattaccatgtctgagaacccctattaactggtatttctcaagttttggaaagaagtattaagggcccaggaatgatcattttattttgtcatttatctcctaaggaaggacatttgtcaaacaattttctttccacagcagaaagatagaggcacatttctatgccttaagtcacacatgaaccctaagagcagaaataggacctgagaaggcagtgtccaacatggctgctcccagtgggacaggtagatttaaaagtacaagaagggccaggcgcggtggctcacacctgtaatcccagcactttgggaggctgaggcgggcggatcacgaggtcatgagttcgagaccatcctggctaacacggtgaaaccccatatctacctaaaatacaaaaaaaaaaaaaaaaaaaaaaaaattagctgggcgtggtggcgggcgcctgtagtcccagctactcgggaggctgaggcaggagaatggcatgaacccaggaggcggagcttacagtgagccgagatcgtgccactgcactccagcctggggacacagcaagactccgtctcaaaaaaaaaaaaaaaaaaaagtccaagaaggtgttaaactttgatgacattccagtgacattatcccttcgcccacaagaggactggcttcaggggatagtttggcagtaattgtccaggagttttcaaccgttagggtggtatgggcagggaggtcctgaaaacttttacctggtccatctccagtctggattgctgcctccaaggccccctctctgcattctgccaccacagcatctagaaggggttatactgatggcctcccatctctcacctgcccccgcttttggattttgcttctgtggcattgccaacaccaccatctggtaatctagaacctcagaaagacttgtccatagagatgagattgtatgtagtttagaatacctttaactttcgtatatataatgcttgctctgatgatcaatatattgaaagcgaatttgcttcataagccactgttcactccctgtctttgaaatcaacaacgtaagttttaaaccccgcaaggatttaaggagatagtagacagtatcaatgcctggcatctgaattaagaatatatttagtggagaagttttaatacaaacctcaatgaaaaagcatcaatatcatattcagcctaataaaatgttttaatgaaaattgtcatggcgtttgacaacatctctttattaattggtcttttccattattattttcttagtagcaaacacactctggttttagctctcattagttatagtcctcattggattcacattttgcgacttcagctgtgtttatcttctcattggtctcagttccttgggagccaggttatagattgtcttcagtgttctgtcccatatctctctgccttttacatgagcattcggtgaatgccctcaggatgctagtgacgtgcagtttagaatcaatatgtgaaagatgagccagctgagggaggactgggatgaagcaagaaaatctattcctcgaaagtttcaaatgtttaagggcagtataatagaatatatcgcctccttgcattgatccatcaaatattcttgtgcacttactatgtgtcaggtcccatgttagtcaatggaacgacaaagctgaattaagtgaattgatgggcaagaaagacattactttaaaaagatgtagcatgctatagtagagatacttaggaaacctataacatagagaagaaggagaaaatgccccgagaggagttagggaaagctcactgaggtggttatgcctgcccgggttttagaaaaatgaggagattcttttggcaaaaagtgacagggcattccaggctgaggcacccaaggggagagttcatggcacattcaggtaacataagtgagatgtagcttggcctgagagtatgctggtgaggagtaggagataaggttggagaaagtaggcaggggcgagcctaagcatttcggaccttgtcttatagcaaaattttgaacaaatgaaaaatacctgatttctttttggtaaggtacttaaatatacttatgtggagttagggagggagacaaggaaccaagttaggagattctgtaataattctggtgactgatattgaaggccaagactggggtgagggttgggagtggaaggcgaagaagagttgactctgcggtaggattccccaggaagtggagttggaagaacatgatggagggaatggcaggagtcaagtgcagagtgtgggccgggattattggctgggacagtgtagtggagtagagtgtgaagaggagagaaggcatgggttcaatttgggatgggctgagttggaagttccagggacatatctgatgggcagcggggaatgggggtctagcagggagcaggtgacaatatgttacatgtggcattaggcaagaaaacaaaaaaatagcaatagcaagtatctggcacttaggagggccaggctagagagctggagtcctaactctgagcagcactcttgatagaggattagaaggtgaatttttacatctatgaggtgatgttcatggattttgaaatgatatcagcagaaaataaatctaaggtctaagtgggtgtggttgggaaattgaagggcttggattggtacgatgacaaagaaaagtctctcacaaaagtggattgggacttggagaccctacatctacataaggtgtaaaaaagtaagaatgggcctggcatggtggctcacgcctgtaatcccagcactttgggaggctgaggtgggtggatcacctgaggtcaggagttcaagaccaccctggccaatatggtgaaaccctttctctactaaaaatacaaaaattagccaggtgtgcacttgtaatcccagctacttgggaggctgaggcaggagaatcacccgaacctgggaggcagaggttgcagggagctgagattgcgccattgcactccagcctgggcgacagagtgagactccgtcccaaaaaataaataagtaaaaataaagtcagaacgtttgtaagcccagagtcaggttttagaccctttgctgtttcgggttgcatttcacttttctctgctttgatggtgctctcccaacatgcctaactgatgattgaagtgttgcagccttttttttttaaaacaaacaaacaaacaaccctttctacacagacagcattgagttgtcctgtctctaaaggcaatctgccccacacttggcagaaccttaagggtgggagaaatggaatgaatagtagctgtggataggtctccttattgccctgggaggaagacttcgtaggagaggaagttgaaagagggtcttgagaaagggggtgagatcttcaaaggctgggtctagccatgggaaactaagtgaaagaatttttttttaagttgatcaggaagagaaaaagaaatgcaccaagtgtttggccaggcggatgctgaccttggttatgactgggtgggattgccattgctgcaagttgatggcacttaacagttttctagggactttcacatacgcagcagcccctggaagtcctggaaggaggttgatgatgttgcagcccatcgagggaccagaaaaatgttgtgtaattatgaagacctgttgccttaaaacaattcggatccaaataggctgactttatcttcaactcaagtagtgtggcgggagggggctctgccctgttggaaaggcatccctctgccctctgtggccatcactgagctccctgttgttttcggtgagctctgactagatgttttccctgtcaatatttcactaatgtgtcatatgaattatttgtgttatctctgtgctgtgaaattagaggccttcacccacagtgtggtaagtagattaaaaggaaagcctgttttttatggtgtgggcgaaactgggaaaatatcagggaaatattttgtgtgtgtttgatctgacagtgggaaggccttgggatgccagtgtcttctaaaacctgaaagctgagctccggctggagttttcttcaaaggggtttatattttatctgttggcacttctgagcggaaggaaggtttggaatgggagattctgtgatgatcctttttttttttttttttttgctgttgttttcttctctgtctttttaactttgcagaaagcccttccagttatacactcagaccctgttcaggacgttggtggccaaacagtccccttttgttaagcgagcgtcccatttttgtttctcttgaaaggtgccctccaggacagcagagcctttctttgggctgtttataattgagccctgaagaaaaacagaaatcattctaaacccaggccaagtgcctccttggcctagctaggcaaagctaaactcacacaagatgaaatctaaccagctggttacctgagaaccaccttcgggagttctccggcttgactgctttcgccttggccaccatctcgagctccagcgacagctgagggtcagggcctctctgtgcagaagagtaggaagagaatcatagctgttggtgaaggttaggttgcattgtttgaaagggtcctatgtcagcttgcaaaatgctatggatctgtaagaatcctgaaagaaatgggttggagaagaaatttatgaccgtaagtctagttgtctttgagtggtgcaatttagccaggaatttttcctctttgcggctcaaggtttcaaaaagttcccttttaaaaaatgcgtgtgtatctatttttttcttagtttacataaaagggtattcatagctttagcccaccttgacatacttctgtcctttctctttttgcctttttctttacacaaattaggagtcatttgagaaaatgaggcatatataggatttgataagttagaggttgtgcagtttcgaattattttattttattctgttataataggtatgggggtaaccttcaggaatcgaaatggaatcttttttccctgttctcaaattatctagtttaggtcttagactcgccttattgcctataagtacagccttcagttttggaatttttctttccattttaggtatcagctgggtcatttagatggaataggaaacagtactgggcattgtcagagaaagactggctataaaagttctgatccctgtgggcagtttggagtcttcttaagtgtaagatcatcagtatacttcaattctgagcttctgcacatgctggttagtgaagctctgcccttccttgttaactgcacattttaacatctatgtttctagaggagacacctgcctcttgagggaaccctcagcatcccgggagcatctgtccaactggcccctgtacacacagagacctgaaaagtgaagcagtttcgagacaggcatcactttaaggctgaagtacattttagaaagttagggactggttctgtggcggggaagttgagctaaatatgcagttctattttaattttcactttatgccaaggcaaaagcattgggagatagactataaatgtataagtaagtcagtgcaagaatagccccttgcaaaatgcagatttagggaggctaaatattttctcacatactttaatgcacatgaataacccctgatcgagttcctgagaaagggatgttgtgtaaccatttgaccttgatcactgtaatgagttatacagaggtctgcacaactgtacaaaagtaaagtatttggctgtcttagttagctcaggctgctataacaaaacaccatcaactgggtggcttaaacaacagacatttattttctcacatttctagaggccccaccttctaataccatcacactgaggattagcgctttaacatgtaaattttatggggacacaaacattcatttcataacataggttgatgcctaaagcatactaataatttacagggtggttggtttgtctctaaaaagttaaaattttttagctttgtcatttgtttgtttcaacagagttgtattttcctatgtgtattttatcttaggcatggtcacctctcttcctattcctgtactgtttgaaatcacagtagtgaaacccaaggtaattaaggctggggtatcattgttttaaattagagtgtgtgaatttttttttttttttgtaattcaacaacaagttccttcatattgtgcataattggatcacattttaattttgtggcaaataaagatctattttacatttctattagaaagacaagcccctgtggcgagctctgaattaggatgttggccattagaagtactgaagcagtgaggcttttagagctgattcagcttctgaaaaactcatctgtgaatctttagggtaaggaaagaaccttcaatttaaagcttataaacagccatggattttacctaaaaacaaatactgagaagacaagaaaacgaaaaatataagtactaacgcaagcagagaataaccaaatcatgggttatccagtatgatatataccacaaaaacattctggtcattgaatcaggcacatctgtttgtgaggatatttt

SEQ ID NO: 1911 - DNA, 1311 bp, Homo sapiens
gaatcttgaggtgggacgttgactctaagatgtccttgagcagtggagcctccggagggaaaggagtggatgcaaacccggttgagacatacgacagtggggatgaatgggacattggagtagggaatctcatcattgacctggacgccgatctggaaaaggaccagcagaaactggaaatgtcaggctcaaaggaggtggggataccggctcccaatgctgtggccacactaccagacaacatcaagtttgtgaccccagtgccaggtcctcaagggaaggaaggcaaatcaaaatccaaaaggagtaagagtggcaaagacactagcaaacccactccagggacttccctgttcactccaagtgagggggcagctagcaagaaagaggtgcaggggcgctcaggagatggtgccaatgctggaggcctggttgctgctattgctcccaagggctcagagaaggcggctaaggcatcccgcagtgtagccggttccaaaaaggagaaggagaacagctcatctaagagcaagaaggagagaagcgaaggagtggggacttgttcagaaaaggatcctggggtcctccagccagttcccttgggaggacggggtggtcagtatgatggaagtgcaggggtggatacaggagctgtggagccacttgggagtatagctattgagcctggggcagcgctcaatcctttgggaactaaaccggagccagaggaaggggagaatgagtgtcgcctgctaaagaaagtcaagtctgaaaaggtaagaggtggccagatatggctgcccactgactgccagtcagaactgccctggactaactgccaaatactatgtgtactctgtgggaggctcattagtgtgtgggtaatgaccaattacaaggtcagagcagctggtaatgataatgtggttttcttccaaattagaggattcccctacagactcatttacagcaggcctggacattgtggaacaggatatttgttgttgggggcagctactttgtagaatgaactttctgtagtctgagttgagaccttcccaccttgtctttgcccacctcagacacttgttggtagagattggcatcagacctttatttgtttcccagcttgactggcatttcatcatcagactcataatagttgataaacaatacgcctttggtgataatgtagattgagtacggttcttgatgggataaatggtgctgttgggtctctggtagaacaaagggctaaatttcatggcatatctacgaagtgttctattgccggctaccaaagagcgaagg

SEQ ID NO: 1912 - DNA, 1193 bp, Homo sapiens
ctgccttagcctcccgagtagctgggactgcagacaggagccaccacacccggcctaaattttaaattgtgcctcattctgagtagcatgatgaaatcttgcaccatcccaccctgtcccacccaggatgtaaactgttagcctttatctagtatatgcatgttgtatgcgctggctgctacaaagttaggcacttcgtagctgtgttggttatcagatcaaaaaaacagtttatgtaaggttaggtactattcgtggtttcaggtacccaccgggggtcttggaatgtatcctccaaggttaagggtaggggggactactgtaattgcctgaatggctcagaagggagagctgttgtggccagagaagctgcttgttatgtaatccacattagtacaagataatcataagatgagctgtaagtatagtgggtgttagatcactgctgggtcttatttaaggtggcaggggtgttagggtaacatttagaagttgagagcaaagagtaaggtttgttttgactttatacaacacttgaagtaaaaagcagtttgttttgttttcaggcataaagatatccatccatgtgtttgttgtgttgtttttgttttttgtggggttttttttttgtcatattcacaagggaaaccagaatctgtatgttcctctggaaaattaggtgaagagaagtataacctatttcagtgtggcttcagtctatggtctgggttttattaaaccagatacgtataagagcatgtcaaatttaaccacctcccttcatccactagattacagtgaatgatagtaatgtcactgatacattgttatacacattgctcactaactgtttttttttttttttctttttagaaacggagtctcgctctgttgcccaggctggagtgcagtggtgcgatctccgctcactgcaagctccacctcccaggttcacgccattctcctgtctcagcctccctagtagctgggactacaggtgcctgccaccacgcctggctaatttttttgtatttttagtagagacggggttttctttttttttctttttttttttttgagacggagtcttgattctcggtctgtcacccaggctggagtgcagtggcgtgatctctgtttactgcaacctctgcctcctgggttcaagcaattctcctgcctcagcctctcga

SEQ ID NO: 1913 - DNA, 1279 bp, Homo sapiens
attatgtatgcacatagactatatacattatttacgagatatacttaaaaatctttaagatgtttctatattttagagacagggcttaaaagtcctgggcaattagctgggcacagtgtcgtgcgcctgtaatcccacctagttgggaggctgaggcagaagaatctcttgaacccgaggtagaggttgcagtgagccgagatcgcgccactgcactccagcctggatgacagagtgagaccctgtctcaaaaaaaaaaaaaaaaaaagtcctgggcagcaaggcctccacttcaccccctaaaggttgccccaagagcaccgtgtgactgctaaggtatttccggagtctaaagacgattattcaggtctcatttgcatacccataatacactgcaaacagtatttttttcggaaaaacatttatatattgcttgacatttttaagtatgagaattttgcatgcagaatttttttgtataaactttctcaggtagtaacccttgggattagtagacaccatcagtgtactaggaattgcagttacccgaaaattgagttacagaagtaactggtatactctggtttctcttcagatcgcataaatctttcgccttttactaaagatttccgtggagaggaacaactctgagtcttaacccaattttttgaggccttgctttggcaaggctatatgtggtaatccaacaatagaaattatttttaagtttgtgtgttcctttttctgttcaatggtgcttttgatattgttgtaaagcagtgactagcagattctgtgtggtaaaagcactgaaccctgtttagttcttttctccctaccttattggtaattatttctgtgtatatatgttccaaagaaatgcggcttgtatattcatgcttttcaactttttgtgatagacagttgatacacaagtagtacctcctccgggatcttcttagtcaagactgtttggtagatgcatgttttttgttacttgtaatgtacagtattcagttcattttctttttgcagcactgtccggttgaaacacaacgcgaggatcgggcgtggtggctcacgcctgtaatcccagcactttgggaggccgaggcaggacaatcaagaccaatcctggtcatcaaggcaggagaatcaagaccatcgaggtcaggagatcaagaccatcctggctaacacagtgaaaccctgtctctactaaaaatacaaaaaaaattagccgggcgtggtggcaggcgcctgtagtcccagctactcg

SEQ ID NO: 1914 - DNA, 1263 bp, Homo sapiens
gaacgcccctgcgcccaccacacagtttaagaaaacggaaattgtcaaactttttaaacccctgtgcgcccttccccaagtcacatctctcgctcctcaccgaagggaggaaccactattctgaattctgtgttaatcattgacttgccaattttttctctttcaatttaatagcagtctttatttaaaagaaatcaaactcagacgtacaaatacacaaaacagataaaacccgagtctctgaccaggaaagcgttattttccagccagccagtcttcggcttcgccccctaacggtgacataaggcactctgtgaaatgctctgttccggaatcaaaagattgatccgattatttgcatacccataatgcactgctcacagtacaaatttaaaaaggcaaaatcaaacatttttattctaagcatattctgtgaaagttagacttttgtttaaacaatactcttaaaatttttttctaggtatagaaccttggcattcactagtcaccatcactatactaggagtttctgttacccgagaaacgagttatgaaattaacaagcatactctggtttctcttcagatcgtataaatctttcgccttttactaaagatttccgtggagaggaacaactctgagtcttaagctaattttttgaggccttgttccgacaaggctatataaagctgttaaaaaatcagattgacttcatttagggtgtttcttacagatatcgtttaagttttcggttctgcttgtaaacgcttcaatcgctcatgcgtttaaactttgtgtaagtgcaagcgttctttttctagtgaagcttcttccaacaagttagaagtatttacttcagtgtcattaatgtgaaagattcttaaaagtgttctggctgggcgcggtggcttatgccggtaatcccactgcattgggtaaaccaaggtgagcggatcacttgaggtcaggagttcgagaccagcctgggccaacgtggtgaaacccacgttgtacattgttttcttagtcttctgaatcctgtgtatattttgcatttagcgcatctcaattaggactagctgcatttcaagcgctcaatcggcacacatggacaatgactaataattgccctgtgcacctctgctaggtgtaaaacgtttgaacagagcacagtgtgtagatccgttctcccttcctgtaggttttggggttttgccagattttggccattggaactccttgaacctgtgcaaggttatattt

SEQ ID NO: 1915 - DNA, 1215 bp, Homo sapiens
ggtggggagtgaggagtagggcttatccccttttgaggcctatccccagtctctccctagattcctcaaagcacagctgaggcacaatcggctcatttaaagatgatgttaggccaagggatgacaggagggaaatacacacaggatattgtgacctaacatggttcaggaggtctggcatcctcatctgcagcccatctcctgaggtcagagccaaagggaccttcggggccacctagttccttctcagccaggttcaggagagaatcctgccctcaggccctaatgtgaccactgcatgtagcagattgacttttctcttgtgcatctaggatgtaccatccttgggagaactgagaaaattgtccattaatcctcttctgggtgctgtggttcaggtgggagaaaccctggctgacagaggcttcctctcagctaacagaggacaatgaagcaccaagcaggcagcctcctacccaaggtcacacagccagcccaagcttgtcttctgagttccaagccagtcgtcttctcttttctcacaatagcattaacatcctcccctccgctgctccaatctcgtgagcatggaggaagctctgatccaaagagatgagcctatccctgtctctctctctctctctctcacacacacacacacacacacacacacacacacacacacacacacacacacacacacccctgagtctgcaggacagagacatcccagaagcttggcattggacaagccggtagtcctgaatttgtgtctaggtcatccacgtgagcctgcatttcgccacctgcaagaggagatcataatgcctacttgatggagttactggaaggactgaaactggccatgtaccaaggctggcacctggcacagtacaaggtcttgggaaccatccatttttcttttgccctggtgctcagtaaggtgcacagtggctgatgagtgaacagcacactcaatgttcaaccgagtctacatctaggttctaatccaacagggaatattcacagagtattcttagtaagggctcgcaagtccccgaatatggcattagtacccaatacccggctgagctcagacttccaggcccgcttcctgccagctgtgcacacccaggcccacagatgcctgctctcccaagcctgccaggctggcctcccaccggcctcactccccacccctattcctttttcttt

SEQ ID NO: 1916 - DNA, 1186 bp, Homo sapiens
cacctcaccacatggtctccactgacactgcagggggcagtttgttactagctggagaaggtgaaagtttcagctcctttcttggtcttctctgataccaccagcgagtgtgttgaggtgccttgtacaaccttgagaagacagaagtctgggcttccctcttggcctttgcttgtgggcccacagttggtgtttggctggagttgaatggctgttatccccaccacccccaagacaggatctcgttctgtctcccaggctgaattgcagtggtgcaattatagctcattgtaacctcaaattcctgggcttgtgtgatcctcccacctcagccttccaagtatcttggactatccaggtacgtgctaccatgcccggctaagtttttaaattttttatagagacagggtcttgctatattgcccaggctgatcgcaaactcctagcctcaagtgatcctcctgcctcagtctcccaaagagctggaactccaggcatgagccactgtgtctgactgagtggctattatctaaaagtttcttgtcttgctaagctgcccctttcttagtcctctggcaagagagagcaggattttgttggtgttttttgtgtatgctcctattggcatttctgggttcctagtgtctttagctccaaatcagggatatatggagcaaaaaaaaaaaaaaaaaaaattcaacccaaggaacacaccaccatgttgttccttggggcttaaagttcctagttgctttggcctcttccctctacctttcacagtcttcttatgtttgttttacatgtaatgtccaggggttttagttgtgcttagcagaaggaatagggaaaaatatgcttactttatctctctggaagtggaaatccttccttaaattttgagtctcattgtctcttgctagaccggtggtcttcccaagtagggaaatgcagaagaggacaagaatgaatgttgatggaggcccctgggtgctgtgtgcttctgcatgtgcaagtttattgagttctcatgacttggtaaggatggtttcattattccctctttacaggtacgaataacctgaggctcagagagagtaggttcaggcaggtaggcgggcctgtactggccttgaacccagtgcacatgccttttctaccacaggtcactcagcagctaaaatctagg

SEQ ID NO: 1917 - DNA, 1144 bp, Homo sapiens
acttggatttcaggctctatattctatggcagtaaaaaaaaaaaaaaaaaaagataaattaaggccaggcgcagtggctcacgcttgtaatcctagcactttgggaggccaagacgggcggatcacttgaggccaggagttcgagaccagcctggccaacatggtgaaaccccatctctactaaaaatacaaaaaattagcctggcgtagtggcacatgcctgtaatcctagttactcgggaggctaaggcagtagaattgcttgaacccggaaggcggaggttgcagtgatccgagattgcgccattacactccagcctgggcaaaaagagtgaaactctgtctcaaaaaaaaaaaaaggagataaattaacatggaccattcagagaattacaagcatgctgaaatatagggtacaaataagagaactgaatctgagatttttgtttgttgtgtcatatatttaatttgtatcttaatagtctccaaatttttttgatcaggtgccacagaagtaaaaatgttttgaccattttatttgttgattaaatacatttacttctatacggatgtgatttgtaatgtacttttttttttttgagacggagtctcactctgttgcctaggctggagtgcagtggtgcgatctcggctcactgcaacctccacctcagttcaagtgattctcctgcctcagcctcccagtagctgggattacaggtgtgcaccaccacacctggctaatttttgtatttttagtagagacagggtttcatcacgttggccaggcttgtctcaaactcctgatttcagttgatccacctgccttggcctcccaaagtgctagagttacaggcgtgagccagtgagccactgtgcccggcctaaatttagtttttgtagtgacaggatctcactatgttgcccaagctggtctgtatctcctggcctcaaacagtctgccttggcctcccaacgtgccgggattacaggtgtgagccactgtgcttggcctccagctgttccttggacatttcaggcacatttttattctaaggcttttgtattgccgtactctgcctggaacactcttcccttgtacccctcaagtccgcatgactgtcttacactcctcaaactgtgc

SEQ ID NO: 1918 - DNA, 1199 bp, Homo sapiens
taaatagataagttaaaatgccttggtagtgggctgggcgtggtggctcatgcctataatcccagcactttgggaggctgaggtgggcagttcacttgaggtcaggagtttgggaacagcctgaccaacatggggaaaccccatctgtactgaaaatacaaaaattagctgagtggggtggtgcacgcctgtaatcccagctactcaggaggctgaggcaggagaattaacttgaatccaggaggtggaggttgcagtgagccgagattgcgtcgttgcaatccagcctgggtgacagagtgagactcttgtctcaaaaaaaacaaagccttggtacatctagaatgttgtatatcaaatttgttgtagaatatgaacttttgaaaactctggtgacccactgatcctatatagcacttgttaataaaaatatatatcaagataaaagtgttcatatacatatacaccattggataaagtggtactgggaaattaggcaaaataatttatgatgaaagtttgcatttcacttggagcgcagctctcggatataggactttagtgagacctttgtgactgttcctggtattgattgcatttgttagttgtacagtgcaaccatagacagtcacacacattaaaacagatggttcctgccgacagggtctgtatagttatcagattttctgtgcgatggctccatacatgtttgtttttgttttttaacttttaacagatgtggaagaaaatacaggttccatgtagaataccctaaagttatttataaactactttcaaacatgtaaaggaatgtgatttaggccgggcgcggtggctcacgcctgtaatcccagcactttgagaggccgaggcgggtggatcacaaggtcaggagatcgagaccatcctggctaacatggtgaaaccccgtctctactaaaaaataataaaaaaaattagccgggtgtggtggcgggcacctgtagtcccagctattcgggaggctgaggcaggagaatggtgtgaacctaggaggtggagcttgcagtgagccgagatcacgccactgcactccagcctgggcgacagcaagactccgtctcaaaaaaaaaaaggaatgtgatttaaataatccgtgatttaaatttcttggtaaaatatggtatgtatggatggcataggattgggtatatgtaaag

SEQ ID NO: 1919 - DNA, 1420 bp, Homo sapiens
ttgaagataaagttgaaggctacaagaagaccaaggaagctgttttgctccttaagaaacttaaagcctggaatgatatcaaaaaggtccgttcaatgagcacatttacagtttggtactccttgttcacagtttgtcactttgaatttcagaagataagggcagtatagctaatccttaatgtgtgagagaacaagaacctcagagcccgattacttgggtttgaatcctaactgctgtttatggctctgtgtaaccttggcaagttattgtgcccagtttaatcatctgtaaaaaggaattaaaactctgaagatctattgcagagattctatcttaatcagaatactaaaactgctcactttgtaggtctatgcctctcagcgaatgagagctggcaaaggcaaaatgagaaaccgtcgccgtatccagcgcaggggcccgtgcatcatctataatgaggataatggtatcatcaaggccttcagaaacatccctggtaattaaactgcttacatatattgactaggtatactctgcaagtctactcagcttttgttatgatgagattccacttaaggtccgtgtttctgaaacaaatgattttgtggaagttctgatttatggctgaaagagttgcaccattgatggttgaaacttcataattaataagttctcaggtaccttttatagctcttaagccataaagatgatttgtgtttcttttgttggaatacaggctccctaatttttctttccctttaaaaggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaagtaagtatctttcatatactaagcacagatgtttatattgtggatattaacattcagaattggcttacatgttttctaaatttattcccatttccccttatgtgcagcaacagtatgccaaaatgagactcacctggtctatatttttggttttttgttttgtttttgagacagagttgttctgtctcacccacgctggagtgtagtggtgtgatcgtggcttactgcagcctccgcctcccgggttcaagcagttctcctgtctcagcctcccaagtacctgggactacaggcttgtgccaccacacccggctaattgtagagttggggttttaccatgttggccaggctggtctggaactcctgaccttaggtgatccacccgcctcggcctccccaagtgctgggattataggggtgagccaccacacccggcctggtccatgtttatgagaagtgatagtgtagtagatattttggagagcatagtggcta

SEQ ID NO: 1920 - DNA, 1420 bp, Homo sapiens; identical to SEQ ID NO: 1919

SEQ ID NO: 1921 - DNA, 1813 bp, Homo sapiens
gagggtgagtgggacagggatggaagttgggatgagtagagcccgggtagacaggatttgctgattaattggcattaaacagcatctccaaaccttacaatatggttttgatttagctattgtgctttataaggcttgctttgaaagttttatgataaacaattctttttgaaaataaaattgtgcagtagaggttgagattctaagggttctagtcatttactgctattttggtttaagggttgtttgcctcaccataccagtctcttctgcaattgagtatttaatggtattgttggcgtatgagaagagtttgcttcaaacattacttgtcaataaaaataatccttgtctttttctttaggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtatggatttatatcttctgcagatattttagggactgctttacagtagtgatgaaattccacttcattggtccgtgtttctgaaccacatgattttctcggatgttctgatgctgtttgctaccatgcataatagtcatgggttggtatgtatgatgaagcagctacaacttttatctcttctcaattttaggtcatcagactagtgctgagtcttggggtactggcagagctgtggctcgaattcccagagttcgaggtggtgggactcaccgctctggccagggtgcttttggaaacgtatcctttgtttcactacctaagactggtcatctctgatggaatttagcggcctgggtctggtttattgatgataatacggtgtaaaaatattacttttttttgtcttgaagagaaggggcttcatttatatggggttattttgcttgcaatgatgtcgtaatttgcgtcttactctgttctcagcgacagttgcctgctgtcagtaagctggtacagaaggttgacgaaaattcttactgagcaagaaataaccttgttgtaattactaaaatttgagaaatgtgattcttgactggaaaaatagatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtttgtaatactttatataagagagtttgatagaagaaataagacacctactatttgatcattagggtgatttttattcacagtaacccatttcaagatggctagaagagaataatttgaatgtttttagcataaaatattttagttcatggatattccagttacactgatttgatcttgacaaatgagtgcattcagttatcaaatgtactccagaaatacatgttacataccggtttaaaaattttttaatcaaaaatatttcgtatcagtgatacaaaatgccccactttttctttcacgtgaacctttgttaaaattgcacattcttttcattctgaagtgtctgattaaattttaatcctttactaaatactaggtctgactacttaaatctgacaaatcaatcagggaatactagcgtaactggggaactattcaagtagtagtttagtatatccttagaaaacttccaacttaaacttgcctgttgcgtacccatcgcatttttatttaactgtcaaaatgatg

SEQ ID NO: 1922 - DNA, 1813 bp, Homo sapiens; identical to SEQ ID NO: 1921

SEQ ID NO: 1923 - DNA, 1813 bp, Homo sapiens; identical to SEQ ID NO: 1921

SEQ ID NO: 1924 - DNA, 1813 bp, Homo sapiens; identical to SEQ ID NO: 1921

SEQ ID NO: 1925 - DNA, 1129 bp, Homo sapiens
tctggcttatttcttttaaatagatctttttaaataatttagatcatctggaatgatggagatgctttatcccacggtctttgcacttaacaaagtacagctaaggatagatagttaatttaaaactcgtgcattccttataaatgaaagataatttatatttatttttaattattttccttggagtcacaacaggttattattctcttcggtttgaattttaattcttatttgtaagaatagtaggtgctgttaatgtctttttgttacttaatatcagatttaaggcaaacaggttaaattacagtactataactatagtataggcaaattattattctagaaagagatttttaaattttcctgatagatataacttctatattaacttagaacttagttttatatccttggctccaccagtgtcttgtttcattaagccaaagtgtgcatttaaaaaaatttttatttttattttagaattgggggtacatgtacaggaagtctaattattccattgccccatagatcgtttttcaatccttgcccccctccctcccactttgaagtctcagtgtctactgttccaatctttttgtccatgtgcactcagtgtttagctcccacttgtgagaacatatcgtgtttggttttctgttcctgccttaattcacttaggataatggcctccagctgcacccatgctgctgtaaaggacatgattttgttcttttttatggctgtgtagtattccatggtgtacatgtaccatgttttctttgtctaatccaccgttgataggcacctgggttgattccccatctttgctattgtgaatggtgcaaagcatgcagaagaaacagggacattattgctccaaaggggtgaacattaattcttgaggggcaaaaaatctttactctttttatctataaggcacaaataaatgtgcaatacataaacacatatacagtgtatctgtagtattaatatttcagtgggatggtgtgtcaaaattagggggaaaatgtcttaaaaggttcctggtggggcggctgtactgaaaatggttgagaaacactgagctgaaggatctggttgcatgtgctaagctctaccctagaggaaa

SEQ ID NO: 1926 - DNA, 1194 bp, Homo sapiens
atggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatggtgagtgtgagggtctgtgtcggcctggccagggctgggggcgtgaacctcaggtggagccctcccctgactgttttcctttctctgctgcaggccaagtttctttcccaagaccaaattaatggtaggttgggtttgttctttgattagcaactcagcaaaatatgggtctcattaggcaatttgctctgctcatgttttcttggtgggaaggaaggtggctgtgggagagctgggcccacccagggccaagagctgcggggaggctgctgttggcggggtgggggttgggggtaagcctccaaaatagacatgtggctttatacttgtcagtgtgacttacaagccagggcgctaagacagaacttactaggtttccctccagaacctgaccagttggatttggggactgaggggactggggatggagagagagaccattaaaggtatggctggcagcagggaaagaggaggggctttgtaattgagacagaacagaggccaggtctgcactctctggcaggatgcgtctactctctgcgcctcagtctccctatctgtaaaatggagggtccactgagccccctttgccctggcatcaagcctggtttgggcgtgagcactttattccctgggtcccctactctgccagccctcgaccaggcttcagtttcacaccgtgcagggttctatttccagaaggccaagagcaaagagttgcgttacaaagaacttgggggcccagacctgagccaggggagcctcatggctgcagcccccctgcacctggcaggagaggcccaggaggcacagccagctgctg

SEQ ID NO: 1927 - DNA, 1099 bp, Homo sapiens
gggtgggccatggagggcatctgaatacaggagtagggggggtgtgggtgtgtaaccagagaccgagagcatgagtggggtgtgcctcgtgtgcgtggattcgtgtgtgtgtgtgtgtgtgtcttgtatatgtgtgcgcagagtgcatcattttcagactctactatttccgtcaagtttctgtttgatttggatcatctcaggatcggattctgttttagagtgtttctgggccaggatccgggcccctgccctcctctgcacctgaccacactccctactcagggctagtctgttcttcccggacatcttctggtagccgtgcaggagagggctgggtggggcagaggccaggaggggacctggtgtgtcacctgcccaccacctggctcatccctcaggcccaccctgaccctacattacataggttacgtcagcctactgtggctgttgagcaaagcatttctcctttctgggcctcatttgcactagatgggcctgtggtcccaaagtaggtcagtaggttggggttgctgacaccccttgggtgcagctttgggacagatgagtggctctgtcctgtcactgccctctccctgcctgggggctatgtgcactccagacccctgcccaggctcaggcccatgaggtatggagacaccctggcccccaggagctggaggcaccgcccactcccctggcattccagctttgcaggtgaccctcctctacccaaagctctgtccccctgctcccactccagaagaactgcggcacgcgcttcgggcagcctagccacaggctttgagcgcctgcattcctgggggctggagggtggggtgccaaaggccctgagcaaaagccagagctcctctcatcaaagcctttacaaggtgctgggcccagaggctttgccttgacagagtggcccagggtttcaagggaggaggaacctccccctacctaggacccttcctgtggggggtctacagagtcagggacagaagggaagggacccacaggaagtcacagtggtgcccagggatgtgtcagcccccagccacggggacgcgggattcaagaatgaagtaaatacagt

SEQ ID NO: 1928 - DNA, 1148 bp, Homo sapiens
agtaggacatgaagaagaggggcagcagcttggtgcccttgcagtgactagtgtttcagtgctgttgcaagaagggattcaagttggggcaattaagaaagagattgtgggagactggagagagctggagcccagattttggtgatccctgtataaagtactaagagtaagactggttaaactgcaatctcaaatgtttccatcatttaagatttcatctccttgattctgtatatcagtttagcttatggattattacaattatgaatttattagctgctatgtaaaaatagtccttattaaatgcttgtgatgggcctagcctgtgtcatgttctggaggaaatgtaaggtacaggaaatctaaggtttctacttttgagaagcttacaaattaattaataaaagagatattgaagttcctggtactctctgtgcattcacaccttctgtgagattattttgcagtttatcccagtcattttaggattttagaaccaaaaaagagtgtgatgatttcactttgcatttgtttcagacattgtgaaaatgttagcctgagtacattaacaatagaaagctgacttgacccttgggggctgacctttgaaaaacacatagccagcacttgagacacatggccatatagggattaacagctgtgtgctgaagtagattagtgtttctaatttttagtcattcacgtgctagcttcataatttttggccaaattgttcactaacctgctgtttacttaataaatatcttttctttaaattgtctgttatttgcttgatagttgtcttcagaatgttttacttcttagcttcatcccatgtaattatgggtttgctgtgtgttttgtgtgtgtgcgtgagaaagacatacattaaaataaatattacaaaagttttaaaaagtctattctacctaaaaccttctataataccttaggaaactaaagtggattcatgatagagcctcgaggggaaagggaccacccacctagattaagccattgatatttgagttcttgttcactttttttttttgagacggagtctcgctctgtcgccggggctggagtgcagtggcgcgatctcggctcactgcaagctctgccttccgggttcatgccattctcctgcc

SEQ ID NO: 1929 - DNA, 2038 bp, Homo sapiens
ataacgatggagaggtagatgacgaggaagatgaagaagagcttggtggtatggcagcctttttactctcagctggtagcagcctggccctttcactttggccttagattgcttagactcagaggcccctggcagtgggcaggacactcctgtcagaggcctcagattccccttccagctgtgcagatgtcttgcctcggtttccaaggatggcacagcttgctagtcatgggtcccctgacttctcactgggtgggttgagttaaagaggtgggattaataactaatctaaatgccgctttcttacttttccagaagaagaaaggggtcagaagcgaaaacgagaacctgaagatgagggagaagatgatgactaagtggaataacctattttgaaaaattcctattgtgatttgactgtttttacccatatcccctctcccccccccctccaatcctgccccctgaaacttatttttttctgattgtaacgttgctgtgggaacgagaggggaagagtgtactgggggttgcggggggagggatggcgggtgggggtggaataaaatactatttttactgccactctttatttttttcccctactttttctttgtgtccggtttttgtccctgtaaatgcgatagctaagtacacactaagtgagcatttgttcctgactctcaaagaggatggtttggagttctcttacgtttcctggtatttcccaagtctcttgggttggttggaaggctgtggctggtctcagtttggttactcaatgcccaggaggggctgagcaccagccatatcttttgctttggttcacatgatgatacctgcttttctcaggcctgctagaggcatccaacgccctggtttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgttttacaaaaaatgatgagagaattcttccacatgtacttctgtgcttagaacatttttacggacctaagcgctggagacgttgctgcatgtcggctgggttttttttttcatacacccgagcacggaaaaactaacgcaaaattgtattttcttacctagtggaaatctgaaatgactgcaaattcctagtgaatgtacaggtttgctttcgtgtccctcttctggttgctttagaagtgacgtgtaatttctgaacccatgtttcatctgtataaaagaacatctgcaccagtttttctcctgcccctcagaagagccaaactttgagttttatgtctgtttgtcattgataaatttcaataaatctttttatacaatttttttggggatggcttctttgagtccaacaggccattgatcttttcaagatgcattccagatgaactgctaggtgagggggaagcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaatgtttataaaacaaattatttcacaaacccagaggtttacatatggtgttttattttgttactttacttaacagtattataatcatttccctgtttctttaattttcaaaagcatgtatcttaaatggctacatagtagtcc

SEQ ID NO: 1930 - DNA, 1147 bp, Homo sapiens
cagctacagcggcaggctctgctgtgatggcaggagtgggtgaaagcaactgggcatgtgggggtcttgtgggggcattggggtggcggggcaaggcccagaagtccctaacaatgctgtggctggtgcatgtgggttttgggagaatgcgagagcagggttggaatgagaccaccaaccttgcagaggcagcagggcttactgggtttgtcttctgcggtacagccaaggcccctgtctggagtggccccctggttctgcagctcggctcaccacaggcctcctctcacccagatgttgaaaaggcagaaaagtcagggtgggcaaatccatcctgtggtcgttggcagcacagtgatccggaaagctagaagaagtgacggagtgactgactgcttcctgcgtctgtctccctgttctctgaggagtcctctaacaccctccccctgcttcagccccattcctcagccccgctcacacggtcgggccttctttcaggtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaaggtaaatagagtggagtctgtgtgtgctgggaggcgggggtggggagtgggaagggttattacctatgtttagaaagagtaattgaagggaaagccgggtgcttgcaccaacatgccagacaattgcctgagactgctttcccttcttgcccgtctggggaaagccgggcagctctgagccggtagccttcattttaaaagctgtttctgctttttctttccctgccttatttagcttgaactaagcgataacagagtctcagggggcctggaagtattggcagaaaagtgtccgaacctcacgcatctaaatttaagtggcaacaaaattaaagacctcagcacaatagagccactggtaagtcattcggaccctcccctccctgcaggggtaggaggtgggaggaattggcatcagcaaatactacttttgcatttgtccttttcccacttaatttttttgactctcatgatgtgctatgagatagaattgagctatt

SEQ ID NO: 1931 - DNA, 1144 bp, Homo sapiens
tgagtaggggtaggggacattcacagtctccctttaatacaataagctagcttgcccgagatccttggtgaatcaaggctccactgccgtgtgtcagcttggtgctctttgtttaggctgtgtggacagatccaccaaagtcccctccagtcacccctggggtcccacagaggtaaacccccgggttctctctgcccatgtcctgagaggccaggaagtagctacgataaggattccatcagccatagactcagggtgggtgggaaggtggctttctcctagttatcttggagtggggaacaagtaagaggcaggatgtgtgggctggaagggcagagacagaggtgcacagtgaagcttgaaagagagaggcccgcagagtgtgtttgctgagagatttcagcaaagttgtgctggaactctgcagccagcagtgcccagtgctgggtttctggattctgctgcctcctgtagaattcgtgagaactacgtgtgtatgcatgtgcgtgtgcagggggtgatagggtggaggcaagggcctgtcattctcaatttagaggaattactttcagatttcttcagggaccatgcatctggaggagggactcatcttcaatttatgtaaccaactgtcaccttagccattggcttcatgggcaggcctaagtggtgtaactgaatggacgggtgaggggagtccactgatatggcctgtgtgcccagcatcgggaatgagacaaggagttgtataaatgctatgtaagtatttttgtagcaaatttaatttcttgaatccagtccttgcatcctgggctgggtaggagagaagagagtggttatagtggatggtggtgcctggctcctgtggtggagctggagtgatggagcatagcacatacactgcagggaagaaggtgtgtggttagtaaagccgatttcaaccccagctgtggatcagaactgccaggggagcatctgaagcaatacccaggctctgcctgaactgaatcagtctctgagggtggtgccccagtccgtgtatttttagaaagctctaaaggggactctaaagcacagttgggaaccaccccatggagcagggtgcagagcttcacagcaggtaggaagaagtaactaagtggaa

SEQ ID NO: 1932 - DNA, 1166 bp, Homo sapiens
aggaattttgagttcaaaaatccagacttagaggacaatttaagatttaatcagatacccactgaggaatttttaaaaagtccttaagaatgaccatgtactccattttacttttcttggtaaagactctaaagtgctaaaggcagctctgttttgctttttcctcctcctcctcctattattattattactgttatttttgagaaagggtctggctctgtcacccaggctggagtgcattggtatgagcacaggctcactgtagccttgacctcctcagctcaaacagtcttcctacctcagcctcccaacgaactgggactataggcacactgtaccacatctggctattttttacatcttctgtagagatggagtctcactatgttacccaggctggtcttgagctcctgggctcaaactatccttacaccttggcctcccaaaatgatgggattataggcatgaaccacggttcccagccttgctttcacctcctaaattcaacagtcagagagtacttacccaattaaaaaaaaaaatcaacagttgctttaaaccagtattcacctatagtgaagaactgccaactcagaagcaaattaaaataaatttttcaatatggcttttctgagatagatagacttttaaaataatggaagagatttactatctgttggtcactgctctcagagcttctatcttcctcatatacaattctctcttgtgctcccactgtgtgccgagtgtgggtctacccttcatggaaaaactgcggtattcttaccaatcgttaaatgccttctaaaagacagttatttgtagttttcttagtgatagtcctggttacaattctgtatcatgtagtttcccaatgtagcaataggaaacttcagtaatggtggattggagtaagcataggtatatgagatttatagtctacacaggcattgatttcaatcatagaactttttatcagaactattagcaagtggttaaatatacttgtaacacaggtttgggctacatagtgttaagtgtcacatgaggccttcttaatttcagtacataccaagttctccatcccaaatcccttcttgattctttgatgatttaacattatttatggataatttcttattctgacctttaatgtttctaaacaa

SEQ ID NO: 1933 - DNA, 1223 bp, Homo sapiens
taattctccaaagggatgtagatagtattcccctacttctaatatttttcctcttcttagatggaaaaataattgttgcatcatgtttcccctttttcagtagtcgaaaacgaagatcttccacagtagcacctgcccaaccagatggtgcagagtctgaatggaccgatgtagaaacaagggtaggggaaaaattaaatatttgtctgcctactaaaattaggtttgtcatgttttaaaccccacagctctagatttttatgctctttgaaaatgctgaggtataatctcacattgccagtgcaccatgtaggcctattcctagaataacaagaatccacttcatcaggaactcccttgcaagtgttattcctgaggagaatctcttggaaagaacatgggaaggtaggggtcaggaggctaagctatggccttagccaccaactctctttgcaaacttatctaaaatgagataagttacctggatgacctaaagacctttctggctcacaacatttgtggcctgtgccagaaataaattacgagtgactggtgttttaacgtaagagtctttgctgaactagaaagcaatattgcatttcacctaggtgtggagcctgctaaataactgtgttttatagactattgagaggagctgatctttttcctcttgtcattttcctctcagtgttctgtggctgtggagatgagagcaggatcccagctgggacctggatatcagcatcacgcacaacccaagtgagtactgactgtaattggggtcttgctgtgtgcttttttcctcctctggtctttacattatcactccttctaccagccatccacttattcttcagaagaaatatatggttttggttttccccttggactatctgggcctccatgggcagactgcagtaggcagctggaatgctgagagcctcagaaggctggataagagcaatcagagctgcaaggcaggcggtggtggaagattggtggctcatgttcatattctgccaacgctcataaagctttctgaggctgaactgagagtacctctaaggagggaaggctaaaggcttaagttggagactagacagctttgtgtaaatcattgtttcctgacttgcttcttggtcttggtgtagcaataggtgttcactaaaataaataacactgaatgaaagaatttatagtagggaaggaatcataccttttct

SEQ ID NO: 1934 - DNA, 1199 bp, Homo sapiens
tccaggaccttccactaataacaaaatcccaggatgttccatctcttatataaatgtatttgcatataacctatgcacatcctcctgtatactttagaagtctacatgtttggtacacatgcttatttttccactgttgaatccatggatgtggaactcactgtatatagtgttaggggttgatcactgtaacctggaatgggggatacttttcgtttttggctgcgtgagtgcttaacaaggacagaactgggcgtttacctatgcatgcacatgtattgcaggccctggccaacgtcaacattgggagcctcatctgcaatgtaggggccggtggacctgctccagcagctggtgctgcaccagcaggaggtcctgccccctccactgctgctgctccaggtaggaaacatggagtttttagtattgggaggagtgtagagattttttaaaaaatagtattatagacaaaattgccattaatttttcacaagtatatgaagtatggaaatcctaacacctgattgactttttttttctagctgaggagaagaaagtggaagcaaagaaagaagaatccgaggagtctgatgatgacatgggctttggtctttttgactaaacctcttttataacatgttcaataaaaagctgaactttactgctgttggtcttgtccatagttttggaatgtgctctgcaaaaatggtctgttttgtaatgttggctttcagcctattctgccatgacacaggctggattttccctgccaccattgccggatgtgagatttagacaatcctgatgctaacaagaaggcacctcatggtacagtgttgaaaactgcactggggtggcaggaggaaggatcagagcagatgctttgtccaggttacctgtgtaaacttgatgattataaggtgtgtcccctacactgggggtggagggtaatacagaccagctttagaaagcctcctgggtatttaccctatacaaccctgcctaagaacgaactttgacgtatgctgaatgttgactgctacatcccaaggttgtaaaaaaacaagacttagctatgtaatgtctcaccaaatgtttgggagttttatggtaacactgaaggagtgcagaaagtttacttaatagtttattaaggtctccagttacacaaagtggaaaaaaaaaaagattcaaacctg

SEQ ID NO: 1935 - DNA, 1199 bp, Homo sapiens
aataaactgatacattactaccagccacaggttttgaagattgtacagcttgtcttattttcttttgttgttattcctctgtcttccctctttcctcctcccgctaaataattatttgctagtagaccgtgggaaaaaaaaggaggaaaaaaactcgagcagcccaggactataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacct

SEQ ID NO: 1936 - DNA, 1176 bp, Homo sapiens
acaactgtgggctatgaggagatgggagggtggggcaggagccaaggtgggggctactccctggacagaaattcaactccacctccatctgtcatggaccacccctggccacacaaaggccaaggaaatgggattaacacgtgctcagcacctatatggtgccaagcccatgcctgacacttcaccttcagaggcccattttcctcatgctggctctattatcttcagatcccagataaggaaactgaggcttagggggggtcaaggcccagagtcttgcagagaggtggtagattgaagccctgcagtcttcctcctgtaccatgctgcatctccatgacttaaaggttgcatgctaaggcttagcatggactccagctctccgccatctacctcctaggttgaaactcagcccatcgctgttgaaagcttgcaccatgccctaggccgtgttcctcatttcatcagccacagtcctgctggctcatgcctggttacacacgcagccccctggagggcaggggctgggtctcattcccgagcccagtgcagccctggcacaattccttcccagaagcgattctggtaattggagtgagtggtgggtggaactaccccacccaggcaggtgtgtttctggaatccatggctgaggtggttgttgacaagtccgggagggagagagggcgaggaactgcctgcttcccccaaacaggaatttttcctaatgggctgagttctcagctgatgagagagatgttggacggaccctaacaagagaaggctctacatgcagcaccgagtgagtaattagatactaactaatttgcatttcacaagagagtcagggatgttgggggaaaaaaagctgcaaaggcctattggagaagggaacgctggggacaagaagccccgacagagccaaggaggagcggcggtgcaggcgtgctgccgggcattcggtggcacagctgtggagatggcgggacgggggcagaaggtctgaaggtccctgcaatgccctcgatggctccaaacagcagcctgggctgcctaccattgccttgggatgcttttttatttccatttggaatggccaggagggagacaggaagaaactgagacagagatgcatagataactcccagtttctagagtagggttaacaaagtttat

SEQ ID NO: 1937 - DNA, 1215 bp, Homo sapiens
caaacctgcaccactgcatcacaaattcctgcagcctaggccactgagaaaattgcagacaccacagatgaagattacagttgaaaaatctgtacagagaccatgttactgagtccacccagaaccaaagtcaacataccattcccgaccaacaacccaggatccatttacaggaaaaaggctcttgctatgaaagttaatccataaaattacaaaaatgactgttttggcagtacattgagctccacagagacagcgccagggcaagtgagagccggacgggcactgggcgactctgtgcctcgctgaggaaaaataactaaacatgggcaaaggagatcctaagaagctgagaggcaaaatgtcatcatatgcattttttgtgcaaacgtcgggaggagcataagaagaagcacccagatgcttcagtcaacttctcaagagttttctaagaagtgctcagagaggtggaagaccatttctgctaaagacaaaggaaaatttcaagatatggcaaaggtggacaaggcccattatgaaagagaaatgaaaacctacatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgcgaagaaactgggagagatgtggaataacactgctgcagatgacaagcagccttatgaaaagaaggctgcgaagctgaaggaaaaatacgaaaaggatattgctgcatatcgagctaaaggaaagcctgatgcagcaaaaaagggagttgtcaaggctgaaaaaagcaagaaaaagaaggaagaggaggaagatgaggaagatgaagaggatgaggaggaggaggaagatgaagaagatgaagatgaagaagaagatgatgatgatgaataagttggttctagcgcagtttttttttcttgtctataaagcatttaacccccctgtacacaactcactccttttaaagaaaaaaactgaaatgtaaggctgtgtaagatttgtttttaaactgtacagtgtctttttttgtatagttaacacactaccgaatgtgtctttagatagccctgtcctggtggtattttcaatagccactaaccttgcttggtacagtatgggggttgtaaattggca

SEQ ID NO: 1938 - DNA, 1198 bp, Homo sapiens
cttctatttagttttacttcatcttctcacatctatcaaatattttttaaagatatgtttaagaataggaacagtatttttctttctttttttttaaattgctgctccttgtagagcagggctacgctgcaggcagtgtgcccagaatagcaagaacagtatttctatagcttctcagccttttggctaagatcaagtacagttatgtttttatagtttaatatctgaaatgtcttctatccaaagacaattttttttttttttgagatggattttcgctcttgttgcccaggctagagtgcaatggcatgatctcagctcaccacaacctctgcctcccaggttcaaacaattctcctgcctcagcctcccgagtagctaggattacaggcatgcaccaccacgcctggctaattttttttgtatttttagtagagacaggtttctccatgttggtcaggctggtctggaactcctgacctcaggtgatccacccacctaggcctcccaaagtgctgggattacaggcatgagccattgcgcccagccctaaatgagtttttggagctgggagatggaacagtatcttgcttgatctactccacacatcgacctggtattgcagtacctccaggaatggtacacccccccacctcaaaggataaaaatcaaaattaaaatcaaaaataagatttctatatatttacctcaagtactggtccagctccaagaataatctgttctactccactggcaaatcctttctgactgagagcagtaaggtggtgaataagaaagtttgtgctttgagtcttcccagaaccactctctcctgaaatcacgatgcactgattctttttgcgctgaagcatggcatgataagctacatcagccacagcataaatgtggggctcaagttttcccagttggtggttatcatacattttgacatatttggggttataaataggaagaaacttgaatgggttaataactattagaatactgccaacataggtataaattttttcatgcttaaagcgatttcgtaggttttctaagagagttttctcattcaaatcaggtaaactacataaatcatcaaagtctttctgttgaggctgtggaagaaaaccccgttccatcatcctgcgacgttcttctgttacccgtagccatgactgcaggctaccataat

SEQ ID NO: 1939 - DNA, 1179 bp, Homo sapiens
ctacagtattttcagcaaatgtgattggacaagtgggcctgtgccttatcttttggtggagtgaaaaaatttgggccagtgaagccaaatccttacagcaagcagcatgcagcatacctggctctttgctgattgcaaataggcatttaaagtatgaatttgagccgggcgcggcggctcacacctctaatcccagcactttgggaggctgagacaggtggatcccctgaggtcaggagttcaagaccagcctggccaacatggtaaaaccccatctctactaaaaatacaaaaatgagttaggtgtggtggtgtgtgcctgtaatcccagctacctgggaggttgaggctggagaatctctggaacctgggaggcagaggctgtagtgagctgagatcacgcaactgcattccagcccgggcgacagagtgagactctgtctcaaaataataataataataataaataataaagaaaaaatatgagtttggaatcagatatctccattacttccagctaaagcgtcatcataggtatttcctaagttttaagttctggataaaaactccactggtgcctactatctccaccatgaactctgttaaggaaccttcacttttgtatatgcctgctgttttctcttcatttccctgtcttctgcataagcatgccctcttgctaagtaattcaagcataaggtcttggaatactaaaatcataagcttaggagaaagaataaaataaaacttattccccgtccccccaaaatccctccaatttccttcccagtttcggaagatgtttcatttattttcagaatttctcctttgctgtggctacccatggaaagcccttgaagtcaagaacggtgtagcattccactctgacatctggtgtgagcctgaacaccagaaaataatttttctcccttccaggaaagtgaaaatgatttccctcaattctgcagccatctctgatgcaagtgtgagtttcacttgaggtcggccttggccactgtgcgctattcacctggacttcagggcatcagtctgtcaccacctgtcatcaccaacctttgaagctttaattccccagttatttgctaatgtgggaaaggaaggaggagggggagggcagaagcccctgggaatggagcttcctgtgtaattaagaagtaa

SEQ ID NO: 1940 - DNA, 1553 bp, Homo sapiens
ttttttaaataaaattggccacagctcctgtgctgtggggtggcatacacagattacgtactgatgtggccattgtccctgtataaggtagggtatcatcagatgacaggaagcagctagctctgaccctgggcaaggctttgcaccctctccaggatagtgaatgatgtccaaaggtccctgccaaccctgccatctgagtgataaggacatttcagggccttcctcctgtttgcctgggctgtgagtttggtgccaccttgtggtgtgaggaagtagtggtcagccagcctagttcagtactcaggctatggggcagctgcccaggtgcaaacctgcctggcttggcttttactcaccaacctcccttctcttcctccaggcaaggcccgaggcttcttcaagaagggagatgtggtcattgtgctgaccggatggcgccctggctccggcttcaccaacaccatgcgtgttgttcctgtgccgtgatggaccccagagcccctcctccagcccctgtcccacccccttcccccagcccatccattaggccagcaacgcttgtagaactcactctgggctgtaacgtggcactggtaggttgggacaccagggaagaagatcaacgcctcactgaaacatggctgtgtttgcagcctgctctagtgggacagcccagagcctggctgcccatcatgtggccccacccaatcaagggaagaaggaggaatgctggactggaggcccctggagccagatggcaagagggtgacagcttcctttcctgtgtgtactctgtccagttcctttagaaaaaatggatgcccagaggactcccaaccctggcttggggtcaagaaacagccagcaagagttaggggccttagggcactgggctgttgttccattgaagccgactctggccctggcccttacttgcttctctagctctctaggcctctccagtttgcacctgtccccaccctccactcagctgtcctgcagcaaacactccaccctccaccttccattttcccccactactgcagcacctccaggcctgttgctatagagcctacctgtatgtcaataaacaacagctgaagcacctgtttcctctcttttctgctggggagggggaggtggttgaaccctgccctctgagcaggctgggaatggctgcagcctcgtgccccgcagtgggagctatggtggtgtcacctgccatcctgcccacctcctggtgcagaggcgctgggaaagcagtagcttactatcttagggttacaggttgcccccttcagtgctgcggggagactttaatggcttacgtgaaccgaagatgggaaagagcagggacaaggcctccctcccactctggtagataaacccaaattgcaaagtggccttggccatggttcttccactttggtcttcctgcattagcgtatcccttatgggggctgtaggaggagtcagctctgggcgcctgagactgggtttggctcccaggtcctcagttgtggacctaggctccccttgggacccctcct

SEQ ID NO: 1941 - DNA, 1152 bp, Homo sapiens
ctcatggcccagtcaagttgacacacaaaattaaccatcacaagtacccagcatagtacctcactattactgtcattactatacagagttctttatatatgatatttaatcctcagaacatctctatgggggtgataggagttatcttcacttgcataaagggatgctaaaggttctaagaggccaaataacttaccctgttactcccagctggtaaaagagaactagcatgtgcccctagaactgtctgacattaatgctctttccatgacatactattgtttcctagggcctagacttttttggtacatctagccccttttcatcacatcttactttcctctacttttctttatttggttcttctcttcccattgattctccacagaagaagaattatgagcggcttcagaaagctctggatagtgtgatgtctattcgggagatgacccaggtattctgccttctctctgtcccctctcctttgcctgcccagttcaagtgtcctattctgttggtaatttgtgggagtgggatgaagatttagagatgctacgcactgtattttttttttagtctttcctctttaaccttcccaattcctgttctctgttttgttagctctgttactcctctttattctctttagtctttgtgtctcaatctttacctttgctgttaattcctttacaagttgttcatatttaatgttttgccataattcttagggagttaagaagtgaaggaaagacctctgcccagggttgggagggtgaggaggaggggggcttgaaggtaaggaactagacacaggggcctacatcttctatccttctaggggtggggcagccacatggagcggtgaccatcctttgactcaaggctgtccctcaccagacttccccacccctcgtctgcaatctctgcatgaatagacattcatttgtactcatttacaggtgggcctcttctcagcaaatcctgtatatcacagttgagatttacacataagatacacctaggaggaatgatttacttgtcaggaggacgctttgcattatttaaagatttaccacaggattccttagcctaatcttcttgggacattgattttatttattttttgatttataatcaactttttagggctgt

SEQ ID NO: 1942 - DNA, 1102 bp, Homo sapiens
cacgtctgtacaagtggacagaatcacacagctacctaaagtgggttcacctgtcatacagtttagaggttccacttacaacaggtttccatcagtagccaaagcaacagaaattttagcttaacggctgagggcttccgggattaccgcagggcgggcgggaagcgcctttccgctccggagggaaggccgcgtccccaagggactgcctaagtgggctggatccctatggcctgcggcagacaccaccacgtaggcggtccaggggtccctctctcggtgactggtgaccaggaggccgcaatctcttcacataaaaggtctacgggtttccgctcggccctcacagcggcagcggatcgaaccaggaaagcaattcccgctcggctcccctcgggtcccaggcccaggaaggccgggccgtggggtctccccgggctccacgcaggggcggtggggcggggcgcagtgacgcaaagaggagtgacgcgacgacgcagcgcgacgcggtgacgcacgcccctttgttggctcagtagcgatagcagcggccgtggaggtggcgttggggactgttttctctcggaggccggagcggagccgcgtctgactgaggcgggcagcaagcggccccctcgctccctccctccctcctccgcgccctccccgccgccaccagccgtcaaacgccaaccgccgctcctggggaggagccgcggctcgcggggccggagccaggcctgcgtccggacatcagccggagccggagcgagagccggggcctcggcgtccccgccctctccccgcctcggccagcgtccgccgggcccccgcgcgtcgcgccatggactcggacgagggctacaactacgagttcgacgaggacgaggagtgcagtgaggaggacagcggcgccgaggaggaggaggacgaagacgacgacgagccggacgatgataccctggatctgggcgaggtggagctggtggagcccgggctgggcgtcggcggggagcgggacggactgctgtgcggggagacgggcggtggcggcggcagcgctctggggcccggcggtggcggcggcggcggcggcggcggt

SEQ ID NO: 1943 - DNA, 1154 bp, Homo sapiens
tgtcagctggagaaaagcagttcttccttgcccacttgagaagtgcacgcccactcacccaacatcctggtctctaggaaagcctcatgtgaggttcctctttctttcagctcagtgcccatgggcaaggatcatgatttccattccgtgttacaatgacaatatttaatgagcataaccttctcagtctcctgctctcaaatttaggacagagccgctaaggacaaaacaatccctcccgtgctttatgatggcagcaggggctggggagcctctgagggactctttcattctgcagttgtctggaagcctgggtggcgtcatgagctgaaggatcatgctttcctgtcctggctccataggttataggctggctggtgaaaggttcacgtggcccaggctgaacttcattgcctagctttggatgtgctttctgccataaagactgatttttgttcgttctgagccttcaaggaatttgttttttacaactggaatatgctcctgtgtgtgttaacagatcatggatgttttatgttttcactgatcatttaaagagtttgacctcagagctccaggatcatcagtaaatttgtcatgttatatatttatttttttataaatcaagacttctgtgtgctcttaaatatattaaaaacaatttacatttcaggaattctgtctgtaattgatttttgtctccatcaccactctggaaccagataagataaaaatcattctgatcttcatttgtgatgtgcatgttactttgctcttgaggtgcttgcagtccctcatgctgagcctgagctataggcttgtcctgtggggttgaaagtgacacaaagtactagtatgaagtagcccagttaaagctgaattggagcatagcagtttgagagcatggtgagccttttcagcttgttgggagggcagtatgaacatggcagctggtggtgggcctgcctagttcaggggtcttcatttcccctgggcccacagcagcttctggaatctcaaagctacctcaagctcttcatttatgacctccctttccctgctttggataagaaagcttgattactccttcaaagtaaatttaagcctagaatgcagcttgtaactcaaagctgcattctaggcttaaattaagg

SEQ ID NO: 1944 - DNA, 1197 bp, Homo sapiens
atttatgaaaaaaatacaaataactgataaacataaaaagatacctcttaagaatcattttaattttctgcctcttttatgttcaacagagaatttcactttgaatgcagtaacttaaagtatttataaatctgattctagggtttgaaataaaacttttattagatactcatgtcatttaacaaggcttgtttatctcaggtagaaggtttttttttcccctaatgttcttctaaatggctcaaagtttggtttcctacttgaaagtaaatcttatttattagacatttgtagtgagatgactatatttatgtgtcacattcaaagaacaacagttaataatttttggacttgttagtaatatattttctgacaaataatagaagagagatttgcttaactttgttctttttctttatttttgtaggagccagcattcgaacgttcactccattttattttctggtggagccggtggatacactctcagttagaggctcttctgttatattaaactgttcagcatattctgagccttctccaaaaattgaatggaaaaaagatggaacttttttaaacttagtatcagatgatcgacgccagcttctcccggatggatctttatttatcagcaatgtggtgcattccaaacacaataaacctgatgaaggttattatcagtgtgtggccactgttgagagtcttggaactattatcagtagaacagcgaagctcatagtagcaggtaagttttaagtgatttttttttttgcattttcaaatatttataacatacatcttgataaaagcactgttctcttggagttttcttttaattagtagcaacaaatatactcatttaacagatatcaattgtgcatatactctgcgtatgggaccttgctgtagggcttgctcagtgccgtagagaataaactgtagcgtgtttccacttgtctgatggcttaatattgctatcagaagtactgagcagttcttttctccttttaaacttggaagtggcagaggaagtggtataggaaaattaaatcactttgacggccaacttctatcttacccagcataaccatttagtatggttttgtaaaacttgcagtaaagtcagaatcctggttccttgatgccttaaccaaggaaatgacattcaattggattaattgttttaaaatctacaga

SEQ ID NO: 1945 - DNA, 1221 bp, Homo sapiens
gtttgttttatttacagatgagggaaaaggtcaagtgggaagcttgtggtctcacagttgggaagctggctagtgaacccaggtggtctgacttctagctccatattccctcttgctcccttccagatagaacaggagaaaaataatctttccttagtggttttattactctgcaaatgacttttacttattttttctgattgtcaaggtaatgcaggctcattttagaaaacatggaaaatgtaaaaatttgtaaagaagaaaatacaatcactacagccacataacttagatttaatataactataaacatttgttgtacttgcgttttgaagaaaaatgcctactatagatacagttttaaattttatatacaggctgggtgccgtggctcacacctgtaactccagtactttggaaggccaaggcaggtggatcgcttgagcccaggagtttgagaccagcctaggcaacatggcgaaaccctgtctctactaaaaaaaaaaccacacacacaaaaattagccggagtggtggcacacacctgtaatcccagctactcaggaagctgaggcagaagaatcacttgaatctgggagatggagattgcagtgagccacgattgcaccactgcactccagcctgggcaacagagcaagactgtctcaaaaaaaaaaaaaatttatatacaattttgtgcttaacttttatcacctaacaggccttgagcaatttaaagtattactttaaaatattttagttttcaaagtatattacagaagtaataataactcaaataattttagaaatttggaaatgtatgaaataaaagtctgactcttcaggtgtaattgttaacagtttggtctacaccttcttggagctttttcttttcacaaatatattttgtctgttctacatattgttctaccacttgcttttgtactctgctctggcagtcctccatgagtgttcatgaagatctatttttcgtgtttttataattatttatttaaaatcacataagcggtatgaataggtgctcatgaaaattaaaacaatatggaaaaatacagagtaaaaattcgtagttaaaaaaataccatggtgtcctgttgcctgtcctgtgtccttacacctcacaagtaggagtgaatcagcttctaggactgtttctgtgtatttactgactgaagtgtgcagtcacagaacatgtgagtg

SEQ ID NO: 1946 - DNA, 1189 bp, Homo sapiens
gataagatttggataattgacactggaggccagagactgtgatagaacctaagcctggggggacagtgagagggtgggggcttatgcaggtagctggtgtgatcaggtgggcttcctaggaaaaggtgcccaagggagctgggaaggatgggtaggttttataccccagaggcagatataggagggtgttccagcctaatgatgagcagaggcttggaaatagggttgatcctggcgggtctggagggtggagaggagcctggggtgaggctttacaagtcaggagctgaagcagctggaattcaagccctgctgcctctcctcttgcctgcagactttggtttcgcacaacacatgtccccgtgggatgagaagcacgtgctccgtggctcccccctctacatggcccccgagatggtgtgccagcggcagtatgacgcccgcgtggacctctggtccatgggggtcatcctgtatggtgagacctcttttccctgcttctcaccctgaggcctacagtttcctcaggcaaggcctctctgggccacttctgaagggttctgatgaaaactgactgctggcccagggcccctgctgaggggcgtcaggccaggcttgacccattccctcccagcctccgctctgcctcccttccacagaagccctcttcgggcagcccccctttgcctccaggtcgttctcggagctggaagagaagatccgtagcaaccgggtcatcgaggtgtgtctagcagggccttagcgaccactggggggcagagggagtcagggccctgagggtttagacctcgttctgacctgcagagactggagtatgggctccaggctgcctttgtggtggaggggcaggttctaggctggaagtcgaggtgccaggctgtcccagggcctcaggtcagcccacagctggcagcacagtgcccattttgcaggcccttgtggggagaatgcaaagcagagccaggcccagccttcctaggagcatagtccagggagggaaataaggacccagaaacacgattctagctcagctcagggctccagcgagggtgcaccgggagcccagggatggaggcctcgctccccgctggctccatcatcctgacccatcctgttcctcctcggtctcagattccccacctgtccaacgcgtacctctggggttcct

SEQ ID NO: 1947 - DNA, 1228 bp, Homo sapiens
aaattcccgggccctggcttcttggcgcgatggtgaggcactaggggcgaagcgaggcttgggctgctggagcgggaatgagggggcgccaagtggctccggaaactgggggaggttgtactggcctctccgcaaacacagtgtgtgcgggcgtgagggctgtgagtctggtagggaaaagtccaccactctcccgctcccgagacgggggcgggggtacggggcgggtaagacagagcaggccggccggcttagagtcccggtgcttccctggcggaaggaagggcccctgcctcccggggcaggaactagggcttgtctggagctgggagtcctttcaggtcttccccatccccaagaggacctcccaaggatacccccttccccagccctgccgtggggcttgtacaagaaggtgcttagaatcaggctcactcttccacactgttaggaagcccctccgctctttccagagccagaaagtagtagttttggggttgagacttatccatccatccatccaatccatccatccgtacgttctaagcgcctggtctataccatgaagtgtgctaggcactgggaggacttgagctgccaagggaaggggaaatcggaggcttgaattggagtcatagctaaggctccaggggcagagacctaactgcgccttgtgtgtagtgctaagggggcttcctaaggatgccatcaaacttaaaggcggatggatggcaggagctggctggctgaagtacagtttgtgtaccaggggtagggaggcaagggtgggagacgtgtgtcttcagacagggaacagcatgtgcagagacttcaggttagagagagtatggctccccaggaatggatgcatttcccatagctgggagagtatcatctgcaggttagggaaagatgaggctggacaagtagagaacaaatcttcctggctcttggatcaccacaatcaagataatgaacgtatccactggcctccataatttccttgtgtgaggggctattttaagaagtataatcaagaaaggctgttctggctgggtgcggtggctcatgcctgtaatcctagcactttgggagagtgaagagggtggatcacctgaggtcaggagttcgagaccagcatggccatggcactccagcctgggcaacagagggagactctgtcttatttttttattttttaaaaaaagaagggctggtctgatgtgtc

SEQ ID NO: 1948 - DNA, 1218 bp, Homo sapiens
ttagattttctttgttaaggaatgtattttaatattttaattctttgtttgtttgagatggagtttcactctttcgcccagtctggagtgaagtggtgtgatcttggctcactgtaacctccgcctcctgggttcaagccattctcttgcctcagtctcccaagtagctgggattacaggtgcccgccaccatgcctagctaatttttgtatttttagtagagatggggtttcaccatgttggccaggctggtcttgaactcttgactccggtgatctgcctgcctcagcctctcagagtgctgggattacaggcttgagccactgcgcccggccggaatatattttaattcttaactggcccttttgctaataagaataatttttacagttggccattaagattttatgatctgttgatatttatagtggtggctttatttgtatatttctgatagatggataattaggaacttatcttttaatcataggtggcacaagatctctgtaaagtagcaggcatagcaaaagttctggtggctcagcatgatgtgtacaaaggcctacttccaggtgaggttttccagtagaaaaaaatgtagtgtctaaattacgcttgaatatatgaatatgaaagtatttcaaaatatttttttatcaaatgtgtttaattctcagaggaactgacaccattgattttggcaactcagaagcagttcaattacacacacatctgtgctggagcatctgccttcggaaaggtgagaaggttgagaatgtggaatctgatatcactgcttgaaagggttagatttcattgtgctgaaagtatgcaacagactgtttatgtagccaatctggatttatctgaattgatgtggtagttttgctaaaatttattctttcaagattttgtcataattttccgttaaaactaccatttccaggttttcaaattatgttgtggagaaaactctaattaggctattattttaaaattttctgcatgtaaaagtaatgctgaattctgcttgcatgtgagagagagagtgaacgagcaagagtcatttctattagtagcccattttaagagatggtttatttggatggctgatggatatctagaaaagccaaattttatctacgtagggaatttggaaagggcttgtggtggttgaagacatccttaaggtaaagaaagctgtaatctgatcatgtg

SEQ ID NO: 1949 - DNA, 1120 bp, Homo sapiens
cgctgggcgagcgccgcagcgactacgaccgcgaggcgctgctgggcgtccaggtgaggcggccaggccggtgctgggagggccgggcctcgcaccgcggctgccgcgggctttgtcccgggacaaaggggggcggccgggcgaggcctggcaggggcggcctgacaatgggggccgggcggcgcggcactcgctctctgggggtcctggggcctggaaagcctgaggagatagcacggcccaagagctggatcccttctacccctcagatcatggagggtgtgtagggggtaggggccttgaagtgcaggtgcgggtcaccccgaaaccctttggcaagggggtcttctagtagccctgtttttctccaccattttgccccactgatagtaatgcttggccctcctgtgtgtcgcttccccctaaaggaagatgtggatgaatatgttaaactcggccacgaagagcagcaaaaaagactgcaggcgatcataaagaaaatcgacttggactcagatggctttctcactgaaagtaaggactgccctacacgactaacaatggagacaaacacaaatatgttaagcagcggtgtctgctgaatgtatagattgctagtgtcccaagttggaagtcctgtgagaaggagaaaaggacatggagaataggctttatacttacaaatctttagacactgagaaccaagtaaaactcggtgctttctccagttatatataaacatcattgaccctgtactctatgtggaagtcacaccttgagacaccctctttctcacgtgacttttgttagtgtcaacaatatgatttattttagagaaatatgccccaaaactttaaggcagtaaatgatttatcgctcttttgatatatgcttcatttaaattttaggaatttgcttctttttttaagcaagtagaaaaagacctgttgcctgtgaattacgtttattataacattataccaaaatgttagagctggtaggggccttgggatcatcttgtccacatcactttgtagagatgaagaaatgaagcacagggataagtgccttctacaaataagtggcaaagctggactagaatccaggtatcctgctctta

SEQ ID NO: 1950 - DNA, 1308 bp, Homo sapiens
tttttggtcttgttctgatttggaaggtgaattgagcaggtctgctgctgttggcctctggagttcatttagttaaagcacatgtacactggtgttggacagagcagcttggcttttcatgtgcccacctacttacctactacctgcgactttctttttccttgttctagctgactcttcatgcccctaagattttaagtacgatggtgaacgttctaatttcagaaccaattgcgagtcatgtagtgtggtagaattaaaggaggacacgagcctgcttctgttacctccaagtggtaacaggactgatgccgaaatgtcaccaggtcctttcagtcttcacagtggagaactcttggccaaaggtttttgcggggaggaggaggaaaccagctttctggttaaggttaacaccagatggtgcccctcattggtgtccttttaaaaaatatttactgtagtccaataagatagcagctgtacaaaatgactaaaatagattgtaggatcatatggcgtatatcttggttcatcttcaaaatcagagactgagctttgaaactagtggtttttaatcaaagttggctttataggaggagtataatgtatgcactactgttttaaaagaattagtgtgagtgtgtttttgtatgaatgagcccattcatggtaagtcttaagcttgttggaaataatgtacccatgtagactagcaaaatagtatgtagatgtgatctcagttgtaaatagaaaaatctaattcaataaactctgtatcagcccccaacatattatttttcattatttgggggatatttcagttccagagcagcagtatcatgttttctttgttggtgctgtctatagttcatcatggtttacgtgtgttttcgttatagctgttgccagattctaaagggcttgatattcaaaaaaccacagatgctttcagtccagtatatcctagaaatatagagctctactttgtgcaatgcactggggatacagtggcgatactgtccttgtcttcaaggagttcggagtcctagtataggagacatacataggagaagataattttcacactgcagtggttgtagtaatagaatgggagtccaaaggggagttccggagaggtcaggggtgacttcctggaggagatgcccaagcttggaggctggataggctttgttgaaagatggtacacaagagtgtgaaacaaaattgtgtgtgcagggagcttaaaatacaaggctggggaaagaagttggagaagcaggaaagcccaggccctctagtgtcttacgg

SEQ ID NO: 1951 - DNA, 1123 bp, Homo sapiens
aaacatgtctctgccttgctaacgccatcaccagccttttctcctctctgactcttctgaggtctagcccagcgcctggtacaataagtttctccataagtatttgttgtttttctttgcacttctcaccaacagtgctgccaagattttaacctggtcaggagaatctggtcaggcagagattagtgtctccaaccttcctaggggagaatgggctaggtagaaagatagcactcagagggctctgaatcatctataagggtggcatagtcataggaggagagtgggtttggtccaccagaacctccctagggagccatctgcgtccaagggcggccagaggccaagaaaaggcgctgaggccttggctcctttaagaggcgtggcctcactgcagcctccgcagaggcgattggctgaagctaccggccgcgtggggcgggactcggttgccagggagcggcgcgggagccctgaggggactgcggcggctgcgcggaggagcgaggcacttgctggggtcggggctgcgcgacggcgcaggggctgcggggagcgccgcgcaggccgtgcagttcctagcgaggaggcgccgccgccattgccgctctctcggtgagcgcagccccgctctccgggccgggccttcgcgggccaccggcgccatgggccagtgcggcatcacctcctccaagaccgtgctggtctttctcaacctcatcttctgggtgagcggggccgggcagagcgaggggccggcggcggggccgggcgaggccgcggcggaggcgcccgtgggggccgggcttgggcctgggcgggcgcgcgggggccgcgcgcgggccctcaggcggctgaggcgaggggagggccgggtgtgaggccgcttcgcgaggtccctgccggaccaagccgggagcctgggcgcggaggacagcgaggggaggccttcagggactccacggcctccagccggcgcctccgcgctcggcccacgcgggctggctccgtgccaggcgccccagtctcccccccccggagtcgccggctggacggagagcgcttattgcagactgtagcaggacgtcgggctcgaaataggatcttcgccagaggctcaggt

SEQ ID NO: 1952 - DNA, 1196 bp, Homo sapiens
aatggtatagccaacttggaaaagagtttggcagtttcttataaagttaaaaataggcttaccacacaactcagcaatcctactgttaggtgcttaaccaagagaaataaaaacttacattcacacaaaaacctgtatgtgaatatttatagtggctttattcataatctccaaaaactggaaacaacacaaatgcccttcaactgctgaatggataaacaacggagtactatgcagcaacaaaaaagaaagacattctgattcaagaggcaacacagatattaataaatgtgaagtgcattatgctgggtgaacgaaaccagactcagagggctacgtttagatgactccatttgtatgacactctggaaaacgcaaaacaacaggaacagaaaacagatcagtggttgccaggggtaggggctgggaggagttgactacaaagagacagcatgccgggatttgggggtgacaggattgttctgtaccttgatggccatagtggttacacagccacacgcagttgtcaaaactcatagactgtgcactagagagggtcagttttactgtggggtaattatacctcaataaacctgatggaaaaagtttgctgtgggactattgaaacaaggaaaaccaaataacaagtcagtctgtcagggcagtgagacacggtgaggatggcttcctccagggtggcctatggaggacattggagactgtgagaaggaggtggtcacagagctttctgaggaggtggcaggtggctgtgtggtctggaggggaggtgagggtggcccacaggtcagggctgggttgggcagtgccctgtgggccaggttaaggggcttcaccctcctctgggcatggtgggtgccactgagggcataggcagagggtgattgaagcacagttgtgggcaggatggtctgggaggagggtggagggaggagggaggaagggagacagcacctgtggccatgtctaggatgagtgatgggggtgtagtgaagaatgaggaagggtggatcggggtgtcactgagagggtgttcccaaggcggggtcagctgccagagaccacaggctgaggcgggagagctgggggtgctgatggggtccttggggaccttgctggggatcttgagcggtgctggggctgaggacctgtaagtgaagcttccaggaggcagggga

SEQ ID NO: 1953 - DNA, 1166 bp, Homo sapiens
tccacccccaagttcaggacccagatcactctctggagaaggcctcagcctcttgccttggctttcaaggctctgcgtgatttggatactcgcttagctcttatttatatatattttaaaagcatcagcagtttatctcatgcccactaaactatcctgcctccgtaccctttgttcatactttctgctctgtgtggaatgcccttctttcttcccctgttctttctcttagacccaagggttctcagccttatttctgcctctcccatctctgatttactttcattttctgtatcgatttctcaaaaaatactttcttgattctttcatcatcccttttcccaccctacccccggttcctctttccacattataatctatgactgcctctctcacctaactgccagtattagcttttcaggacaggaactggttttacacattttggtattccagcatctagcataatgcctgacacttagctgaataaagggagtaaataaaacagatttgtaaagtcagcaaatgctttttaatttgtgaatcttattttaatgatgatctgattttctttttacaggaactatataaagttcagaaaacatggtgagttaatacacatgccaataaacggttgcctgataaacagtattgcttgtactcagtttacagacttgagtgggaaaattgaaatagaaggaaagcagtgagaaggtgccttttttcttgtcagtttcctctcacctattgaactttgtataccaggataggttttgtaagatcatttgtaggcttgcaggagttggcctactttcagtgggtaggaatcactcatgtgtttttcctttgcagtctcgaagatatgactccaggaccactatattttctccagaaggtaaaatagaaattgtttaatctgcctcaagtttaaaaataaatgtgttagacttttagaaaaaaaaattacaaactttttttggtagttgcaaagttcatcctttttgtactttgaagcaattatcatcaccaggttgattataccatagaagagtgaaagtggaaatttgtttctagcttgcttcattgctgatttcttttgggccagtggtgcaggagcacagaggagagtcttggcttctcactgcttttgttttgtaggtcgctta

SEQ ID NO: 1954 - DNA, 1199 bp, Homo sapiens
ggtcttttcaatcattagaatctcaggcttctgtgaaaatttgtcagttctggagtagatgcagaagaaggggttcagttctagtagagttagatatttaaggaagatattcctggagcagggtccctatgtagcacgtatatcttatctgaagtatagtaatttaaaaattatttcatgcaatcaatgataggcctgcttttatattaggcttatattaatacaattcatgtgcattgtttaatttctgcattgttattttatatgtgtgtattttagtgcagatggacgttttgaagggaccagtacgaaaacagtcatcaggtacaatggcactgtcacctggactccaccggcaaactacaaaagttcctgtaccatagatgtcacgtttttcccatttgaccttcagaactgttccatgaaatttggttcttggacttatgatggatcacaggttgatataattctagaggaccaagatgtagacaagagagatttttttgataatggagaatgggagattgtgagtgcaacagggagcaaaggaaacagaaccgacagctgttgctggtatccgtatgtcacttactcatttgtaatcaagcgcctgcctctcttttataccttgttccttataataccctgtattgggctctcatttttaactgtacttgtcttctatcttccttcaaatgaaggtgaaaagatttgtctctgcacttcagtacttgtgtctttgactgtcttccttctggttattgaagagatcataccatcatcttcaaaagtcatacctctaattggagagtatctggtatttaccatgatttttgtgacactgtcaattatggtaaccgtcttcgctatcaacattcatcatcgttcttcctcaacacataatgccatggcgcctttggtccgcaagatatttcttcacacgcttcccaaactgctttgcatgagaagtcatgtagacaggtacttcactcagaaagaggaaactgagagtggtagtggaccaaaatcttctagaaacacattggaagctgcgctcgattctattcgctacattacaagacacatcatgaaggaaaatgatgtccgtgaggtctgtgatgtgtatttacaaatgcagatcttcttccattttaagttcagaagttactttcattaattttggcagagtaaacagcatg

SEQ ID NO: 1955 - DNA, 1189 bp, Homo sapiens
atgaaattagactgaagtggtccctaggaaatccaaaaataaataaagtgtgtatgtgaggaagatgaacagctttctaacatgtattattctgaaccaacttttaatttggcatgaaattaatctcaggctagagtctctcaaaatattaaaataagtaaacactactgggcaagaataagtatatatagtaagaataattttttttagtttattgtaaaatatccaagtctattttaatttttaatctatcaaaataaaccacttgtaatataagttgatgtgtaaatgaacatattttgtagtgtcttttaaagcttatatctatagtagaccttcaggctagtgtctgtccctgagctgagtatagggtcacttaccgtttagaggcagcaatgggaggcagaaatcgatttggcttctaactcagtgtgtttgttatatcttaaaatatgtacacaatttacaattatttaatgcatttttatttttttcctaacaggttgttgaagattggaaattcatagcccaggttcttgatcggatgtttctgtggacttttcttttcgtttcaattgttggatctcttgggctttttgttcctgttatttataaatgggcaaatatattaataccagttcatattggaaatgcaaataagtgaagcctcccaagggactgaagtatacatttagttaacacacatatatctgatggcacctataaaattatgaaaatgtaagttatgtgttaaatttagtgcaagctttaacagactaagttgctaacctcaatttatgttaacagatgatccatttgaacagttggctgtatgactgaagtaataactgatgagatacatttgatcttgtaaaaatagcaaaatattatctgaactggactagtgaaaaatctagtatttgtatcctggcaaataatactaatttataatccacagtaaagttcatcctttgactgtgctggagaattccagttgtatttgaagactgattttaaaacttttctgcatttggtaaaggtatgtaaactttcctgtactcactgagtaacagctaatctttaatataatattatactgctatatttaaaaagctgactacttgatataattacttaatgtgatgcttgatataataattacttaatgtggccgggcacggtggctcac

SEQ ID NO: 1956 - DNA, 1238 bp, Homo sapiens
tgtcttagttgaaccaccgtcatgccaaagaaaagaattccgaaaatctctaagtcacacgatgccgagaggccagccagctctgcagctgggctttcagttccaattgtttccagagagtgtgcaggacatttctccgcagccatcttttgcagtgggccacgagggtgctgagaacctctctggtccccgcgcttcaaggggtgggcgctctgccggcgggaatctttaggatgaactggaagcacccctacactcactcctattctccgggctggagtcggcatcgccttccttggcccgccttacctttaaggaaacggaaaggtgctgaccactagagggctgtttatacatttttattaaacaacagaagtttgtgcgcacagaatcagacatgaaacacaagttttaaaagtcatgaaaaactttaccaaaaaaaaaaaatatatatatatatatatatataaaatagaaaaatcatttaatacgaaatgtaattcttagaacaaatcaaaacaatcttattcctttgaaaagatctaggaacaacacttttctctaactgcccggctagctcagtcggtagagcatgggactcttaatcccagggtcgtgggttcgagccccacgttgggcgggtttgttttgctttcgtttgaccaacttcaggtctcatcaacggtagtaattccaccagtttcagttgtcatcaacggtaataacagacttcagcccggatggtcttattttcaaataattcaatacatacaaaactaccaatactattttaaaaaaggaacaatgggcctggcacggtggctcacacctgtaatcccaacactttgggaggccgaggagggtggatcacgagatcaggagtttgagaccagcctggccaatatggtgagaccaccccaccccctgtcccccaccccgtctctactaaaaatacaaaaattagttgggcgtggtggcgcgtgcctgtagtctcagctgctcgggaggctgaggcaggagaatcggaggctgtggcaggagaatcgcttgaacccaggaggtggaggttgcagtgagctgagatccggccattgcactccaacatgggcgacagggcaggactccgtctcaaaaaaaaaaaaaaaaaaaaaagaacaatgaaaccagtaaatttcatcttgtaaattacacacttaaaggctatctgccctataaaagtatttgttgctgagtggcct

SEQ ID NO: 1957 - DNA, 1193 bp, Homo sapiens
gagtttctgcttgagtttgactgattagggaacagaaaaacagaaatatgtcggccgcggtggctcacagctgtaatcccagcactttgggaggctgagacgggcggatcatttgaggtcaggagtttgagactagcctggccaacatggtgaaaccccatctctactaaaaatacacaaattagctggtcgtggtggcaggcacctataatcccacctactcaagaggccgaggcatgagaatggcttgaacccgggaggcagaggttgcagtgagccaagattatgccactgcactccagcctgggcgacagagcgagactccatctcaaaaaaaaaaaaaacaaatgttatgaatactgtttgacataaggggaaagcacaatgatatttctacaaaggaaatagaatgttggcttgcaattcaaggcagccagtatgtgaacaggaagaatgtaactcttaagaacagacctgttgaaattgaagtaggcatagtccgttttggggatccactcagagcccttctctttggtccaccttcagcctgtttccaagtgctcttttgtcatacctggctcttccggcttgcctcaccgtgtggttcggcaggttttctctctttatcagtaccagaagctgagctctcactctcctcttgccacaatttacttacccgtggttctgttttgaggggccttgcttttctccagtaatccagttgcaaaggatctgacagatgacttcattttctgtgttaatgggcaataactccttaatgtgttctcttccgagcacagttgttttcatttagtgcactcttagaggctcagtcttctctaaaattcagtcttaggtcaggcacggtgacacagcctcactgagacctccctgtagtctcagttactgggaggctgaggtgggaggattgcttgagcccaggagtctcagaccagcctgggcaacatagtgagaccttgtctctacaaaaaataaattagctgggcatggtggctcatgcctgtagtctctgagcccaggagtttgagaccagcccgggcaacataacaagaacctgtctccaaaaaccaaaatcaagtcttaaaattctaataatgccatgtcatattggtgtagaaagcatttttttcccctgcagaagtcacttaaatcatacagtcctgagattactt

SEQ ID NO: 1958 - DNA, 1293 bp, Homo sapiens
ttaatactggacactgacaaattcatgtttactataaaatctccttacatggaaatgtgactgtgttgctttttcccatttacacttggtgagtcatcaactctactgagattccactcccctccaagcacctgctgtgattgggtggcctgctctgatcagatagcaaattctgatcagagaagactttaaaactcttgacttaattgagtaaactcttcatgccatatacatcattttcattatgttaaaggtaaaatatgctttgtgaactcagatgtctgtagccaggaagccagggtgtgtaaatccaaaatctatgcaggaaatgcggagaatagaaaatatgtcacttgaaatcctaagtagttttgaatttctttgacttgaatcttactcatcagtaagagaactcttggtgtctgtcaggttttatgtggtctgtaaagttaggggttctgttttgtttccttatttaggaaagagtactgctggtgtcgaggggttatatgttccatttaatgtgacagttttaaaggatttaagtagggaatcagagtcctttgcagagtgtgacagacgactcaataacctcatttgtttctaaacatttttctttgataaagtgcctaaatctgtgctttcgtatagagtaacatgatgtgctactgttgatgtctgattttgccgttcatgttagagcctactgtgaataagagttagaacatttatatacagatgtcatttctaagaactaaaattctttgggaaaaaccctcaattgtgattttaataaattaaaagtagcacattacatggttagaaaatgtcagtgttaaagaatggtacaaagtgaaaagtgtatccctctcttgccgccggtggtagcttgtcccagtggaagctgctgttaacaatttgtgcccccacatccccctccctgcccatccaccaaaaaaaagtacatttacttatgtaaatgtacttatggtgatgtatgtttgttttggcctcacagcatctgtttccccttaatttggtagctgctcacatttccctcgaaagaaccacaccctctgcattctcagttctctgctttggatgggacatttgccctgcagtccccccaccctccaggccatgccctctccagggtgaggcctgtgtgatctaccgtactagggtactaggccctgaaagaggcttttcttgttcctcctgcatcttgaacctggagcgggagctgttgtaggccccgcccttggagaagagaactgtctgacagtggggaga

SEQ ID NO: 1959 - DNA, 1174 bp, Homo sapiens
ttggtaaagcaggtcactagattataggagtgaaaagccttttcgcacaggcttcagagtcataaagatcagacttgaagtcccagctgtttctcctcaacagtgtgaatgtgcataaatcctttaacttgcccaagctgtagctccctcttctacctcttaggagtatgtgcagatgaaataaagcgatccacgcaaagccatagttcagggtccccccgcgtgccgtgttctctacatgttagctcttaatagcacacacgtggcagcagttgcaagtgcctggcacaagggggcgctcaatggatgaccatttctaatgcggttctcagcccagagatggttgtaccttcttgcagctactaagcgagaccctctcctctgtagttctgcggacaaaaaaactactgggaaggcctcttcagccactgttaatgttgggcccctcccttctccccgggagaaactcttctctgagtttccctccttccattcttaccgcagcctttcctgctggacagtccaattgttgagagagggacttcctgttactgcagagagagtaaggctgcctgtccgtgggcgctgcagatttcttggtcattggaaaatcaatttctcttgtgcaatagggattaacacctaaaccagaagaggaaaaacagcaagaaatcatttgtgctctcaaaatgcaaagttcaactaagaacaatatcagcccctcattagccaggggccagtgtgactgtaaaccacttaacaccctgtgccaggtgcgtggtggggagaggtggccgcggaagacatgagcagcattgtcatgatctccacgcatgctgtctgtactgcagggtgcagatgggactctcacttccattttacctccattcaatgcaacaagagttgacaggcatttcctgcaagtcaatcagtgtgctgagctctcagaaaccacaatgctgcatcagatccaggccccggtgttttcaatcccaaccaaggagagaaaggaggaaaacacaaaggtttccgaggacaagcacaaacaggcgagacccagtaggaacaggggcaggggagatcctatctgactggctcttacacaggcactcacacacagggatacacacacacggagacaactcttgattctttggatatctgcaaaaatgca

SEQ ID NO: 1960 - DNA, 1178 bp, Homo sapiens
gattctacaggaccctccaaattccataattcctgaattgacttcgtagaaaatattaacctttggaaaagtgatcattgcaaatggtaaaggacacaggagtggcatcgggtgatgcaggcccacatataattccacggtggcctgtgagtagatctggagattagggtttggcagtgggactaaggttcaacacagccttcttaaactgaaggctaagactcctcactctcagaaccttggttaacctcaagaaacattccagttccctatcagataggaatccaagactccctctgtggacaccaggcaccatgaaatccaagtctggcaatccagaggtgagaccacagtttcagtttctagggtctaaattgattaatgcaaatgtaatccatttacagtataatcccaggttcattgccctgtggtaattcaaacaatgtgagcattcaaggcacagaaataacaaaaaggctttttttaacttctagttatttttaaacatttttttttaatcatcataggtacttacttggtaggggagataccaagatcacaaagttggtttcccagggcgaggcttattcagtacactccaggtgtgctgacccctgcgatttccccaaatgtgggaagctctactgcatactttgtggtagagagaactgtgttcgtgctctccccttctcccctgacataaatggttttttttttccttttttgagaggagtctcgctctgtcacccaggctggagtgcagtggcaccaactcggctcactgcaaactccgcctcccgggttcacgccattctcctgcttcagcctcccaagtagctgggactataggcttccgccaccacctccggctaattttttgtatttttagtagaggcagggtttcaccatgttagccaggatggtctccatctcctgacctcgtgatccgcctgcttcggcctcccaaagtgctgggattacaggtgtgagccaccgcgcctggcccaaatgtattttttaaaaagaaaaaaagattgttttatcatcataaaaatagtacatttggtgagaccatttgtttaaatatagaaaaaataaaatgaaaatgacctttaaccccactatccagacgtagccactattgacattttggaatatatcctccagctctttttttc

SEQ ID NO: 1961 - DNA, 1249 bp, Homo sapiens
ggacactgctgatgattcccaagattgagatgatgacggtgatgacgactgggtgaacagccatcacttcaacattgtgataatccttcacagcaagaaaccgaataaaatactaacatttctaacaactgctctgacattgtaaagagatccaacagaatcactcctgctgaaaaatacgctttctgccacctacacatttctatttaggaagtaaaatttgcttcatggtcatgaccccattagtcagtgttacagctgtgttggggataggaagtatatctggcagattgatatttatacacttttttataaagcagattttaaaatatagtaacatccatttttttcccttgaaagtgattctcttataaaaaatgaaagtggagtttaaggtatatcaaatcgttgtggaaggtgattaaaaatcaaaattcttttaaatatcaacttaattttttctaagtaagatacaaaaaattttcatctaaagtaatatttcactttatattgtaaagaaggtaggtatattggtggctgaggtctcttgaaattgctaaagggaaatttttctatggtaatgctcttacggatataaacctcagttaaatggaattatctatgggatgtgtggttctggttaactaaaaattaaccagtaaacactctgtagtaaccattacagaaaatacttctgccttaaaaaatatgatatgccagagatgagttagtgtttcttgacgttggagaccttttaaatgcctcatctgttgtactgaacaattgaaactgcatgcagccataaaagggacaagaaacagaactgtttactaactttgggacatcccctggagtttttaaaaataaataaatatatatatatataaaaaaaactcttttatgtcatttgcctttttcttctaaaagtgaatataaacagaattttgatttgttttttgtttgttttttgagatgaagcctcgctctgttgccaaggctggagggcagtggtgcaatctcggctcactgcatcctccacctcctggattcaagctattatgcggcctcagcctccagagtagctgggattacaggtgcccaccaccacgcccagctaatttttgtatttttagtagagatggggtttcactatgttggccaggctggtctcgaactcctgacctcagctgccttggcctcccagagtgctgggattgattacaggcgtgagccaccacgcctggctgtc

SEQ ID NO: 1962 - DNA, 1195 bp, Homo sapiens
agcaatgatcccacattggcctcccaaagtgctggaatcatagaacccaagctttttgatggaggatgaaaagttaaattgtagtgtattgacataacaggatattatgccgcattaaatatgaatgagctacagctatacattggttgctttcaatgtagttaatcagagtacctttgcaattatcagtgtcaaaaataataaagcaatatttacccattattttaaaaaaaatgattgaattcccactgtatgccagattactgttctgagtgccagggatttaacagtgaacaagaaggacacatcttctgtcttcatgaagcttatattttagtttagagggggagatatgaattagtaagcaagcagagtaatatgtaatttaatgtagccaggaaaggtatggaaaaagatgaagcaaagtaagaggctagcatgtatgtgatgtgtgtgtttctgtataataaaggaagacttctgtgaaaatgtgacacttcagcagagttggatgttctgaggaaaaagtaggaatgagctcagcataatcaaggaaaagcaagaaggcaaatgaggcgcagagtgagcgagctaggacctgggggagaaggacagaagatgaattcaggtaggtagacaaagccatatcatgtaaggccttatagtttagtaacaagtttagagtttttaaagtaggatggaaagtcataggagagttttaagcaggggaattacatgatctgatttatattcagggactgaagaattgattgttgggggcaaagggaggggtggagtaggggaaggtagattcaaagggcccagttggtaggctttcatagaagtttggatgatagtggagtagatagggatggggtagagtagcagtggatgtagaaagaagtggttagtttggtgacatgttttggggtataattgaaggacacagtgatgaatgagatatgtctgtgagggggaggaataaatcaataatgaattccaggttctggtaagggcatctgggtggatggtgacgccctttactcacatggagaatcttgaaagctaagtagattaggccacaagatgttaagagttcattttagaaatgccagtgagacacccaatatgtgagtctgaagctcatatgagaggtctggagtttgaagatagaaatatgagactcatcaacata

SEQ ID NO: 1963 - DNA, 1158 bp, Homo sapiens
atgctaataatttgaaccctatagaaaattgcaaaaaaaaaataggttttatttttaaggaatgcattttttaaaatgagataatgttgtgacaacattttgtaaactgaaaaaaaaaaaagtgtttgttaattccctcacacacccataactatttgtcatcacttagactaaaaagagttaccgaggcagggcatggtggctcacacctgtaatcccagcactttgggaggctgatgcaagtggatcacctgaagtcaggagttcaagaccagcctgaccaacatggtgaaactccatctctactaaaaatacaaaattagccgggcatggtggcacgtgactgtaatcccagctattcaggaggctgaggcaggagaatcacttgaacccaggaggtagaggctgcagtgaactgagattgcaccattgcactccagcctgggcaacaaaagcaaaactccatctcaaaaaaaaaaaaaaaaagttacctggcatggtattgtacagaacagggtctgcacaatttttcaaaagtaggatagtaaggtttgcttcaagctcatctgtcattctgtaggagcagtgggggattttggaaggcgaaaaaaggaaaagtcaatgggtagcaacactgattctgcagctggaggactgtctatacactactttgcaaatgggggtgagaaaaatgcagtatgccagtaagcaaaagtagaaaaagcaaatgtaggaaattaacagcaaattttttacaaaagaaggaaggaacacagcagagctttgccttgttgagaacaatcggctgcaaactgaaaactgaccagcatgccttgagctgttaggccacattactaaagtctctgattgctcaatctgcaaatgagtatcttcagcccttagctcctatgcagaaacatctgctcccaacctgacgtatgtttatttactggcctaaactgcctttacctcaaaagaccatggtaacaggcagactgaccaataatgtatgcctctgtgcttattggcagggctagctttggaacagcatgcaggagatgggactatgtcacacagcatctaataacaaatatctgtccagatgttctcgagcatcatagtgtaactctcattttctgccctttataatactgcctc

SEQ ID NO: 1964 - DNA, 1231 bp, Homo sapiens
tctcagcttcaccactgtgctgctgggtgacttcaggcaaggcccattcctctctggaccctggttcctcatctgtgtactgtgtgtgtgcgttttttaaaaatcagcttacttttaaaatttgaaatatgaaagtaaacacaaagttaaaatagcaaatgctcagcttcgtgtaccatctaatcctgttttatgtatgtgcatgcgtgtgtgtgcgtgtgtgtgtgtgtgtgtgtgtgtgtgtgtgtgttctgggctacctcagagatccattctggctttgagtgtggtatgtcccatcttgggcaggtccaagggaaggcatgagcgatctggctttgggacaagtatggggctggccctagggcccggatgcttctccctccgctgcctatcacagaggggagtttgtcttgcaggaaacagcctcatccatcagtggcaatggggggctgacagtggccactcccccgccagtcctggctggaggcagactcataaatcccacaccaggccgggctttaaattcctttgattcacatccggcctcttggaggacagagacatttggggctgtggggctggctgttctctcctgggcaggacaggtgggtattgggaagaagcctcttcatgggcccagcagtctcagatggcctctccgaggatatgcagtgctgagcccccaggatgcctcaggctcagcctgagccacctctgcccaggcccaggccacctctgcctaggccattcctgtgccctggcctgaatcaccctggaggtcacctatgtggacacactctgtggcctcagagatctcgtggggcctgtggcccagagggttggctccatgaacttcacagcatggtcacctgccaatccccatggcattctgtcttggggctgtgaggacacggtgggagatcagggcccagtctgtgcatctctcattccagggaggccggggccccgaatccactgtcccttaggcaggaaggggacagggacactcagtccagggaggcagccatttgtcacctttcatcaggacttttgccacactcagatgccactggaattcttctttacttagtgttttttaaaaatcagcttacctttaaaatttaagtgtgtgatttaccctcttctttagccatatttgagaaatcagggtctgatatactagtcaaatacccgcacacatatacatatacacatacacatgtgcaca

SEQ ID NO: 1965 - DNA, 1175 bp, Homo sapiens
gggaggctgaggcaggagaatttcttgaacccaggagacagaggttgcagtgagctgagatggcaccactgtactccagcctgggtgactgagcaagagcgaggctccatctcaaaaaaaaaaaaaaaaagaaaaagaaaaagtaatagaggagttcagaagcagagacagattactcttggctggtaagtagcatgagtgataaatttaagctgaatgattatggagcccaaatgaaataacttgtgtgaaatgttcttaaaataatatggtgttatataaatgtaactgatgttttaccaaacaaaatggagcagggtgctttgggtgaaagaaggggggcctgttttgatctgctgatggcataattattataatgtattaaagaatgtctcagaactgtagttgtcctaatagtactgcttgaaactttcaaattgttactgctttcagttgctttccgaagtggggataatggtggatctgatctcttctgttttgttcttgcagctctattatcaagtcctaaattttggaatgattgtctcatcggcactaatgatctggaaggggttaatggtaataactggaagtgaaagtccgattgtagtggtgctcaggtaacagtttttcctttcaaggcatggaattgcatggcattacttgggagaaaaattgagatatgaaataactggcatatcattctcttagaaactactcttttccagaaaagggcctggaagaaaattagtcactacttatcagttgtaagaaattctcaggctgggcacggtggcttatgcctgtaatcccaccaatttgggatgctgaggccggtggattacttgagctatggaatttgagactagcttgggcaacgtggtgaaaccctgtctccacaaaaaatacaaaaattagcgggtgtggtggcatggacctgtagtctcagctactcgggaggctgaggtgggaggatcacctaagccctagaggttgaggcctgcagtgagttgtgattgcaccactgcacttcagcctgggtgacagagcgagaccctgtctccaaaaaaaaaaaaaaaaagagagaaaagaaattcttactttgttaggcatttccattcagaactccaaagggctcatgacctttctacaaaaaagttaccatgttaaggttt

SEQ ID NO: 1966 - DNA, 1212 bp, Homo sapiens
accatgttttgtttatccatttgtcagctgatggacctttgggttggtttccccttttggcttcatgaataatgaataatatgaataatgctgctgaagaacattcatgtacaagttatcatgtggacatgttttcagttgctttggatacctaggagtagaatagctgggtcaaatagtaactctgtagggaggggaacatcacacactggggcctgtcagcgggtggggggctaggggagggatagcattaggagaaatacctaatgtagaagacgggttgatgggtgcagcaaaccaccatggcacgtgtatacctatgtaacaaacctgcacattctgcacatgtatccccaaacttaaaatataattttaaaagaggaaaaaaagtagtaactctgattaactttttgagaaactgtcagactattttccaaagtgactgcagcgtttttacatccccaccagcagtgtatctaggttttgatttctgtacacccttgccaacacttgttattgtctttttgattgtaaccatccttatgggtgtgaaatggtatcttgtttccctgatggttaacggtgttgatcatgtgcttattggactccaacttttttttttttttgagacagtcttactctgttgaccaggctggagtgcagtggcgctatctcagctcactgcaacctccgccaccccgggttcaagcacttctcccacctcagcctcctgaatagctgggattacagacgcccaccaccattcctggctaatttttgtatttttagtagagacggggtttcaccattttggtcaggctggtcttgaactcctgacctcaggtgatccaccgacctcagcctcccaaagtgctgggattacagacgtgagccactgctcccggcctggactccatcttctttggagaaatgtctgttcagataatttgcccacttctgaattgggttatttgacatcttataattgagttgtaagagttttttatatcttctgaatacaagttacttgtcagatttgcaaatattttctcccattctgtggatgttaatttttttagtaaattctcaagatacctatgttccattttattgaactctactacagagttttacaatattattttatgttttgtattatttttgcttttacttgataatgtaaaaagcctatatatggttatttatataata

SEQ ID NO: 1967 - DNA, 1192 bp, Homo sapiens
caccccagataggcacccactgcgttcaagatgaagtccaaactccaaaatgtagcctacaagggtctccatggtctgtacactgcttacctctctgtcctcatctcccatcatgccctgctttgttctctgtgctccagctggcagccaaattatgatgtccattatacagggagatataaaaatataaagggaaaggaaatgtgaggctagagaattgggagaaatagagtcttgttctttcagatactaaaatgcactaaaaagctgtaacaagcaggggtgttactgctagattggtaaactagaatataaaaaccagaaacaggccgggcacggtggctcatgcctgtaatcccaccactttgggagactgaggcgggcggatcacaaggtcaggagttcgagacaagcctggccaacatggcgaaaccctgtctctattaaaaatactaaaattagccgggcatggtggtgagcacctgtaatcccagctactcaggaggctgagacaggagaggttgcagtgagctgagatcgtgccattgcactccagcctgggcaacaagagcaagactctgtctcaaaaaaaaaaaaaacagacttggatatatttaagaatttagtagatgatcggctgggcagggtggctcacgcctgtaatctctgcactttgggaggctgaggttggtggatcacctgaggtcaggagttcgagaccagcctggccaacatgatgaaaccccgtctctactaaaaaaaatacaaaaaattagctgggcgtggtggcgcatgcctgtcatcccagctacttgggaggctgaggcaggataatcactggaacccgggaggcgaaggttgcagtgagctgagatcgagccactgcactccagcctgggcaacaagagcaaaactccatctcaaaaagtaaaaaaaaaaaaaaaagaatttagcatatgattacatggcattttaaatcaacacgggaaaaagtggacttttcagtgactagagttgtgatagttggttgactagctggaaagaaagttaagctacgttccaatctcatgtcctacccgcaaaatgaactccaatgaattaaagacttaaatgtgaaaaagtagggctacgtaagtactaaaaaataaaagtggacatacataattggatgacgaagtcattataaactaac

SEQ ID NO: 1968 - DNA, 1190 bp, Homo sapiens
aaatagcccaaagaggtgtgtgtgtgtgtgtgtgtgtgtgtgtgtgtgtgtgtgtattttttaaagccagtagagaccaggcgcagtggctcacgcctgtaatcccagcactttgggagactgaggcaggcagattgcttgaggcaggcagattccttaagtccaggagttcacgaccagcctgggcaacatgacaaaaccgtgtctctaggaaaaatccaaaaattagctcgtatggtggtgcgtgcctgtagtctcagctactcagggggctgaagtgggaggatcactggagccccggaggttgaggctgcagtgagctgagattgcaccagcacactccagcatgagtgaccctctatcaaaaaaaaagaaaaaaggaaaaaaaaagtcacaagagagtaatataataaggaggaggggaaagatcctatgtccatagagaaaagaatggaaaagcgatcagtaagccagaccgaaagatgggtgggttttggatagtctggaatccctggatgatgaggtgtctttgaggaatgcacatttacagtttggctgcagaatggggtataagaagattaattgtggctggaaaagaacatcggtgaatacggagaatggtgatggcccggcagaagagttgctggtgtggcatggcctatagaggcactgtggtagagtggaaagagatagtattctggctctgcttattagctgggtgaccttggtcatgaagttctgtggctctttgctttatatatctatacagtagagataggatgcttcgcagaattaagattatgatgaagagagaaagcctaggtgatacaggcacacatgtatttcactctcaatacaaaaagaacaacaaaaacgttgttttgttttgtagaacagagcttttgagcaaaagaatgatgtcactattgctttgaaacagttgtttctgatagattggggggtagtgaaggccctagggtaattgccccataacaagagtggctgtaagagtccaggtaattcagtcaaagtctgaactagaccagtgcctgtaggatttgaaataaggagctgaatgggggaagcattgcaaacacgaagtcaacatgttcagaatgttctgagcaagggaagtggtattgctagggataacagtggtttcataaatggaaataggtttggcattgctg

SEQ ID NO: 1969 - DNA, 1150 bp, Homo sapiens
gtaagtgctagatctgtagttatctagagaacagaaaaaacagtgtattggttaggcaataagttttaaacagaaagtttcttatataatgtgtacatggtttgatggaagaaagttccccttgcttcttatcactttctttaaaaaggctcaaaaagtcctcagaatttgagtctccagtgatactaaatgctcccgactttgttaccaggccatgtgcatgttgctgtggccccgacataagcaatttgtcttcagtcactgtagtacttccagccagttgtcattctagagtcttcaggtactcatttaagaatgcaagccataggttatcagaatgtatttgacagtatgtatttttcttttgtccccagagttggcaatgatgagaacatgtcaaacacctggaaattcctgtctcattcaacagactcactaaataaaatcagcaaggtcaatgagtcaacagaatcacttactgatgagggtaagaggaagttatggcctttattttatgcctctgtagggactgtgtgtgtgtcattacctagaacataagtcttaatggagtgacagtacctgcctcttctgtatcccgtgaagattctctaaattgtcagtaaagtgtccagtgctttgtcatgactgcgtaatcagactcatccagcagctgtcaagtgaaggatgtcatttatttcgatgtgggcctactctttagtacaaatcttttccttcccttagacttttttacatgtacagttctagctcacagagcaattgtaagcctgctctcttaaatatgaaaaggtaccaggtcccttccaattcttaacttcgtgtagatagaagtcatgtcttaatcatgtttgatttatgtcatgtttattactgttaacctaagtctcgaatgtagagtctgtcactcctgaacaggatattgatttttttctggtactagaatatgatctctgtgaatatcccctgtattcatgtgtcttatgaaatcaactatcatcttgaggaaagtccaacataggcttattttacaggtcacaaacctgattctgatattgattttttgatatattgaggagtaggtacagacatgaatgaaggacaactactgggagactttgagattgagtccaaa

SEQ ID NO: 1970 - DNA, 1200 bp, Homo sapiens
tctctagtttacaggaaattcactgagatacagatgatgagcgatggggtgggggttcaccccgggcatggtttggggctcaatggctgaggcatctatccaggctgctgcttcacacctgcctaagctgcctccttgaacctggatagggtccttccaaggcaagtggctagtcacgacctcaggtgcaatatggaattgaggtttctaccaggaggtgttatgttgtttcccgaagtactaatacttgcatccttggagagagagaaagacagcagaaaggggtgggagagtggattaaagggccaggaccagggccaaaaaaggccccattaacccgcagccaaatgtccacctgaggctgggtaagcagcttattaactgataagaggacagtatgaagctgttagcttagggagtttgacactcactggtttgtgggaaggcaggaggctctcaggtgattgagggaactgaagaataatctgtcaagggctttctgcaggtccctgggatggggactccctaaggttcccagcagccctaggtctccttatattctgactttaaaatgtatgatagtgactaagagcatgtggcttggaagccagacaaacctgtgaccctccttagaactctagcagggtctgtgaatctcagttttctcatgtgtgaaaaacagaatgataatatcgatttaaaggggctgctgtgtggactactgattgtcataatatggatggtaacaatgatacaatttgctactatttggttgagcagtgtgttctgggttctggattccaagttctggtttctggttttttttttgtttttgttttttttttttgagacagacagagtctcactctgtcacccaggctggagtgcagtggcacgatctcggctcactgcaagctccgcctccaaggtacacgccattctcctgcctcagcctcctgagtagctgggactacaggcacccgccaccacgcccagctaattttttgtatttttagtagagacagggtttcacaatgttagccaggatggtcttgatctcctgacctcgtgatccgcccgccttggcctcccaaagtgctaggattacaggcgtgagccaccatgctcagcctctggtttctgttttatgtccattatttcagttaatccaatgagcagcccaagccttcaagattttat

SEQ ID NO: 1971 - DNA, 1101 bp, Homo sapiens
aattaaaaagtaaattttaatgtcgaaaatgcaaacttggggagggcagaaagatcacacacaaggctgtcacttcatacttgcaggattgcacagcagccgggcagaggcgctcctcacttcccagatggggcggcgggcagcagagacgcacctcacttcctagacagtgcggcagccaggcacaggcacacctcacttcccagacagttgggcggccaggcaagcgctcctcacttcccagatggggcggctcccgggaagcggggctcctcacttcccagacagggtggccaggcagaggtgctcctcacttcccagaacaattctttatgaatttgataaaggactgaagtgcaactgaaagctgctagtgatgatctggtaatatacaatttgtccagtagccagtttgtttttattgtgttttctaaccataagagatcattaaaggcaaagcctgtatgacgctgtacacacacaaaaaaatggtcaccgcaggccatactaccaatgaaatggtaggtaaacaaatcttctggtcaagagaaaaaaaaaagaaatagcactctgcatgctttgctctacaagacgaatttccctagaaagaatccaatgaaggccgggcatagtggctcactcctgtaatcccagcactttggaggccgaggcgggtagatcacctgaggttaggagttcaagaccagcctggccaacatggtgaaaccccttctctactaaaaatgcaaaaattagctgggtgtggtggcgggcgcctgtaatcccagctactcgggaggctgaggtgggagaattgcttgaacccaggagacggaggttgcagtgagccgagatcacgcctctgcactccagcctgggcaacaagagtgagactccgtctccaaaaaaagaaaaggaatccagtgaaaatggctgcaattacaacaagaagtgaaggaagaagactggtgacatctctgaaggatgcagttgaggttgatccaggtttatccgaatatgctacctttctgagccttaaaccttcatctctcaggtgttgatttgcttctgatagcttcatcatttctccctgaagtcttt

SEQ ID NO: 1972 - DNA, 1379 bp, Homo sapiens
taagaatctcattttagtgaacatctgaattatgatctagaggctagtagatcaaattaattgttgaggggaatgagttttatttgtagcttagccagtccctcctaacatctcttcctttatttcttagtatataagctagagatgatcttgccatctcctaaaaatataagacagtaatatgtgaaaagcatttggtactttgaggataagatgcccaattaatatcacattggccatattataatatattcatgggtgtccagaggaacaactaagccatatgctattatctttgttctagaattaaaagtttttgttactcctcacccaaaggcatagcgaatagactgagatattacgttgtaacatctttaacatgaattaatcattgcgcctcagtgagaagacaagtgtgacattttctggatggacagtttacatggcatcaaatattacattatcctatgatgaaagagagcatatgaagggaagcactccttcaaacatggcaaaatcagcaatttcttacatttgagtaaccagccaattttacagtctctcagcagtcttcttattcctcacatagacttgagagcaggatagaaggaagtagagtatcatgagttaagtattgaaaaaagtcagttgaatttctgtactataaattgctttgaacagctgataccttattttgagtacataaattcactttgttttgctctacgcttcattgtttatacatatgccttctctgtatgcaactagctggatttttctgacccagaagcatattcctgtgaaatagtactgtttgttaacttctctatttctgagctagccagcttgatgcccgaaaatctgcagttgctgggtttttgctgctcctgaagaactttaaagttttaggcagcctgtcatcctctcagtgcagtcagtctctcagtgtcagtcaggtaaggattatttacgttaacttgcagtgtgtgcgtatcattcatgtgcatcgatgaaatgcacgctgttttcttttattcctgttatggttgtaagaatgatcctagaactaaagagtctgatgatgatgatggtgctgatgatgatgatgatgatgatattggctaacactcattaatggcagatttactgtatgctaaactgtgctatccagtatggtagccactgtcctcagtgtggctattgaatggaacatttgattgaaatgtggctagtccacattgtgttgtgctatacatgcaaaattcataccagattttgaaataaaagaatgtaaaaatctaataatttttaatattgattacatcttcagagagaattttgtatgtgttgggttacagaaaacattaaaatttgacttt

SEQ ID NO: 1973 - DNA, 1233 bp, Homo sapiens
agtggggaaagcatgactaacaaaggctttgatgagaagatagagtcttttttttccttctttttatttccactgccttggagcaggtttatcacgttagagcattaattctttccccttctagggcactgcatcagagcatgggggacagaacaaagaaccagccaagaagaaaaggaaaaaataaatgaaatgcctgagttaatgtgaactttggggcttctgcttcatttttacccaacaagcaacaatgccccttgtcctgtagtccacaccgatgttggcatcttggttctgaacccactgaattcaactgcaccttcagttagaaggaatcttcttggcaggtcctgctactgaaaaatggctggccttaggcaagcccttttgcaaaaagcacagctgaaagcctgagtttgggagcctgcaccaccccgatgaagctccacgggagcaaatacagagcctccaggcagtgctatggtccaggctggcttcgtttttccaaggagcctttggtgagttcaattatctggtaaatatccagcgcttcacctgaaagatagtgcaaattggttaggatgccacctcaagaactgtaactgagagctcagaagtgagcaaaggagcttaatgctaaggtcaaaaggagagtgaaaggttgagaacaattgccacgaacggtaatgttacatgttaggagggtctgttttctttttatataagtgtgtcttagatatattttaaatagaaaataagctttctgatttacttgtttggtatttaaagcacagtttgtttttctgtcacctatagagtgcaagaatgcactctatagaataaattatctttaaacatttcttctgtggttgaagtaggggacaggtacaggtagaatatttgaagctctgctgccttcatttctgaaacatcatatcacattcactctggacacagggcaccttataaactgaaattagcctagaatatagcctgagtcaagagtggattctctggggccccaagtttcctgttctccaagacccactttctagtccacctcagatcctatgtgtaatgaggaacaaatgtgttgtgctcaccctggggaatcccgtatctcctttccatcccagttgggttggaaggggttttacaatccatggtcacttccttcctgaggcaccggtcaatatcgactgcactgaaaaaggcgactgactggggcaagtc

SEQ ID NO: 1974 - DNA, 1226 bp, Homo sapiens
tgcgccccgccgcccgcctgcgcccggcagaggcgccgcggtgcgccctgggactagccgccgccctgctccgggcctcgctccctgactggagagggaggggccgcgccgtcgctcagcgacccggcctccccgccgccgaccccgccggaaacctcggtcctcacggtgcttcccggtctgctgctcccccgaccccaggcccacggcacggcgtcccccttcgcgcggcctacgcagcctcggggtagcgtgtggcctccacccggccggtccgcttcgctggcagccgcaacttcccgtctgcacccagctaggtcccgcggctacccgagaggcaagcgggagactcccagcgcgaccaataggagggccgccaatggagcggtccgcccgcggggggagaagggggacttctgggtgggctctccctgcggaacgcgcgaaccaaaggccaacctccccttctcaaggagcaggtggattggtcccgagctagctggtgggcggaggtgacgtttttataagttgctcaagagacggtaacaaccgacgggccgcgtggcctaatggataaggcgtctgacttcggatcagaagattgcaggttcgagtcctgccgcggtcgaagggaggttatgattaacttttagtttattcctccctcaggaacgaagtattgggacaatgtgaacgtagtcgccgccgattcccaccgcacttcaaagatgtgggaacgccaagatccgcggaagtaaccacgcccagcaagtccctgcgagattgcccgcctacgtgtctcagcggaggcacatttctaaaatgtaccaggtctctcgcaccccgacgcaggtggaggaaagtggagagggaggggcatcctgtacagaaatctcaatttatactcaattgatggttggcaagagttggggctcgcagccaaagcgaggctccctccctcgcccatccggtgctgcctcctcgtccagagcaattctgaggggtaaaaatgttgccttccgttgaacctgaatttgcccgcagatgctagcctccggcccacagcgcggctggagcttgtccccttccccagctgtttccagtctccgcatccgtcttgtgttgctccaggtgcttcaacagctctcagcgctcggtggttggtgaactgtggtaaagtgcacgcagaataaggtctacgtgattaagcaccgcctgggggttgg

SEQ ID NO: 1975 - DNA, 1221 bp, Homo sapiens
agccaggcatggtggcacatgcctgtaggcccagctattcaggagtctaaggcagggagattgcttgagcccagtaggtcaaagctgcaatgagctatggtcgtgccactgcactccagcctgggtgacaaagcaagacttcatctcttaagtgaattaatgaatgaataaatgaatgaataacaagttttttgaaaaagatgatgaccatcatggagccaggaggtggagtagtcgccccttatctgcagaagatatgttccaagacccccagtggatgcctgaaaccacagatagtactgaaccctatatatagtactgttttttcctatgcatgcataagttcaatttgtaaattaggcacagtaagagattaacaacaatagtaaaatagaacaattatagcaatataatataataaaagttatgtgaatgtggtcttcctctcaaaatatcttattgtactatattcacccattttggggccatggttgactatgggaaactgaaaccatggaaagtgaaatcacagataatggggtactattgttgtttttttcatggcagttgatataaggacttgaggtttttattggttgaaaaaaaaataaacctagctggaatctgtttactaagtagaattaatgtctcgctgaggaaaaaagggagactaaaaacacaatgaaacttttcaactgcatgaactatctgagaagagttaaaattcaataagaactatctttagaagcattaattattataatagtggtttgttctgtttctagatatttgtagcagtcctttggaattggaggtgggatttcttttaaatggttaatggtgttcactttcttatactttgtgaataaaatgcatatcttatatatctcacaatcctgattgaagattggaaaatccgaaagtgaatggccaaaagttgccaggcctttattctcactagattttacaatgatttgcagatctttctagcacactttgaaactttggttttagattggacaagacagttttcttctctaagatcagaattaacgcctgggcgcagtggttcatgcctataatgccagaactttgggaggccaaggcaggaggaatcacttgagcccaggagttggagaccagcctaagcaacatagtgagaccttggctctacaaaaaatttaaaaattaggtatggtggtgcactcctgtagtcccagc

SEQ ID NO: 1976 - DNA, 1170 bp, Homo sapiens
caggccgccgtgcttggcctggtctccgaaaatgagctctttggagctaccataagcgccgaggccttctacccggacctggggcccgagctttcaggggcagccatgggagagcccgagccaccaggccccgacgtctaccagctggcctgcaacgggagggccttggaggagccggcggaggaggaggtgctggaggtggaggcagcctgtgagaagcacacccggcggaagacgcggccacctgtgcggttggtgcccaaggtcaagttcgagaaggtggaggaggaggaacaggaggtctatgaggtttctgtgccaggtgacgacaaggacgcagggccagcagaagcccccgccgaggcggccagtggcggctgcgacgccctggtgcagagcagcgccgtcaagatgatcgacctcagcgccttcagccgcaagccccggacgctccggcatctgccccgaaccccgaggccggagctgaacgtggccccatatgaccctcacttcccggccccggcccgggatggcttccccgagcccagcatggcgctgcctgggccagaggccttgcccacagagtgtgggttcgagccaccccacctggcccccctgagtgaccccgaggcccccagcatggagtccccggagcctgtcaagccggaacagggcttcgtgtggcaggaggccagtgagttcgaggctgacacggcgggttcgaccgtggaacgccacaagaaggcccagctggatcggctggacatcaacgtgcagattgacgactcctatctggtggaggcgggcgaccgccagaagcgctggcagtgccgcatgtgcgagaagtcctacacgtccaagtacaacctggtgacgcacatcctgggccacaacggcatcaagccacactcgtgcccacactgcagcaagctcttcaagcagcccagccacctgcagacgcacctgctgacgcaccagggcacccggccccacaagtgccaggtatgccacaaggccttcacgcagaccagccacctcaagcgccacatgctgctgcactcggaggtcaagccctacagctgccacttctgcggccgcggcttcgcctaccccagcgagctcaaggcccacgaagtgaagcatgagagtggccgctgccatgtctgcgtc

SEQ ID NO: 1977 - DNA, 1538 bp, Homo sapiens
ccaccatgccaggcctcaacccctcttctttatcataggtattgcgagttagatgttctgataggagacttcttcacaacttgcaaacctgctccttcttcccgtaggtatttacatgaggaatttccagagtcctggtcagttcccaggttggctgaaggctttgatgtcagcactgatgtgatccgaagagttttaaaaagcaagtttttacccacattggagcagaagctgaagcaggatcaaaaagtccttaagaaagctgggcttgcccactcgctgcagcacctccggggctctggaaatacctcaaagctgctccctgcaggccactctgtatcaggctctttgcttatgccagggcatgaagcctcatctaaagacccaaatcacagcacagctttgaaagtgatagagtcagacactcacaggacaaatacaccaaggagaaggaagggaagaaataaagaaatccaggacctggaggagagctttgtgcctgttgctgcacccctaggtcatccaagagagctgcagaagtactccagtgattctgagagccccagaggaactggcagtggtgcgttgccaagtggtcagaagctggaggagttgaaggcagaggagccagataacttcagcagcaaagtagtgcagaggggccgagagttctttgacagcaacgggaacttcctgtacagaatttgagtcggggcttggcttatggagatgcctcgtgaaacacagctgggcaagtattaatgtatatggaacagcctggatttctgcatatggataagccaccttggaataggaagaggtgttgagcctggactgtgggaggaaagagctgcgtggatagattcaaacttcctgtggtagtgctcccagtctgacctctgtagaccttcagtactcactcttcttgcttaggctctctgtgtgttgaaagccatcccgtgttgcatgtgttgttacaattttctgtgatacttgcaatttatgtttgagaagaagtgaaaagtttgccttctgacctcatttccttcttgatcagtgaacactaacattttggggacaacttagtcaattggttttccttacaacaaaataaagtaaaatgtagcagtctgcctctttggtgctctttggggtgggatggtttacctgtgaaccttggagagagggaaggacaaaggcagaaaggaaggatccctggtcagtaaacattgggagagagatggaaccagaggaatttcccagcaaagggctctgtgcagagcatcctgcttagtgagggattctgacaactgaaaactggacgcctttcttttagttgctggggttctggcagagattgggaaatgaggggttggcagaaaatacaaagcaggcaaaggctttagggcccttataatctccagccacattttaaagtttatattaagagctgggcatggcagaatgtgcctacagtcccagttacttgggaggccgaggtgggagaatcgcttgagcctcggaggttgaggctgcag

SEQ ID NO: 1978 - DNA, 1576 bp, Homo sapiens
ggctcactgcaacctctgcctcccaggttcaagcgattctcctgcctcagcctccggagtagctgggattacagatgcatgtcaccatgcccagctaattttatatgttaagtagagacggggtttcaccatgttggccaggcgggtcttgacctcctgacctcaggtgatccacctgccttggcctcccaaagtgctgggattacaggcgagagccacctcacctggccacctatcactttgattttcatgttgtttggctatggtaaaatgtgagctctcgaagggcaatgtgagatttgctttgtggccctgccaatcccctccctcctccctgtcttcctgcccacccccccccactcccccgccagccatgagcagggaatatttcaatgctattgctgagagtggaggtaaccctttctatagttttcttttgtttctacctcatgactagatgattcactgcttgaacatgctccacacatccgttctttctcactccaaaattgaggtcatcaccaagccccattaattttacctcccagattcctctcgaacctatctgtcaaatctgtccatcttcactgccacccttcagtaccaaatgaccagtctcttacctgaattcctgtagcagcctccaaactgatcttcctgatatgatttttgctctgaaaaaactggtttcactcacagaaaccagagtgaacttttaaaatcctaaatcgaatcacatcacttctcagcagctttccattgcttttagaatgaagacccaaatccttacccaggcctaagaggcccttgtggttttgtcccctccccctccatcctcttgtgatatccccttccctctcccttgcctcacctcagcactcttgagttctctgctccttggtcatgccaaggttgtgtgctctttagacccttggtactaactgttccctctgcccagaatgttcctcgcccagtcctttgtgttgcctcctatttgtcaaccaggtttcagcctaaacctatctccttaggaagactttccctaactatcccatctaaattagtcaccctccatcacattatcctcttttttcatcaaagtccttacacctgtctggcaatttcttattaattgatttgtttttggtaaactccacgaaaggtgggagtcatttctcttgtttccattctttccacagcacttagaacagtgcctggcacatggtaggtgctcaatatgtgtttactggatgaattaatgagtgcatgctcatgggcaaggatctcattgtgctggaaaagcagcagagtgagacaaaactggacaggtgagtgaaggtcacaccaagaaggttcttagctgccaaactaaagggtttggatcttactctctggagaaaagggtgtagctagtggttttataggagaggagaggcgcgatccgcacttgagaaggtcaatttggccgctgtgtgtaggtcatattacggagaaaaaaactaaaggctttgagacaatccatgatgtaaagggcttagcacagtgcccagcacgcagtaggtctccagcgagtcgt

SEQ ID NO: 1979 - DNA, 1201 bp, Homo sapiens
gcacctcgatgcctgctctgacctgacccagagggcgaggccctccagcgggggacattcccaggctgagtggaccccacggctctctcccacgcctggattacgacatgaagtttttaccacaagcccgagggcaggcttgagttaggcagactgaaggctaattttcattttctcccagctggtttctgctgcttcagaaaagtacaccttttccttatggaccagaggaagaggaagaccattttatcagtcactgaaaagagtcccctggcactgatgagcctgaagagaactgtgctcctcctcgggggctggggaaggaagacagggactgcaggtgtctcatactcagtggcctccagacaaactccagacaagcacagacctccccactaagagcagccagagggagctggtgaggccctaaccccacccaccgagcaactgagcttccccatccctccccagagctgtgtctctgtgggctgggagtctaatgtcacccccctagaccgtaagctccttgagggcagggacagtgccttatcattgttgaacccgtagcacctaacacgtgcgtggcagcacagtcgtgtgctggagtgagtgctgcagaaccgtgcgtgcagcgcatgatgaatgagtgcgtccgccatgccgtaaggcaggctcacctgtagctatccccttccctgccagatcttctcagagctttagcttttctagcactcgtgcctatggtgaagcatgcactttaatatgcttttaacactaggtgaccaaatcacagtgaagccgggcactgcattctccttgggctgtgctccacgcgggtgggtgggagctgtcttctgagtacatccggaagggctgagcaggtgagtgccctgagcatcctggctgggccccacccaggaagatcttccttctcagatccacgtttggctctaaattgcttcaagtagagattcattctttgaggttgaaaaaatagtttatagtaaaacgaaggcctaattcatggaagcatcattagtcatcaataccttctcataaaatagatgggccagatttccaccaccgcctgcctcctctaacttgggtgatgccagtaggtttgaagggggcagagcactgcagggggaggggggggtctaggctgtgagaggacagggtggagaggaggagaaccctgaag

SEQ ID NO: 1980 - DNA, 1157 bp, Homo sapiens
gggaggcaagaggggtggagactgcttcccatcctaccctcgggcccacctggccacctgaggtgggcccaggaccagctggggcgtggggagggccgtaccccaccctcagcaccccttccatgtggagaaaggagtgaaacctttagggcagcttgccccggccccggccccagccagagttcctgcggagtgaagaggggcagcccttgcttgttgggattcctgacccaggccgcagctcttgcccttccctgtccctctaaagcaataatggtcccatccaggcagtcgggggctggcctaggagatatctgagggaggaggccacctctccaagggcttctgcaccctccaccctgtcccccagctctggtgagtcttggcggcagcagccatcataggaagggaccaaggcaaggcaggtgcctccaggtgtgcacgtggcatgtggcctgtggcctgtgtcccatgacccacccctgtgctccgtgcctccaccaccactggccaccaggctggcgcagccaaggccgaagctctggctgaaccctgtgctggtgtcctgaccaccctcccctctcttgcacccgcctctcccgtcagggcccaagtccctgttttctgagcccgggctgcctgggctgttggcactcacagacctggagcccctgggtgggtggtggggaggggcgctggcccagccggcctctctggcctcccacccgatgctgctttcccctgtggggatctcaggggctgtttgaggatatattttcactttgtgattatttcactttagatgctgatgatttgtttttgtatttttaatgggggtagcagctggactacccacgttctcacacccaccgtccgccctgctcctccctggctgccctggccctgaggtgtgggggctgcagcatgttgctgaggagtgaggaatagttgagccccaagtcctgaagaggcgggccagccaggcgggctcaaggaaagggggtcccagtgggaggggcaggctgacatctgtgtttcaagtggggctcgccatgccgggggttcataggtcactggctctccaagtgccagaggtgggcaggtggtggcactgagcccccccaacactgtgccctggtggagaaagcactgacctg

SEQ ID NO: 1981 - DNA, 1177 bp, Homo sapiens
ctggcccaggctcacgctgggcagagctgggaagggaagcccaggcaggaagaccccaaaccaagctggtgcctcctcctccaggccacaggcccccaacccgctcctgaagcagggagagccatggaatagtcgaggttgctggtccctttagcacactggggcgatggaaagggaggggtcacaggggcagggtctggggacatctgcagcctggaatcccagggaagagaggaacttcccaatacaagcagcctgggcagagcctcctctctaggacatcccagtgattaaactcgaaacacaacagtaggggggcccaggctgggcgccactcaccgagaacttggggcggaagattcctgagatgtggctcttaaggatctccagcgtgggtgtccttcccccctctcgctcctgctcctgaggccagggacagacgtcagcgggtggccaggcttagggagggggagggcgaaaatgaggagcgcagccccaggtgggcaggccggtggcgggcagcggccgcggatggggcagctcaccgaggacgacgtggagtggcggtcatcctgcaggagcagcacaggcgggggctcgccggggcccaggtgctccagcttggtctgcagcaactcctgctgggcctgcagcttggcctggctgcacagcgctacctgcagcccctgcagtgcttcttgcagcacttgcctcttgcccagcagctgcaccctgcaggcaggggcgggtgggagggtggatgagaataagggctcggtctgcggcgggtagccagcagcagttagggtaggtaggagggagggaggcccaggaggctgctgcaggcaggggcccactcaccgctcccgggggtgggtgttctcctcttcattccggagctcctgttgcagctgcgtaaccatctcctgccgcctgaacaccatctcggtggccacagccagctcatctgtcactgaggtcagcctgcacccaagagaagggcagcattagaaccgagccctcctgccccctcaacccaggtccagtgcatccctgtagagccaagcaagcccggccacctggtgacagctctgtgtggacagtctccacgacctagccctgcctacataaacactcgtggtctgctgggagccccgccgcagcccaggtgcaaagc

SEQ ID NO: 1982 - DNA, 1184 bp, Homo sapiens
cttctgctgcggtcggggccggagtctgggctggagccaccgcaggcctccctctgggtcctccgccgcgagctccctgcaggtctctgcggggacagcttaggtgcgcccggagcttgcctgcacctgcgatccagagccaagcgccccgcccctgcccgggcgcgctccctccttagccctgcccctctctgaccccacctccgacgcaagagtggggcggggcagctgccggtggcgtcccgaacccagactcgccccgccccagagactgcgcctgcgcgggcacgagacaacctctccgcgatgactgtgagtggtccagggacccccgagccccggccggccacccccggggtgcgtacccaacccccgcgccatcaccccttcgcacccgccctgaccatccctggcctccttctccccatccatgaggctcgccccgatccctcctctcctctccccttagctcccgggctctgccccgaaccccctccgacgtttccgccccctttctctctacaggccagctcagtggagcagctgcggaaggagggcaatgagctgttcaaatgtggagactacgggggcgccctggcggcctacactcaggccctgggtctggacgcgacgccccaggaccaggccgttctgcaccggaaccgggccgcctgccacctcaagctggtgagggagcctggcgctcttcccctcgcccgcccgggccccggttcgcccatctaagctgatgcttgggccccagctggacattcacgctcccaggccatccccgcttgccagatgttttttgcacctcagggtggtgggggatcgggtgaccttggagagcgagagtacccctgctgcctggttagtgccccgagagggagatgaccattccttcaggctcctgtctttctcttacaggaagattacgacaaagcagaaacagaggcatccaaaggtaggggaatggtgggccctggtgtggagctgtagggcttctgtggtgggcaaggactctgggaccgctgcaccgtcacattctcctcctttggccccagagacacatctgccttctttctttcccactgcctcgggcctttccttttctgcagctaccctcaccttttctgaggctgaagcaccgagccccacattcgtcccccccaccttcttctggc

SEQ ID NO: 1983 - DNA, 1124 bp, Homo sapiens
tttctggtctcagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagagtaagtgtgaacgtgaacgcaaattgggaaaagacgaagaaagtaatctgagcagcccatagtctctgccggggaccagggtttgtggaacagggagccggggaccggggcttgtggaacgggaagccggggaccggggcttgtggaacggggagccggggaccggggcttgtggaacggggagccggggaccggggcttgtggaacggggagcccgcggcagctctttagctctggctgtagagacacgggcctagattcccggccctgctgctgttgccatcccagacccgctctcttcctgagatttatcactgttgcttctgactttcacacagcaactgaagaacaaaaaacagacagagacagagatgctgtatggcagcgctcctcgaacacctagcaagcggcgaggactggctcccaatacaccgggcaaagcacgtaaggtaaacacaaggcttagggaaacactgatttcaagggagtgggtgagggtagtcccagccacctctttgaagggggccagcccctccacacctgtgggtatttctcatcaggtgggacaagagacagagaaaagaaataagacacaaagtatagagaaagaacagtgggcccaggggaccagcactcagcatacagaggacctgcaccagcaccggtctcttgagttccctcagtatttattgattactattttcactatcttggcaaggggaatgcggcaggaggacagggtgatagtggggagaaggtcagcaggaaaacgtgagcaaaggaatctgtgtcacaaataagttcaagggaaggtactgtgcctagatgtgcacgtaggccagatttatgcttctccccacccaaacatctcagtgtagtaaagagtaacagagcagcattgccgccagcgtatctcgcctccagccacagggcagttttctcctatctaagaatagaacgaaca

SEQ ID NO: 1984 - DNA, 1171 bp, Homo sapiens
cccacctcatcccattttttaagtgtaaatgcttttttttaagaggtgaaatcatttcctggttgtttattttttggtacaaccagaaagtagtgtgggatattgaattatgggaggctctgactgtctcgggtgtcagcttaacattccatagatggggggttagtttttatatcccataatacaaagcatattaaatggcaatatggagtcagtcctgcatttaatgtcttgaacattctaaattacttctattaccatgttgttttttagtagaattgtttcctaaagaaaaccactctttgatcatggcgctctctgtcagaattgtgtgtactctgtaacatctttggttgtggtagtcctgttttcctaataacttactgtgctgtgaaagattacaaatttgaacatgtagtgtacgtgctattgagttgtgaactggtgggccgtatgtaacagctgaccaacatgtgaagatactggtacttgataacctcttaaggaaaatttgcttccaaattttaagctggagagtcactggaataactttaaaaaagaattacaatacatggctttttagaatttcgttacgtatgttaagatttgtgtacaaattgaaatgtctgtactgatcctcaaccaataaaatctcaattatgaaaaaaataaaaataaaatgtggcctaaacaataaataaataaataaataccaatttctccaggaaatgcacatcaaaccccaccgcaatcacttcatacccattaggatggctctaatttttttttaatcagaaaataaaaaatgtcaacaaggatgtggagaaattaaaacccttgtgtactgctatgggaaaaagtatggcggttcctcaaaaaattaaacataagttccacttctgagtatatgcctaaaataattaaaagcagggactcaaatttttaaatgtttatttttttaattatttatttatttttaatttcaatagtttttgaaatagccaaaaggtggaagcaacccaaatatccttaaacagattaacggatttttaaaatgtggtctaagtaagtggaaaaagaaaatgtagcatatatacaccatggaacactactcagccataaaaaggaatgaaataatgtcttttgcggcaacttggatggagctggaggc

SEQ ID NO: 1985 - DNA, 1223 bp, Homo sapiens
tgacaaggttgtggtgactggtgccatgatgtttgacagtagagctgtgtgagagggagagcagctcccctcgccccgcccctgcagtgtgaatgtgtgaaacatcccctcaggctgaagccccccacccccaccagagacacactgggaaccgtcagagtcagctccttccccctcgcaatgcactgaaaggcccggccgactgctgctcgccgatccgtggggccccctgtgcccgccacacgcacgcacacactcttacacgagagcacactcgatccccctaggccagcggggacaccccagccacacagggaggcatccttggggcttggccccaggcagggcaaccccggggcgctgcttggcaccttagcagactgctggaaccttttggccagtaggtcgtgcccgcctggtgccttctggcctgtggcctccctgcccatgttcacctggctgctgtgggtaccagtgcaggtcccggttttcaggcacctgctcagctgcccgtctctggcctgggcccctgccccttccaccctgtgcttagaaagtcgaagtgcttggttctaaatgtctaaacagagaagagatccttgacttctgttcctctctctcctgcagatgcaagagctcctgggcaggggtgcctgggccccagggtgtggcaggagacccagtggatggggccagctggcctgccctgatcctctgcttcctcctcacaaccccaagagcccccagcccggtccatccacgtctggagtctggggagaggagcagggtcttaggactctcagctctgagcatccctggcagggtcttcaacctctaatctcttcccttaagccctgtggccacacagccaggagagacttgccgctggctcccgcctcatttcagcccagggtgctcatccaggggcccagaacagtcccacctgtgctgctgtgcccacagcacaaagccaggcttcactcccaaaagtgcagccaggccctggagggtgatcctgccagcagccctacagctccacaccctacccacccatcggcagcccctctgctgttccccagggacctctcatacactggccaggaggctgcagaacgtgtgtctccccctccctccaagaggtcctgctccctctgccagaaccgtgtgtgggcgggtgggagggcgctcggggcccggcccctccctctccctgctggttttag

SEQ ID NO: 1986 - DNA, 1252 bp, Homo sapiens
aatgtgttccagtgccaggtttcattccaagccaatgctttaagagattgtgccgcttttctattgcccgtgattgacaccaatgtgctagagatagatctatcatccttgggcccaaggagaagacaacttggagtacaattgcagcctaaaaataatgactatgtaatagaagtaagaaatacatgttttgttgtcatagccattgattttacggagtcaacagttactgtaccttaccatagcctatactgaccaataaactgaaaatttcctgtgttagtccatttgagctattataaaggaatacctgaggctgggtaatttataaaggaaagaggtaattggctcatcgttctgcaggctgtacaagcatggtgctggcatctgctcagcttctgtagaggcctcagggagcttttactcatgacggaggctaagtgggagcagacagtcagtcacatggcaagaaaagtagtgagagagagagaggggaggtgccacaaacttttaaacaacgagatctatcacttcttggccttttagctaagatcaagtgtagtatctgtttttatcagtttaatatatgatacatcttctatccaaggacaatatattaaatggatttttggagcagagagatggaatagaagcttgctccatccactccatgcatcgacctggtattgcagtacctccaggaacagtgcaccccctcgaggtattaaaaaaataaaataaaataaacaaccagatctcaggtgaactcagagcgagaactcactcatcaccaaggggatgacgcaaagccattcataagggatccatcccaatgacctaaacacctcccaccatgtcctgtcggtaacactgggaattccatttcaacatgaggtttggaagggacaaacatccaaaccatgctacctctctactcaaacataaaacatcatatttagaaaagtcattattgttgtggcataactatattctacattgatttgaaaaggcccctaattatagccagcaatcatatgatgagattaaattgaattgatgaacagattacataacaaaggggacaaaacatgttttgtgaaaacacactttcaatattgaacctaggccgggtgtggtggctcacgtctgtaatcccagcactttgggaagctgaggcaggcgaatcacttgaggtcaggagttcaaaaccagcctggtcaacatggagaatctctgtctctactaaaaatac

SEQ ID NO: 1987 - DNA, 1155 bp, Homo sapiens
cacagctcgactgtcacccagcagctaggggagcactgaagctcttaccaaagctactgtcatggtgacccttggggccgctgccctcactcagaggcattctcgttccccttcccctccccctcccttcacaccctcgctataagagtggctccagctcccccttgatgtgtattcaacgtagagattagcacacaactcttcctttgttcaccgggtatagttgatgccttaaggaaaaggaaacttcctgtatcattgcaaaggatagagagatgagagaaggcatccccacagagctcagtcctgcactgtcttcccctgtggctgtgggtctttttccgcttcctggagcgcgtacctgagctcatgcacctttactgacctgtgcggacctctcttcctcagggtttccctctgcccacatgtacctgtgccctgcatggcccacgcacaccttcccgtgtcaacgtcctccaacctttccctcctcagataagccatgtgaactctactgctcgcccctcgggaaggagtccccactgctggtggccgacagggtcctggacggtacaccctgcgggccctacgagactgatctctgcgtgcacggcaagtgccaggtgacgtacttctccttcggtccttggtggggctttggagaggagactcactctccccagacagggagtggggtagagcagaggtctcaggaggcctaggggagtggattttcttaggaaggcacccagtgatgccgcctcctgccgccagtgttgcctggtgcaccaaccctagctcagtaatgactgagtgctaggccaacaaggagtggaggtggaaagaacaggcacaacgtattctaagactttgaaaattgctttagacatcatgaccaagacgaaggtaggcagggtactaagatgcgcctaaaggatgtctgcacaagccaggccccatttagtgcagaagagacggcagaactgagccaatgcctgtgcaggtcacgccaggcagataggtgcgcccagctgtcagggagcatccatctactggtatatagtcccaaaggcattgagggctggatggccatgactggttagaacagtgataaaaaccatttaagtgaagaaagagaggccgggtgcggtggct

SEQ ID NO: 1988 - DNA, 1114 bp, Homo sapiens
gaccatgactgctctgaggacggaatggcacagaggccatgactgctgtaaggactgaatgggcacagaggccgtgactgctgtaaggactgaatggcacagagaccgtgactgctgtaaggactgaatgggcacagagaccgtgactgctgtaaggactgaatgggcacagaggctgtgactgctataaggactgaatggcacagaggctatgactgctataaggactgaatggcacagaggctatgactgctataaggactgaatggcacagagaccgtgactgctgtaaggactgaatggcacagagaccgtgactgctgtaaggactgaatggcgcagaggccgtgactgctgtaaggactgaatggcacagagaccgtgactgctgtaaggacagagtgggcacagaggccgtgactgctgtaaggacagaatgggacagaggctatgactgctataaggactgaatggcacagagaccatgactgctctaaggactgaatgggcacagagaccgtgactgctgtaaggactgaatgggcacagagaccgtgactgctgtaaggactgaatggcacagagaccgtgactgctgtaaggactgaatggcacagagaccgtgactgctgtgaggactgaatggcacagagaccgtgactgctataaggactgcatggcacagaggccgtgactgctgtaaggactgaatggcacagagaccgtgactgctgtaaggactgcatgaatgggcacagaggccgtgactgcttaaggactgcatgaatggctgctgctggggtttctttctgaaccatcggggaagctcccccaagtcccctttgtcccctcttgggtcctagtttgagccatgtgctggcactcagttattttaacgaaaccatatacatttttgacatgacagaggaatgatttgtatgttcttccccaactcttaaaaaaagaattaaaaaggatcttttagcccttttataaaatctttgctatgttcctcagaaggcttttaccaagatggttaagtatgtttccaatcttggagcaatagcagctgcatgttttgctgcaactggaggaaagtatatttcttgtggaa

SEQ ID NO: 1989 - DNA, 1226 bp, Homo sapiens
agagatttaccattttgactctgcataagaagggaaactagcagcaggtgcctgctgaaggagggcaaattgttttgatgctgtcaaaacaatactaatgttactcttaatatacccagggataagatacatttttccattagggatacaaatgtcattcccaacaatttcagtgttgcctcccaggtggacttttggggggatgatttttgaagtaacttaaaaaataattttaaaattaaaaatttgataatgaagtagttcatcttctctgaaagccaacatggaaaatggatgctgttgtatctgtctctgtacccctacccccaacgcagctgctctgtggtatgtttgtaagtcacacacaagctcactcttgggctcaggtaaatctgaccaatctgcaaagaaacgagcccagacctggaaaaccaaatcacagcaaggtggtcttgcctgcccctccggggggccatgggcgtgtgtgagtgaggatgaccgacatcgcgtttccttctcctttctggacaggttggcctcattcagcttgggcaggagcaggtgctaatccagcccctcaacaactcccagggcccattcagtggacgagaacatctgatcaggcgcaaatggtccttgacccccagcccttctgctgaggcccagagacctgagcagctctgcaaggttctaacaggtgagtcggggcagcagcatgaccagcttagaacacacgcacagcccacatcctttgtgtgtctccaagtgcactgaagccacatgagtgagaacttaccttcccctatatttcaaaagctgttttattgccctgagaccacttccttttcctttctatgtgtcttagtgtcggcagtcctttgaaaaagtcatcgttttgtttctgcaaggaacctaggatctctttcatgcagtccctcaattttatatatcaagagcaagttgaggtccaaaaaaccttgtagccgagcttggataagaattccctcctcctggtgccctggccaggagctcactcttaataatacagtgctcccgagttctggccgcagtaactaaagccacctggggcgcctctgaagctgtgattcgattctcgattcttacagtgtggcccccgggccagcagcatcagcatcacgtgggaacttgttagacatgcacattttcaggccagagctgtgaatcagaaaccctgggggagggtc

SEQ ID NO: 1990 - DNA, 1398 bp, Homo sapiens
ctcttctcgttttaattcccaagagttttagttgattcttgtttgtggatgctgcatcctcctgtttctctccaagacatcagtaatatttattctgaattcattctcgctctgctaacattaattctgtgtagagaggggccctggaggtgctggaaagctggagcctgagattctgcttagggaagctcccatgctaactcagtcttttcctccaagataaggatgaacagttgacaataccaagctgtgttgtgaatcaggaaagcccaaagctgtcttatctcagtgactgtgtgatttgtgtaggtttgccccgaacagtaatgtgaggatgcagcaagatgtgcaggccctctgacctggctagaccctgccttgcagagacattgtcactgtcagctgctcacttcctcctggggactctgaggcccaagggggacagtggtgaaatatgacacagcttctcccctaggtgatcagactgcttccaatgagcctgtgcccttggctacataaagaggaaacataaatattttctgtgtgtgtgtgtctgtgtgtgtctctttgtatgtgtgtctgtgtgtctgcatatctatgtgtgtgtctgtgtgtctttgtgcatgtgtgtttctgtgtgtgtctgtatgtgtctgtgtgtgtgtctgtgtgtgtctgtctgtgtgtgtgtctgtgtctctgtgtgtgtccgtgtgtgtgtctgtgtgtgtctatgtgtgtgtgtctgtgtgtgtgtgtctgtgtctctgtgtgtgtctttgtgtgtgtgtgtgtgtgcctgtatgtgtgtgtctgtgtctctgtgtgtgtctgtgtgtgtctctgtgtgtgtgtgtgtctgtgtgtgtgtgtgtgtctgtgtgtgtctatgtctctgtgtgtgtgtgtgtgtgtgtgtgtgtgtgtgtgtgtgtaaggtgggatgtctcttcctgctgatcggtggcctgcctgtgtgctggcttggttagaggagtttcgtgcttctctttatggcgctgctcttcctcagatgcttgcgggtgcctgggtggatgctgactgttctgctcgggattccccgtagctgtctgtgaacacagcatttgtcacaatagcctgcgaagaggagggccaggggactgtagcaggctgccttggggacatccagagcatggcttccgggtggtgggctccgtgtgcctcctgggagttgcccagcacactttctctttagcccacatcgagtgtagacccatcagtcccaggctgcctggcacaagctggagaggggccagatccacaggagtctgcccactatggctccccactcctcccagtcgccctgctggtgacctggggaccctcttgcttcccatgtcccccagcagcctcgga

SEQ ID NO: 1991 - DNA, 1221 bp, Homo sapiens
aaatatttcagtagtcagtcttcatgtgataccatgtacatcctattttctatataggaagatgaactggatggtgtttctgaaggagagagttcttgtatcagtttgttaacaaagataagatactacactggttgaattactttcaaaagcttttgaaagtaaaagagaagcaacttctgttggtctaggtctaacagttatgttcttccccctcttaagttttaatccaggtgctggtttgccaactgacaaaaagaaaggtgggccatctccaggggatgtagaagcaatcaaggtaatcatgtgttaggattcttggactggaatgagctaagatgggttcagaacacaaagctggataataaacatgttccgaacattgcagatttcattttcccacagttattagcatacagcaatatttctgtttaaggaaaaactagcataaagttattatttgatcagacttgaaattacacaagctaattaatgtggaggcagctttgtctttctcattttccaaggtgcatttatcacttcgaacagttacttaccttggtatgctgtctcagtgtttgccttaatttttactttcgaagatttgctgtctggcaaatccttttgactgatcagtagggaccctcgttttataatattgcctccttaaattattcagtaacataattgcaaatagttacttcacttagctacgattttagaacatgtggagtgattatttataagaaggcctgcatctcttcaccaattttagaaatttgtggtttggcttctagttttatttttgtgggccaataacattcttccccctacaccaaagtatttaatgttcctgatggagaagttgctgtgaatttctgtaggtgattgacacttagttttctgggtagctgatacttggttgaagttaatcatccatctccattgccctctgtcctccagaatgccatagcaaatgcttcaactctggctgaagtggagaggctgaaggggttgctgcagtctggtcagatccctggcagagaacgcagatcaggtgaacaaatggtgttctttgtatgttcaaattaatgttacactcagagtgtaactcacaaccatttagatgccatgactctggaatgccagagtagtgcctccttacatcaaatctaatatatgaaatctctttaaatgctctttgaagataaagtatttgat

SEQ ID NO: 1992 - DNA, 1210 bp, Homo sapiens
atcaccctcggtgggtttggagcagaccgtttctacctgggccagtggcgggaaggcctcggcaagctcttcagcttcggtggcctgggaatatggacgctgatagacgtcctgctcattggagttggctatgttggaccagcagatggctctttgtacatttagctgtggtgtgtgcttcagaaaggagcagggcttagaaaaagcccttttgtccgtaggagttgatgtggtgtgagtgatatatttctatgtttttaatgtacagcatctgtactttgtttgccttgataaaggtaagataaatgaaacgctgaactatgctaatctggaatttgtttttatttgcctgaaatatatttttttctgtgaaaaaattaaaacgtacttaagccaggagaatgaattatacagtgattgaaaatccatttaattcctatgacttttgttttgtattgcccaagtcaaactacatcacttgtatctccagcccaaatgtagtctgccttgaaaagtctttcagctgtgactgcaggaagtgggagtgtttttattgttagctaattgctgtgactgcaggaagtgggagtgtttctgttgttggctaattgaagttattaggctcagcttcagtcatgtgtaagttttgcagtgtaatacatatgtagtctggtctgtatatatgaaaatttgaattaaactgcagaatgtttatgtctagttatggtttaaattttcttagtagtatataaaaggtaagagtactgaaaaattaataaaattgcaagttaagaaatactgtgggcctgttttctatattaaatataatcttgaataatcattacaacttacctttattgttaagaataacatttttatctttcagggcattactccattctaacagagtcataattggctggtttattgacacagtggaaatatataaatgtttttgagtatagatctgttatagaccctttatcggggaaaaaaaactcagttattcaaaaagatttttactcaagcttgcttttgaaacatttaaaaacttagcattttttctttcaaatgtgggtatctgagttactgctttttaaacacttgtgtgtattatccagaagactgttaaccaccatatcatatctagaagctataaaatatctgcatatttcattcagcagatgatttattgatttcagtttacctg

SEQ ID NO: 1993 - DNA, 1141 bp, Homo sapiens
ccaaagtgctgggattacaggcatgagccaccgcacccggccacaatggcctttttgtcactgctccctgtgctgtttggtggcactgttttcccatcctatgctgtcttgactcccactgaagaatggtggtctcaggccacaagcatgggaatgtctggggtgctgggaacacagtgctggcccagctgggcagggggcttagctggatgtcctggcaggggcacagccctcttataccccctaaaactccagcatggccttgcccgatgatgggtgtggagtcactcagcatgccacccctacatacccaaaggccccaggtctgccccatgtgccccgactcccacagagacccccctcccagctttgctcttgtggacccttgaacatcaggaaacacaaacacaacccaaaccccttccagaggaaagctcaggcctgaggtctgagagcacagcaccccagcacttcacgaaaaggtgtgtgaaatcctaagctctcgcacttctgcctctgcatcagcccaggacaccactccaccctcttggcgggtaggcctctgtggaggtgagtcacccctgcctggacaccgtgctgccctgctgctgaggacacttatacctcagctcagaaaacagggcctccagactgagtgagtggctcatgcctgtagtcccagcattttgggagggcaaggcaggaggatcgcctgaacctcggagttcgagaccaacctgggcaatatagtgagaccctcatctctgccaaaaatttttatttaattagccaggcactgcggcacatgcctgtagtcccagctacttggaggctgagacaggaggattgcttgcacctgggaggtgggggttgcagtgagccaagattgtgcgagtagtgcccccaatggctccgccaaccccgacatggcaggtttcagctccatcaccgccctgttccctcaccccacgtgccactcgcatgtctctctcaaaaagacacccccactttcccccagctctgctcagcatagtggtctccacctcctgcctctccctgcagcagcctctccaagatgctgtccattctggaaattgaaaatccaaaatcagtacttaagggcaagcataaggtgccagca

SEQ ID NO: 1994 - DNA, 1168 bp, Homo sapiens
tgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccccccgtgtcgctgttccctccgtgtccgtattcctcccgtgtccgtattccttacctgcaccttttcctgcaggtgggactcagggtacttgttcagcacatgtgctttcctcttcgtcttctaggagggagtggttgggtctgggctccctgttcccaagcccacgttgtgttcatggctgtggctgcctgggtgatgagtgtgagtttgcacctgggtttccctgggccttaagcagacagcgtcaccctcagagccatcaccactgtgaatcatttggatctttttccatctgggcataaaattgtatgtgtagacaaatagttgttttttgcttttttgggtggggggggtcagggtgtggggtttacagaaaaggtgctgtgcccctggccatcctgtcccccgtgtctgctgattacagctgaaggacaggtcctcctgggatgcagcatcagtgtcctcggccgcccctggtagcctccggggcaccatccgtgcagggagaggcgctcctgcctctctaccgtgcagggacagtcgggtgggcttttggtacacctgccaggtggtgctgaccaaactgagcttcat

SEQ ID NO: 1995 - DNA, 1202 bp, Homo sapiens
tagcagggatgacaggcgcccagctaattttgtatatttagtagcgatgaggtttcaccatgttaggttgatctcgaactcccgacctctggtgatctgcccgcctcggcctcccgaaatgctgggattacaggtgtgagccaccatgcctggccgggatgtttttattgtgtggtctgtggaggacgtccatgtggcttggtggccaggccccagtgccccatcccatcctatccctcaaggaggctgcccttgtgagatgagtgtagccccaccaggccacctggccagggtgtcggccacagtcacaacttgttctcttgttccccaaggtcttcggggacgaggaagccacagccccatgagaactccagacccttgtcccttgagcacccctgggccggccctcagctccggacctccgtgcagccctcccacctcttcatccaagaccccaccatgccaccccacccagctcccaaccccctaacccagctggaggaggcgcgccgacgtctggaggaggaagaaaagagagccagccgagcaccctccaagcagaggtacggccgcgtcgtggggtggggtgggtcttgggggttaccacagcaccactcctggggctgaagctccccgaggcctgaggtcttcaggggaaaaacggccctctgggtgtcccccagccatactgggcccttccatccactgagaaccactgaggggccacgtggcaggccaccctgcggtggacggaggctggggctggagctttcacacacccgaggccgccgcgctcattgctctggaggcggggtccctcctcaacctgagcccagtctgcagggaggctgcagggccccagtgtgtggggaacgccggtccccagccagaggctgctcgctgctgggcagcctgggctttagggcagaggtcctggaggcatggcggctgcctcttgacagttgcgtcccaggagccctgagtggctctgcacggtcggaaagctacgtggttctgaaagccgtgcagatgtagaagtgtcgtcctggacgtccagcccacagccctcctcgctgtgtcctcttgtcatcctggatgtccagcccacagccctcctcactgtgcccttctctcatccgggacgtccagcccacagccctcctcactgcgccctccttggtcttctgggctccgtagccaga

SEQ ID NO: 1996 - DNA, 1195 bp, Homo sapiens
ggcatcccttcttagcatgagaggcattcctgtagttgtaaaagtttccagaaattgctttaaagtagaactatgcttgtggccaaaatatatcttgattgaacatttaaactgagtttcttgctttgagtttgagcgggagggcgtcatcgtgagtcttgtcttgagaaaacctctggtcgtgtttcatggacccacctttcctaatccttgtcctcttaatggtttcaacaggacagattgattcactttggagctgtaagtactgatgtattagggtgcagcgctcattgttccttgacgcagagtcccaaaatgaatatccaagagcagggtttccccttggacctcggagcaagtttcaccgaagatgctccccgacccccagtgcctggtgaggagggagaactggtgtccacagacccgaggcccgccagctacagtttctgctccgggaaaggtgttggcattaaaggtgagacttcgacggccactccgaggcgctcggatctggacctggggtatgagcctgagggcagtgcctcccccaccccaccatacttgaagtgggctgagtcactgcattccctgctggatgaccaagatgggataagcctgttcaggactttcctgaagcaggagggctgtgccgacttgctggacttctggtttgcctgcactggcttcaggaagctggagccctgtgactcgaacgaggagaagaggctgaagctggcgagagccatctaccgaaagtacattcttgataacaatggcatcgtgtcccggcagaccaagccagccaccaagagcttcataaagggctgcatcatgaagcagctgatcgatcctgccatgtttgaccaggcccagaccgaaatccaggccactatggaggaaaacacctatccctccttccttaagtctgatatttatttggaatatacgaggacaggctcggagagccccaaagtctgtagtgaccagagctctgggtcagggacagggaagggcatatctggatacctgccgaccttaaatgaagatgaggaatggaagtgtgaccaggacatggatgaggacgatggcagagacgctgctccccccggaagactccctcagaagctgctcctggagacagctgccccgagggtctcctccagtagacggtacagcgaaggcagagagttcaggt

SEQ ID NO: 1997 - DNA, 2167 bp, Homo sapiens
cttccagagtgccctgcatagaggcagacaccctgaagcctggtgacccctgggctctggctgggaaacccgggtcgtggggacgtgaaagggtgaggtggcagtgcctctgacctcttgccttttgaaggagggccctcctggacccgggagcggaccctggtggcggtgaagcccgatggcgtgcaacggcggctcgttggggacgtgatccagcgctttgagaggcggggcttcacgctggtggggatgaagatgctgcaggtagtgggactctgggcttgtgggtgtccctgtggggatggggttgggggatccttctcggcctttcacatcccagccagcgccggggcagggcctggctttggcagttgaaggggcaggagggatctattctgcggtgggggtgctgcccatgctggtgttatctgcaaggtgcctgaggtcagggcatcacagctgctgtgctagtgcccacgtttactgtctgcggctcctccttacctcaatgccacccaggcaccagagagcgtccttgccgagcactaccaggacctgcggaggaagcccttctaccctgccctcatccgctacatgagctctgggcctgtggtggccatggtacggcagggcaggggtggtggaagggcctgtgggtaaagggcgtgtgggtgtgtctttccccccagcaaagggaggggccctggattgagcccaggggcccttggtgttccccacttctccccaaccattatctctcgctgcaggtctgggaagggtacaatgtcgtccgcgcctcgagggccatgattggacacaccgactcggctgaggctgccccaggaaccataaggggtgacttcagcgtccacatcagcaggtacgggggtcctgatacaccaggctgctgctgggggcaaggagggccatcacttggggtggtggcagatccacgagacctggctgtcttgctgtgctaggatgaagccaggtcggacatgacagctcacactggtgagagccgtgttctcccagggcacacagggcaatgaggtgttccctttgtgttgtgtgtaccgtgccatcgttgcctgttacctgacaccccaaggggttggcacggggcaacttggggggaaatgaggctcccaaaagctggggcctgggcgggtccacgaggctgtaagaggccgaggccaggctggaacccggtttcccagctccactgttactccttccctgtctgcagtcacaggcttgctcccctagacagagggcaacgggagcagcagatggtccctgggattcctcagggtgcacatgaagcctgagcctcacattgctcctgtcctggcacaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacacccagttccataacgttgttggatgtatgagccaggcaggggtccagagaccaccagcctgcaatccggagaacccaagctaggcgcgagccggtgctgtgatcccgccaaaggagaagctgccttcccggggaaggggcagagaggggccggcgggctgaggccaaccagcgcagaaagggcctggcagccattactgtagcgctggcggctctgtcacgcccctgaagccgctggcccgcgggtgtgttcagctcaggagcggccctgcgtgtt

SEQ ID NO: 1998 - DNA, 1128 bp, Homo sapiens
tcccaggcctcccagcaggggtggctctcgcccctctggaggggagaccccaggaaccggcccccgccctcagccatagcctcacagggtccttgtttctcggggcctggctctgtgggtgcacaaggcatggtcgggctcccgtccttctggaagtctccagagtggcatgtgggcagctgtgtgaagcggccccccagatcttcatccagcctggcctgcagcagctccctacgccctctgctacctcccctgcctacctttgggtagacgttctcttgacccttccttctgtgataaagcaaaagcgtgtgatctcttttctcaccaaggaataaaacgtctctgaataccacagacgtgatgccgggcttttgggggccggggggtgtcctagggccccgagggaggagccctgtgggtgccgaagtcgggccgcaggccctgcactgagatgtcccctcagcctaccccaggcggctgggcatgctgggaagtcctcccgggctgtgtgtgtgaatcatgctgtttcttctctattttctctctctgtctgtttatttttgttgtgtgtcactctgcccagccggccgtcctgtctcttccctccatgctccgcttcgcccgctgctggccagaggtgaccaggtccggctctcagcacggccgccggccggggggccatggggagctccgcctcctccctggccgcagagaccgagtcggaccacagcttccccgggggaccgccctacccgggtcccccggcagcggctggctggtgtaggagcggcccaggggggcccgtctggggaggtgccctggtcagccggcagcaccagcccccacggccccgggcccgaaggtaagaggtggggaggggtggccccggagggctcccgggggcagagggcctcgttctcagggtgccccctccttggcagaggtgcttgcagagaagtgggtccctgctccttccagttgtggcagctctcttccccagggtgcaggagctgagcaggtctgagaccccggcctcggcctggctggttggtggtggggatgggggctagtgcgcccaatcccggcggccctgtgtttctcacaggctgtgctgctccacgcaga

SEQ ID NO: 1999 - DNA, 1214 bp, Homo sapiens
aacaacatctttgtaagggtttcgggtctctgagcccatgaacctgcccaggccctgcagaggtgagggtggccctagagtggctggggggttgtggagaccagaaccagggcagaagggcagggagggtgggggccctgccgaggtctcccaccgctgacccctgacccctggcccccttccacctcggcccaccgagagaggccggcacagcgcagactgcggggtcagtgacactcccctcagcgtctccagccacagaagggccgtggcctgccttcgccctcctcacccgtgtcccggggccacgtttgaactttaggccttgttctgacttcattgaaaccctcctgaagtgcagacgtcttcctgacccacctgggttttgccaggatgactccgaaaggtgtctcccagcagacacaccccgctggcgattgtttggtcctggggacccgggttctcattctcctctctggagctggtgaggctgtccttgctagtcggtgacaactacagggccaaagggagggtgtgtcccaggaggcccagcccacctctgcctgcacctgcggtcagcggggtgcagagtctgtgaaggcacctcccggagtgggggctgcaaagatcatggccactgtgccacccacaggggcccaggccggacgcctgggctgtgccgcctcggcagccaggccgaggaacgtgcaggtgcggccgggagcccgccggccacagctgcatccatgcccttctccgagtggtgatggcggggagaggcctggctgtctacgggcagattgcttgggctttcacagaagcccgctgttagagcagattcccggccttgggtctctctgctccagctggacgccctgagcctcgccgggcccagtccacccccgtccactctgccaggggcagctcagagccctcgccacgcggggctgagcgcagggaaggcagcatcacggagttcgctcggctccacagaacacccgtgttgctcgcggagactttttgtttttgtgcttcttatgaagaggcaggttttctttcttcctgaaccaaaagggtttagatggagcacaagattcaggccatatttacaagaacaattgatttttctgccaggcagagcagccagtctgtctcggaggctgtgctgtggtgtggggaggccccttgctcagatcagcctgtgccttccccag

SEQ ID NO: 2000 - DNA, 1200 bp, Homo sapiens
gcaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtatcggcaccgtggggcggtgtgcacgccgcccccgccctcctagggccgagtccttctctggagaacaagcctgtccctcctgctgacctggggtggggcggcttgttcgtggcccaaatgggacctggagcttcagctccaaggtgccaacctcagaattcaggtccacccaggtcagcagattccagcgccctgaagagccggccctggagggcttcctattataggcctcagggatgggcccccgggggccgggctgcaagaggacggtgacggagcagctggcacctgctggggtcaccggcctgtggttgcggtaggcgctgagccacggaggtgtgggccgtggtaggctcagggccccgtcctcccgccacctgcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggtgggtgctgcggggccccatcgggctgggctgggctaggctggcggccgtgaccacgcgtgaccctggcccgtggtgtctggcgcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccagggtacgtggcccctaccccaggctcatgccccaggcccacggggagggctgcggttcacacgcccgtccttgtagcctccagcccctcggcaggggtcccgagagcctccccagagccgccgggccacgtgctggctgtgtacagctcgaggctggtcatggtggagcccgtggaagc

SEQ ID NO: 2001 - DNA, 1325 bp, Homo sapiens
tccctacccccttgcccaccaggctggccttggctgactccctcttggggacagggagggggtgccctttcattctccaaaccccagcctgcaagtctgtcccaggctctctgggaaataccccgaccttggtccagtgggctgtgtccccatgcccacagccctatgccatcaatgggaagatctccccccagagcaacgtggactttgacctgatgctcagatgcaggtcagagctagaggcggggggtctggctcaggtggcaggtggcttgggtggcaccccccaggccatgactccatctccccaccctctgcaggaacccagaatgggggcttcgggacacagccctcctggaggacctgggaaaggccagtggcctgctcctggagaggatggtaggtgggggagcgggggcccaggcaacctctctaggggttgagggccgtcctccagcaaagtgtttctccaggtggacatgccagccaacaacaaatgcctgatcttccggaaaaactaagcccctccttcacccccgcacacctgcatccctgccggaggctctgtgaggcacgaaccctgcctccctaggccggaccttgtggacgacagccccacccagtctgtgctctcagccgctggccgaagggcccagcctgctcagaataaagcatgtcctgctgccggcttgctggtgtctgccccacctcctcctaggagcaccttgtgaggttgggtgggagacggggtctcctgtggggtcaagggcttgggacgtcctgatccttgctgctggagctcgggcagtgggattggggccgagacagctgctgaggcaggatggagctggttggggatgcaggggcggacaggcactccctggtgaccttgtaccaaagcccaagccccagtgggtgtcaaggccccagcggaaactggctgggcatggggcacctggaaggatgagggtcgcccgaccagcagcagcaagccaggaggtctgaggcacagggagtgcgtttattcaccaggacggggtggcgcaggcccctgcgggggctagtcctggaagcggttgagcagctcgcaggcctgcttctccagcagctccaagatcttcttgacgcgcttctcgctggcggcgcggacgtagctgccggcgtccagcacggccacgccatcgcgcacctcacccatgatgaccagcggcccgtcgcccgccgtcatgttggggcaggggcaggcccagtccatgccactcagcgtcacctccaggtacttggtgcccaagaacttgaggcccatcttgtcatccttgagcacg

SEQ ID NO: 2002 - DNA, 1149 bp, Homo sapiens
cgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaacctagaatgtgttgtttgtctttatgtgggctggaaacgccacccctcctttcattcctgggtcactgttctgaggtctcaggcgtgtgcatatggcctctggaaggtccactctgggctgctgtggcctgggagcccagtgtccttggaggtcctgcggtctgggagtgggagcccactgcgggaggacggtgcgcgcccggcatggactggggggcgccggtgcctgagatgtttccccggtgactgaccccttctcagggtccagtgtgccctggcactgcccactcactccccagagcgtcctgccagcctggctgagctgcgccgagaacctgggcttgtgtgaccagatgtggtcactgcctgccacagaacggggtgaccctggggccctgacctgagggaagcaggatgggccagagggagggacgggctgggagttgagcccagatgcctgcttctcgggacccagggcgtggccttcccaaggtcacccggacaagtatcagaaggcctggtcccccccctcccatgtc

SEQ ID NO: 2003 - DNA, 1134 bp, Homo sapiens
cggccgcgtgcagaaccccgcctggtcttgtgcccgagacgggcggaggctggaacttgagacctcaataaaggaagtagagccgctgtcggcactgcgtgtcaccccatagcgcggcgggctcgccgtaggcccgcggggcagctggcgggcgggggctttcggcggggttgtcgccatggtaaccggcggcgcccatagtcgctctcggggcggccttcccagtgcctcccgtagaggcctcttccggggcgggccaaaggaggtcacttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggtgagcggcccgggaggggccgggcggtggggtcacgtgcggcgggcggggcgcgggctgacccagctgtgcccgcaggcgcccgggcgggccgggggccgtggcggaggaggagcgctgcacggtggagcgtcgggccgacctcacctacgcggagttcgtgcagcagtacgtgcgcccctgatcgcggaggtcgcgtcctgttcaccggcccgtctgccccgaccgcccaaggccgccttcccctgacctcgcgcgcacgcgtggggctggggcggcgaggctggcggtccggcctggccgcgactctgcccttctttccaggtacgccttcgtcaggcccgtcatcctgcagggactcacggacaactcggtgagcgcgtgcccgtccgtccccggccactctcgcccgtgctgggcccggccactaagtcccctccccgcccccgcagaggttccgggccctgtgctcccgcgacaggttgctggcttcgtttggggacagagtggtccggctgagcaccgccaacacctactcctaccacaaaggtacgcggcctcacccctggggcccgcccatttgccaacaccggggcggctggaccagacggtcctgacccgtctctttcctgcagtggacttgcccttccaggagtatgt

SEQ ID NO: 2004 - DNA, 1134 bp, Homo sapiens; identical to SEQ ID NO: 2003

SEQ ID NO: 2005 - DNA, 1134 bp, Homo sapiens
ttcttcgcccagcagcaggtaacggcgttgggccagccccagactcaggctggggagcggccagaagtgactttgctggcctcttgccatgaggctgcaggaaacagagtcctcgctgtgctgtgcggccttccccagcacacctccacccttgttccctcctggttcaggcccttcctcttctgcagcagagggcttcgttctgatccagaggtgctcactgctcacccagaggcagccaggcctgaggctgagggagcaggaggccctgggcagtccgggcctggagcccacccctccggccaccaggtccacgaggatgcccagcacgacccccacctgaggcccagcgggatagaagcctgaagacactcagccagcagggggcgggagagggcgagggcggccccggtggtgcctgggcctcgagcgcccatgtcccctgcggcacctcttgcctgactgcacgcggattttcacccggggctggagctggttggttcccccgtgacatccgtttccccggctgctgtgcagtgagccggcccgagccgtgggaaggccacttctcctccgctggacttggctgttagggagcgcaggcacactgggaatgggtcagtgtcattttctgtcacagccagggcccgtcctgtccagggacacatccgcagagccggcaggaggcttgctgggaaatggagtgaggctcactgtccctcggggtccggcctggctgcaggatggctgagttccaggtcccgtctcagccaccttactgctgggattggggagacaagtgtttgtttctccttgtagcacttgacccctgacaagatctaccacgtcacagtgatgccctgctatgacaaaaagctggaagcctccagacccgactttttcaaccaggagcaccagacacgggatgtggactgtgtcctcacaacaggtgcggtcacgccgtgcggccctgagccctcaagcctcctggtctgattcctgagccctgggcacaggtggcgactgcccaggatcctgcctgtgggggccctggctggagtgtgggggctcgcatgcgtgcacgtaccttcgtctctccccttggagccaggtgggcccatttgcagctggcct

SEQ ID NO: 2006 - DNA, 1114 bp, Homo sapiens
gatctcatgaaccactgcaccaagagacgatttccagcccagcactgggggcccagcccacaaacgaagggaacccctggaaggtgctggggtgctggtaggcgtggctgtcggtgcagtggcagttggtttggaggagcctgtcagcctctgcccagcaccctgtggcaggcaaggctttgtgccttggggcagaaccaacgtaggaatacaaggcgagctcagattgtgatacacaggcctagcagagagctgggctgcgaggggttcccacacagttcccacccagtcgccttactcctctggctgtattccgggccactgcagcacccctggccctgctcaaaccattcctgcctttgcaggagaagttgggggagctcgagctgggtgcgttttgcatgtaagaaaagttgctgaggcatgtcccggaggcccccgactggaacaccttgttcctgcatctgtttggcgagtctgacggttgtttctgccccgcccaccggaggccaggctcccaggcttcctccctctgctctcctcttcctgtgccttcgtcctttcctcctttgtcctcagctttcccgcctcctcctttcagagcccaccttcggcattttcctgccctacagccctgtgagtgtgcaccggggccagcaccccgtccagggccccatgggtgagtggggtggctgctgctttgctgagataccagtggcaagccttagtcctgtgattcggatgcactaaccaagtggtaccaagaagcagacttgacggcattatgaaactgtagagcgtgcgtgtgcatttttgtaatacatacctaatttttaaaaattcagcggcacacaagcccagccagcagccatgttggttgtcggttatgagctggactccactatcctctgtctccatgtcctcgtgcagagggggcccctgtgcaccgggttcttctcccttgtaggacggcgggacccggaggctggagaaggccaaggtctcgctaaacgactgcctggcgtgcagcggctgcatcacctccgcagagaccgtgcttatcacccagcagagccacgaggagctgaagaaggttctagatgctaacaaggta

SEQ ID NO: 2007 - DNA, 1227 bp, Homo sapiens
ctggaggagatgctggaggctgggctggacccgagccagcgaccgaagcagaaggtgagccccgctggctgtgccgccgggaacaagcctgaggctttgcactcggcgccggcacccttgcagcctgttgactttctccaggagccgtgggtgtggtgacgtgtgggtcttggcgtgaagcgccattagcgtgagttagaactggagcgttgcagtaacaactcgggggaagtcgttgtccctgaagggctctgcggctggccaggatgatctgggtggacggtgggtggtttctgggggccagtcacactggtatcagctgtgttttgtctgcacgaactttgctttgtgtaggtttttttttccgttgccatcttggtgtgtgaaagtgctcaattttgttcttatttgatggctggagtggggtggagggagcgcccagcctgtgggacacatgtggcagtccctggctgctaggccgggagcgtcctgtaggtgcggtgcacactacgccttcatctacctgggctgcaggtggcactgctctgtgggcccccggggctggggaagaccaccctggcacacgtgattgcgcgtcacgcggggtactctgtggtggagatgaacgccaggtgagtgatgtgaggtccgtctctggctcgccttctgtcctgacgtgtttgagttctggtggcggacctgaaaccgggtgtggatgttcccgtcttgagggtggtgggggcctgggtgtgtgggccgggaaaacgtgtccttcctcggggttcacgggatcggcagcagccgcgtcatgtgacggtctccacgcaaatgcggcagccccggccttgggaggctgccctgccagggacgcccactgccctgacgacccctgacctccccattgcagtgacgaccgtagcccggaggtcttccgcacacgcatcgaggcggccacccagatggagtcggtgctgggtgctggcgggaagcccaactgcctggtcatcgatgagatcgacggggcccccgtggtgggctccttgatgcctgggtaggtgggtgggcgggcaggcaggcgggcagcagggcctggactcaccgtgtcctctgacctcccccaaggccgccatcaacgtcctcctgagcatcctgaaccgcaaggggccacaggaggtggggccacagggcccggctgtgccttcgggaggcggccgacggcgccgggca

SEQ ID NO: 2008 - DNA, 1205 bp, Homo sapiens
acctcacctgcatggacttccactatgaggtgagcgtgccgtgcagcgtgagggcagggcacccggtctcacgccgccccgttcccactcttggcggggctcagtcctgcacaccctggtgagctgtcgcatcacagggtcacccccattgattcaggacgtcctctccctcccttcacggggtgggtggtcacacgggggcttgctggggctgcggggacggggtctgtggccctccatggtctcgagtgcagctggtttgctctggttcctgcacgggcaccctccgctgctgtccttggtcctgcccaggcctccgggccggcccctccttcctggagtccacagctccccaccgtcccctgacaggtgcctgttgggggcttcctggctgcgtgcccagcccctgccacacggaactgtggctccatcgttacctggacacgggcaggtgtgtcccacagggcaggtgtgaaccacagcacagttccactgtgcttggcccccagaccaaggctgagtcccttcagacgccccagttcctgccaactgctcacgtgttcacatgggggctgggagtggtctggggcctggagctcacgtgttcacgtgggggctgggggtggtctggggcctggagcttggatagtcatttgttctcagtccatgtgggagcctcctggtagcaccatccccaccctgggcccgtgtggtcatggccacggtgcacctagagcatctcaggcctggacaccccttcctgcatttggcccgtcactcgcacctgcacgcggaagccatcatcgtctgcctgctgccgacagccagtgatggctgtctcactgcctttgcgttttctgccagggttgctctggcactcaccgcctccaagcgtggagctggcaccgtcctcacgcggtgcctctgctgcgattccgggtcttggtccacgtgccggcctggcacaggcgtttgtgcctgcatttagtggctgtgtcctgactttattcttcaggctcttgagatgtctccatagcccatcaagtgccccgccttgctgaggacccgtgagctcctctctttgtccgagagcaggttcagctgacggtctgtgaaataccagaaagtaaacactctcagctctttggctggatggtcccaacacagccgtgacggggagcagccgcagggcacacgtgtgtgag

SEQ ID NO: 2009 - DNA, 1179 bp, Homo sapiens
gcccgccttggcctcccaaagtgctgggattacaggcgtgagccagtgcgcccggccccatacaaatgtatcttaacatcgtatacaacatcttttcattcagcctaaaagtgtatcttttctttcttttaaaagaaagtaaaccatttcagggggcctggacaagtgctgggaggaccgtgccaatggcttagttggccggcagggcctggtgggtgtccggcctctttggggggggcccatgttaaacccccgtctccccacctctggttggaatccctttgagcccatggcttgcccagctgtgttggacatggccaccgggggcgctgtggctccaaacacatagatggtggtggctggcctggcccctatattcccaccccccatatccccaccaccaccacctgcagggtccgtcttccacggctgccgcccatggcagatgtttgggcagaggcctggcggtactcccttcgctgactggtccgcccccgccaggtcccaggtcgctggccggctctgcacctgtcgccatccccggctccctgcccagagcaccatcgctacactcgccatcctctgcgtccacctcgccgctcggttcgctgtcccagcccctcccagggccggtgggctcctcagccatgacgcctccccagcagccgccacccctgcgttcagagccgggcacactgggctctgcagcctcatcctacagccccctaggtgagtgccggctccctccatgctggcgttgccgtgaagcctccgtggggctccctcccagatgccgtcctgactgaggggcctcacacggaaccttgtgccctatctgtggtggcaaaccacatgacctgctgctcacaggttcccccacgccgcagaccgagtctcgctctgtcgcccaggttggactgcaatggtacgatctcggctcgccgcaacctccgcctcccaggttcaagcaattctcctgcctcagccacccaagtagctgggactacaggcgggcgccaccacgcccagctagtttttgtatttttagtagagatggcgtttcatcacgctggccgggccggtctcaaactcctgacctcgtgatctgcctgccttggcttcccaaagtgtgggatgacagtgagccaccgtgcccggctatttgttacgttgtaaaag

SEQ ID NO: 2010 - DNA, 1133 bp, Homo sapiens
cccttcataatcccggggcctgcaggcggtctgggcggtcctgctgctgccagagtgactgcgccagggccctgcctgaccctcgccctgaccgcgccctgcaggccttccggacggtggagatcaagcgctgggtcatctgcgccctcattgggatcctcacgggcctcgtggcctgcttcattgacatcgtggtggaaaacctggctggcctcaagtacagggtcatcaagggcagtatccttcccagtgcggccgctgcagcttgggaggggggcgtggcctgggccgagtcccgggcagaagtcctgagcccagcgtgttccagtgcaggtggaggcggcccggccaggctggctgtgtccctgtcatggttgggccgtgagacgtctctgggatgtccagtgaacatcatggctccacccagcagggtggcatctgccaggctggtctgtggggcagggctgaggtctgggctgggtggtcatgacggggaagcagccagccctccttgatgagccccagatatcgacaagttcacagagaagggcggactgtccttctccctgttgctgtgggccacgctgaacgccgccttcgtgctcgtgggctctgtgattgtggctttcatagaggtgggtggcaggatgccgcagctatggcggaccccatgaaggattgggggtcttggtgaatgggcgggaacccctgcagctcacccacccccaccatcacattggctgacaacccgggcacttttagaatcacgtggtccagactcacaacctcaggaggagcagacacaccagggcctcttcacccccagagccctggggtgctgctcctgacctaccagcacaggcctgggcaccctcaccccactccgcccctccttccatctcctcactctgccctcccctccttccatctccacctccgcctccaccacgtccttgatctgtgtctgggctgggaagagtgagagcagctaccccaacgacatgagacccttccctggggccccaacgtgtgtgctgctcttcccttccctgaggccccgacgtgtgtgctgagctccccttccctggggccccgaagtgtgtgctgctctccccttccctgaggccccgacg

SEQ ID NO: 2011 - DNA, 1326 bp, Homo sapiens
gccaggggtgtacagtgcctgtcagggttgagcttagtgatcctctctcaaaccacacccccacataaagcctcatgctcacccgggctccagccagacacatcctgcccctgagagccacgcctctactctcggaggaacgtcagtgtctagagtgtggggtttgccctccgttggcagaaaggtgaggagaaagctcctcttctctgggcccctccctgcctgtccctggtaacgcctcctgggtcctgagtttgagaaagcagagcctcgccccagcaggtactcacagccagagtgcgggggccccagcaggttctcacagccagccggtgagtgcacctcagagcacaggggcccagagccaggccactccttcagggccccaggtcgcttgctgccagttttggcctgtgagctcactggcctcagtgccaggtaaggacagccaccttcctgggaagaagaggtgaccccgggtctggtggatttcccacaggggccgtcagaggatgtccacagaggcagagcccttggggcctgtgggctgggttgggctggtggatgtggggcctgggacttctccagaagcttacttcctgctgcatgctttgccgactgtccttccacctctaagtgtccatcgtgcctgtgggggctgctgcaggctcctgctccgtcagcccacctgctgctgcgctgctctgggagcgagctccctcatggcatctggaacgctctcctgtcctccctgtgctcagggctggagagagggtggcggggctgcgggctccccgggccttctgggcccagccctgccacctgggcccacctcctctcactgtctctggctcacgcttcccgggcctggagctgggacctgcccataggcatctgaagacacgtcagcctcagccggggggagcccttgcttgacgctctctggcctccgggctgcctctcgcgcccgctctgggcccgctcttcttctcatgatgtctttcctttcacctcctgcgttgtctgacatcgtcgctctcttcataaattgtagcgttttatgttttcgttcataggagtgttttatttgatttttctttattttaaattattacatttaagttctttttattttatgctctaggttttgaagtttttctaatttcttaatttttttgttgttttttgttttgttttgtttttgtttttatgtactgtattttcagtgttttaaccaaacagttgtggctactcatggtgaggaatgaccgctaagagtttgggttctttcagtgcatttggaggtcactgctacacgttgatgtt

SEQ ID NO: 2012 - DNA, 1148 bp, Homo sapiens
tgccacagggtggcatgcccagattttaggggtgacatgggaggagccagaccccagggctcttgctttcaattgttctcacagggtacaggaaaaggattccttgtgattagcctctcttgctccttttctccaccagcaaagtcgaccaagaaattatcaacattatgcaggatcggctcaaagcctgtcagcagagggaaggacagaactaccagcagaactgtatcaaggaagtggagcagttcacccaggtggccaaggcctaccaggaccgctgtgcgtgccccacccacccccaaccccccaccatcctcctgaggcctgggggccagaaccattgcaaatcttccctcccctcccttgtgctcacttgactttgccccctttgcatgtagcagaggcctcggttcccagcttgtttccattgcttccccagatcaggacctgggggcctacagttctgccaggaagtgcctggccaaacagaggcagaggatgctgcaagagagaaaagctgcaaaagaggccgccgctgccacctcctgaggcagctgtgggtgcccctgctgtgtggctctgtatgactgttgctgaaatataaagccctgcaacctgcctgtgtgtctggtgtgatctattggccccacgccccagattcaaaccaccactaaccatgcaggacacgggaaaaaaacagtaacacgcttaattcactttatttttcttgtataaaaaccctatgttgtagccacagctggagcctgagtccgctgcacggagactctggtgtgggtcttgacgaggtggtcagtgaactcctgatagggagacttggtgaatacagtctccttccagaggtcgggggtcaggtagctgtaggtcttagaaatggcatcaaaggtggccttggctgcaaaacaaaagaaccccaggagggtcagtggtgtgcttgaggcaagtcccccaacccaaaaattgtcgcactcctaggaacagagaggccattctgggcgggtctgtcgtgcattaggagagcctttctctgcctccctgaaaacacgccaagcacacactggacccgtgtggttaagcggagctgagagaccatggctatgccccatgtgtggaccacctaccgaagttgc

SEQ ID NO: 2013 - DNA, 1358 bp, Homo sapiens
caaaaacgaaacgaaggggacagatcggggggaagccaggtgagggggttcatgacttcttcggttttttttgggcggggtgggcggttacacagtttcgccctatcgcctaggctggcgtgatctcggctcactgcaacctccacctcccaggttcaagcgattctcctgcctcagcctcctgaatagctggggttacaggcgcactccaccatgcccggctaattttttgtgtctttaatagaggtggggtttcaccatgtggccaggctggtatcggactcctgaccttgtgatccgcccacctcagtctcccaaagtgctgggattacaggcttgagccaccgcccccggccgtgactttggttcttgaatatcataatggtattaagtttttttttaatgctctccctacaattttcttgtttgtttcaggaatcagagatcattgatttcttcctgggggcctctctcaaggatgaggttttgaagattatgccagtgcagaagcagacccgtgccggccagcgcaccaggttcaaggtacccggctgtcctggagggggctgcgctgggcttgccgggactctctcggctctgcatagttgcacttggcttcacccgtgtgactttcgtaacggggagagagagaaaagatctcctcaggacctcggatgggccttactgtggcctctctttccttgaggggtgcaacaggccctgggcggtgggcagtgattgggtgtagggccaccagctgcctcacacacatcttttcgcaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtaggctggtggcaggtgatgggcctgccgtggggcaggctccctcgggcccccgtctcctgactccttccctcaccaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcggtaggtggtccacacatggggcatagccatggtctctcagctccgcttaaccacacgggtccagtgtgtgcttggcgtgttttcagggaggcagagaaaggctctcctaatgcacgacagacccgcccagaatggcctctctgttcctaggagtgcgacaatt

SEQ ID NO: 2014 - DNA, 1358 bp, Homo sapiens; identical to SEQ ID NO: 2013

SEQ ID NO: 2015 - DNA, 1358 bp, Homo sapiens; identical to SEQ ID NO: 2013

SEQ ID NO: 2016 - DNA, 1189 bp, Homo sapiens
actactttctggggtcttggtctcttttcctagtgaccttcagggcctggccactgaggcctcagtgccgcctcggtcagagctgggcggtgcctgccttccgcgggtgggtgggattgcctggccagcacagcctggaatctgccgtgggggtgacccacacacgtttaatttgcactgacgttgtttgttttggtgtcatgcgtgaagccttacttgttctcagtcatgtttaccagacgtattatcatgcatttttgttttctgtctcttccccgctaactgccctttggcatggctctttttgctcatctcacccgcgggatctctccatcctgaccctgtggcctgggacctttcctcctcacccctccactggcttgttctccccttcccgggagctgggctctctggggcgttggggctccttcctcacccgatagtctgaggatagccagaccccccaaacaaggcttgaataactctccacccgtgaaagaattcaaggagagctctgcagccgaggccttccggtgccgcagcatcagtgtgtctgaacatgtggtccgcaggtagcgggactgtcgggtggggggcacggaccctggagcttggccccgtgagcacctgggtggcagtgcatggggctgcttgcatgacctcatcgtctgcccgtgtcctccctggccagcccagggggagccggtgacgaggggtggaaaggttgcattctgtccccaggccccgtatgagcacgggctggttgcacgcatccccaggccccctcggggtgccgctccgagagagccaggcgtgccgggcagcagcctccccaggctgtccccaagggccgcagtgtgggttgggggagacaccactcctggttttggccttttcgtattctctagaatggacgtttttcttcgggctttcttctcaacaaggtttattttttgttgtagctgaaagggaacaaggggcatttgtggagggtgctggggtggggcagcctgggagggcctgggtgggggctaggatcctgcagggcatgggcatgggcctgggccccaggccatggtcttagttctccccgcagtgtctgggtgcaggtgtgggctctcgggctctcggctgtcacctgcctgtgggtcatcgctgctggcactggcagaggggatacctgtctcct

SEQ ID NO: 2017 - DNA, 1081 bp, Homo sapiens
tcaggaaggccccgagcccaggggccggggtggctggcttcaggcccggcccacgtcctgactctggggtgagccttccacagctcaccccagagccgtggagtggtggagtgtggcccgcttgctgcagaggggcctgctctgggtgctggtgtttcctgcgggttttcagctcggctcagtcctggagcccttctctgctccagcgagccgtggtctgactgcaggacaggttctgggtccctccctgtggccctgggttcactgaggccagcactgtggtgggccgtgccccaagggcagagctgccaccgtctctggctgcctgtggcactagcttgccaggctcggggggagcattcagcttgaggctggtggttttgcatcaggtaagtggtggtcaccagtcctctgccctcttcttcagggggccatggtcttcgagttggcgccctggacgtgccggcctcccagttcctgggcagtgccacttctccaggaccacggactgcaccagccgcgaaacctgagaaggcctcagctggcacccgggttcctgtgcaggagaagacgaacctggcggcctatgtgcccctgctgacccagggctgggcggagatcctggtccggaggcccacaggtactgggcggggctggcctgagcgccatctttctgccagtcacccacagagctgtggacactcaggggcgattgcagacttggccctcttgggatatttgggggtaacttttgttttttttttgagacagagtcttgctctgtggcccacgctggaacgcagtggcgcaatctcggctcactgcaagctccacctcccgggttcacgccattctcctgcctcagcctcccgagtagctgggaccacaggcgcccgccaccacgcctggccaatttttttgtatttctagtagagatggggtttcactgtgttagccaggatggtctcaatctcctgacctcgtgatccgcccgccttggcctcccaaagtgctgggattacaggcgtgagccaccgcgcccagccatttgggggtaacttgtaagtctccagaggtgagc

SEQ ID NO: 2018 - DNA, 1234 bp, Homo sapiens
cgaaactacgacttccggcggcctcgtcgtcgcggggcgggaatggcagcttcagaatcactctatgttgcagatcgaagtctgattggctttgttcatccgtcactcaccgttaggcttcacggactctgcataagggaggagcttcgggtctgggtctgagagaccgtctccaaaagaaatgccacggtacgattggtggaaacaacgcggcagggagcggagcgtaccagcggcgggggaaggcgggcacttccgccaggatagcccaatgacagaggtgggacagtttctataaaagcttgagcctcgcccgcccctgtcttttcggggtcgagtccgagggggaagaggtttgttaatacgttcgccatgtgctacgatcttgggacgaactgagccacgagcgtggctttgagggccgtccgaacgctgcaggccggccaggtccctgggcgtccaggcctggcctacgcaccactttgtcccttagcgtttaaaggtttcttcccgaatctcaggccctcagctacctgcaggtaagactgggccgggcttgggttcccttattctcccagtctgtgatgaattgctttgacttctgacacctcgtatgaaaactgcacgtgcagtctgattatttagcaagactgaggcttgagggtgcgcactcctgacggggagctgagagtggaaacaggtgttgcccgaaacgaaggagtggggacttaatgtctgtattttggcgctgactttcaggtttcgtcgcgagccggctgcaagttttgaacctaagtaaacctcaatccggagggcctagcggtaaggtgggcgctgtgtctattgaagtgcttagcaataaagaaaggtagtgagttgattcggttttctctcaagtgtctttattttcctattctggcaccccagaggtctggctgatccacaggcaatcttggaaaagggtacagacatgaaaacggaagctcgttaccagtgacttttcatctcttgggattgccttctccatttctgcccgtgattttttttttttttttttgagacggagttttgctcgtttcccaggcgggagtgcgatggcacaacctccacctcaagcgattttcctgcctgagcctcccaaatggctggaattacaggcgcccaccaccacgcccggctaattttgtatttttagtagagacggggtttctccgtgttaggctggtctcaaact

SEQ ID NO: 2019 - DNA, 1111 bp, Homo sapiens
tggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcttggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccttacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccagtttttaactttgaacaactgtgtcaggcaatggatttgaattttaagtgtattaatagctgtgctctgtgtcgtaggcaaaattccactgaaggagcctctgtgccctgc

SEQ ID NO: 2020 - DNA, 1204 bp, Homo sapiens
tcacggtccccgggccgccgccgccacaggagccgctccagctccaactcctcccgataaacaggccactgaagctctcgcccctgtaacttataccccacccagctcagttttgtcacttttctagccaaaggaagaccagtaggaaagcaaacccttgactctggcaggatttgcaggcagcaggcagcacccctctgccagccgggccccggctgcagaagtgctgttggtttggatgctgtgtgcctgtcaagattccctccggttttctggctagaaagctcatccgtttccggtttctaagagtcagttcagtggcagagccaccagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgacctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttgtgtagagtggaagaattgtgttgaataaacccaagatcggaatgcaaatctagttctgggttcactgccttctcacttgtcccctcgcccctagtaactttctgttcctcaccatccgcagtggcacctccgatgctttcagccaggagaacctagggtttgtgtgctgtggggaccaggttgctcctagggtggacaaatagaaggagatggttttatcgccaccttggaatgtgtgtgtgttttcagacagactctcgctctgtcacccaggctggagtatgtaccatggtgcgatcatagctcattacagcctccaactccttcttcagtgtccagagtagcagg

SEQ ID NO: 2021 - DNA, 1152 bp, Homo sapiens
gtggcgctgggcaggggtaggattgtgggggcctcatcagcccctattgccagaggactcccaggtcccgcagaggagcctgggccctgttctctcctaccagtgacttttctgctccccaaaggttttcggtattctggagaaagccaaggaaaagtacggcgtggacgactactccgtgagccagatctcgctggaacaggtcttcctgagcttcgcccacctgcagccgcccaccgcagaggaggggcgatgaggggtggcggctgtctcgccatcaggcagggacaggacgggcaagcagggcccatcttacatcctctctctccaagtttatctcatcctttatttttaatcacttttttctatgatggatatgaaaaattcaaggcagtatgcacagaatggacgagtgcagcccagccctcatgcccaggatcagcatgcgcatctccatgtctgcatactctggagttcactttcccagagctggggcaggccgggcagtctgcgggcaagctccggggtctctgggtggagagctgacccaggaagggctgcagctgagctgggggttgaatttctccaggcactccctggagagaggacccagtgacttgtccaagtttacacacgacactaatctcccctggggaggaagcgggaagccagccaggttgaactgtagcgaggcccccaggccgccaggaatggaccatgcagatcactgtcagtggagggaagctgctgactgtgattaggtgctggggtcttagcgtccagcgcagcccgggggcatcctggaggctctgctccttagggcatggtagtcaccgcgaagccgggcaccgtcccacagcatctcctagaagcagccggcacaggagggaaggtggccaggctcgaagcagtctctgtttccagcactgcaccctcaggaagtcgcccgccccaggacacgcagggaccaccctaagggctgggtggctgtctcaaggacacattgaatacgttgtgaccatccagaaaataaatgctgaggggacacagtcacagtctgtgggtcacacgcgcgagcggtcacagggctcaatcactcgcccacaatctagacatgaggctctcctttcacatttcaatcacacaaacgtg

SEQ ID NO: 2022 - DNA, 1206 bp, Homo sapiens
acccacagatggcgtcaatgtgaacacctctctttgtgctgaatttctgggccattcttttcctgtcttatttctaaatttccttcttccaagatgaaaacaaaagaaaaacttaaaacagaaggtattaaaaaaacaagagattcccaccattatttaggttcacctgcaaaacaaaaatcttactccagcccctcaatgccatcctgacacactttatgcaaaaagaattttcccagataggctagccagaaaaaacttcaagtcctctgtaacatctgaggtgaccaagaggcagaagagcagagcagtcgggggccgtgtcctggctgatcccaactgcagctctgctgtgggggcccgtgggagggaggcagacccctgggctttcctgctggccacggagactctgctcctgcatggaaagggagcctgggagccagcagcccacgcctggggagcctgcctggggccatgtgaccatggcctctccctgggaacgggctgaccacaacacaccctgctgccatccacttctgtttactctgcaaatgtaagaaagaaccacttggccagaagtgtcccccagatgcttttttttttttttttttggagacagttttgctcttgtctccccggctggagtgcagtggcatgatctcaactctcaactcactgtaacctccgcctcccggatactcctgcctcagcctcctgggtagctgggattacaagcacccaaccacgcccagctaatttttgtattttcggtagagacgggatttcaccatgttggccaggctagtctcgaactcatgacctcaagtgatccgcccacttcggtctcccaaagtgctgggattacaggcatgagccacggcgcctggcccccaaatgctcttgaaccggaaacccagggatgggagatgctcactgagctgctgcttttatgtgtgctggtgctatgtgtgttcatgtccgcggcagctgtctttttgctactataagggaattctggccaccctgggtggggtgtggtcggggtgagaacccaagcgttggaactgtagacccgtcctgtcgactgtgtgcccctgggcatgtgtgagcctcagtttcctcatctgtaaggggggcaatgatacctacctcacaggggtgttgtgaggattaaatgtgaggaggatagtggcagatgagtgatgg

SEQ ID NO: 2023 - DNA, 1239 bp, Homo sapiens
cctgccccctggcggaccccaccccctgtcctgggcgtttgccccagttccctccccaggcctcctgggccacctctcacattaacccttcttggctgcctctgaggctcccctgggctgcgtttgggagctgctgggtgggaggaggagggtgggatttgtgctgggctccacccccagggagggtgggagctggagggggatgtcacatgtccttgtgtttctgcagagcctgaagcttttgctgggcctccctgcgtgttcccatctgaagaggtagccccgggagaggccctcagggaccgacccagaccagcaagctccatttccaggggtctgcccagagaagcctggacccagggggcttctcagctcccctcccttccagcccaggcctccttgagctcctgtagcctctgcagctgcccatttcacctctttgtcattgcaatgacctggggcccagggtcacgcccaagcccctctttgtggcatgctcatctcagtgcagccccaactgcttctctgcaccaggccccgtgccctcccctggccctggccacacagcacctccttggccaccttgcatggatgcatgtcctccctctgtccctcttgtggtgctgtggctggccacgtgtcagggttttctgtgagcctctcaccttacagcctttgggcccctgggcccctgccctgcctgagccctgcgctggccagacgcaggtaggtgccaggggaggccttgcctctgggcactatagggggcagccccctgccttgtgacctccctccatgccccatgacctccttcaactcgtcttgagggtctggtcaccacggaggggagaagggagacacagaggcccaagtggctgttctgggaccatggaagcctgggtcacagaggcaggtaccagcagtcctgcccccacccccgtccctgctggcctccagccagtgccacttggagtcccctgcaccgtgccactttccatccccacaccattgcctgctcctcccatggggctttagcctcccctgaccatctgctcatgtagcctctgactgggcgcacagtggtgcaggaggaaggaccgggaaccctgtgtggctttgggcaagctgacaaacccgtctggaactcagtttccccagctgtgaaatggggccagtccccatgccctgctgtcctcctcacaggactgttgagaggctcgcagggggatggggtgaatc

SEQ ID NO: 2024 - DNA, 1190 bp, Homo sapiens
agctgggcctggtggcgagcgcctgtaggcccagttactcgggaggctgaggcggacgcagaggttgcagtgagccgagattgtgccactgcattccagcctaggtgacagagtaagaccctgtctcaaaaaagaaaaagaaaaaagaaaaaaaagaaaagagaaattaattatgaagaggtcttagaaaataaatctccaaacccacttatagtcacagataataattgggcgtacaggtatatgtctttccagtcattttttctgtgcattttatagctgtttgcgtggcttttatgccattcgagtcacgttggacaagcagttttgagccctgcatgattatataatgggcgcttccccaggtcattggaatgacttgtgggtgtcttgatcagtgtgtggttttctgtcgcatgaacagattgtggttcatgggcctgtttctgtactgttgtgcgttgaaggggtttccatggattcacacactggcgtgtgtctgatgcgccacccaacctgcatgggcaggaggaggtctctttgcctggggtcggggtgggggtgccctgttctccctctagtgggcgagatggggtctgctgggctgagtgagaggccgccctgaattcctcggtgtggatttcaggaagtggcatgacttgttctaactgaacgtttatttgatacgcccttggtacatgtgttttccagaagtgtaatactggcttccccttccatttttgtatcgtattaaaaaatacgtaaattctaaagtaagtgtttatgataaaacattcgataattcacagaggtgaaaagctacccccagaatccctttctgcttgaattccacgctctggagaggaccccgtgagggtccaggcacagctctgcccccggcacccctcttctctctgctgcttccacactgaaaggcggaggctctgctgcctgttttcttttgttgctccccattttaactaaacactaaagaaagtcaagtgtgaacgtcgcggtcattcatttcgcctgtgccgcactttcctgccccggcgagccctccgccagcactgaccggagggcgcttccttcagctttctgggttgtctcactggaacagggtcagccccattccctcccatcctgccccctgcctggtctgtagccacgtggtgccaggagtgagctct

SEQ ID NO: 2025 - DNA, 2008 bp, Homo sapiens
ccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagaggtgagggagcttgacttttagaaatcttcagtgggggaggtattggggatgggttggggagtggggagggagaaaccatgtcacaggtgcttggctcttggaggaggtatggggaccttgaccctcaagctgggggtagaagagaatgctggggcagggggcggagggaggaggaatgggacagataaaagtctccgaaggttcattctctagaggataatgataagttttccgtctctacagaggacagaactagaggaaatggacttaattttacagcaggagggatggcagttagacctcaagaggaactccctgggctggaaggatcttcagaggtcatcccatccctctccctgcctccaggcaggacggccccttccccagccaacctgcactcacaggggcctccccaagctgcggctctccgaggaaggagactacccagcttcagcttccacacctgagcccagaggccttattcctccatcaggg

SEQ ID NO: 2026 - DNA, 1175 bp, Homo sapiens
tgtgcatccatccatccctgcctctgtgcatgcatctgtccatccatccccgcctctgtgcatgcatctgtccatccatccccacctctgtgcatgcatctgtccgtacatccatccctgcctctgtgcatgcatctgtccattcatccctgcctctgtgcatgcatctgtccatccatccatccccgcctctgtgcatgcatctgtccatccatccctgcctctgtgcatgcatctgtccattcatccctgcctctgtgcatgcatctgtccatccatccatccctgcctctgtgcatgcatctgtccattcatccctgcctctgtgcatgcatctgtccatccatccatccctgcctctgtgcatgcatctgtccattcatccctgcctctgtgtatgcatctgtccatccatccatccccacctctgtgcatgcatctgtccatccatccccgcctctgtgcatgcatctgtccgtccatccatccctgcctctgtgcatgcatctgtccgtccattcatccctgcctctgtgcatgcatctgtccattcatccatccctgactctgtgcatgcatctgtccatccatccatccttgcctctatgcatgcatttgtccgtccatccatccctgcctctgtgcatgcatccatacctgcctctgtgcatgcatctgtcagtctatcaatccccgatcccttctttgtaatggtgttgagcgctcacaactccctcatcctaagacgctcgttggatccattccctcccctcaccccatgctgctctctgccctcccttcccggtcaagttctccagccagtggtctcaactcaatcttcacttcccccgctcctctcacacctatccccactgcattctaaattcttccccaacgcgctgggcctacaggcactaaaaaggtcactttgtccctggatgaccaaacacaggccaatgtaacttactgggcttgttttgccccagccacagctgaccacttcctccttcactcttgttgttgatcacctttgggcttagtctttctccatctctgttgagtccttctcccctgccacctactccttcatgctggggttctctgtagctctgtacctgacagtcacgttccaccctttcctcccagaagctcgccaacccccgtggactgctggc

SEQ ID NO: 2027 - DNA, 1230 bp, Homo sapiens
ttcccccagcacaaatctccccccatcccacaaaatgcttaaaaggtaaccggactctttgttcaagcctcagtcctttggatgtgaatcccactgggtcagtgcacctaaataattaaataattccaccttaacccctcggtctctctgattccttaattatcccactgcagaggtgggtggatcacctgaggtcaggagttcgagaccagcttggccaacatggtgaggccccgtctctactaaaaatacaaaaattaaccgggcatggtggcgtgcacctgtaatccccgctactagaggggctgaggcaggaattgcttgaatccaggaggcggaggttgtggtgagcagagattgcgcgactgctctctagcttgggcaacaagaatgaaactccgtctcaaaaaaacaaaacaaaacaaaacaaacaaacaagaaaaacatcagacctcgtgagaactcactcagtttcaccagaacagcatggtggaaaccacccccatgatccaatcacttcctaccaggtccttcccttgacatgtggagattacaattccagatgagatttgagtgaaatagagccaaaccgtctcaattgcaccccggatgtgctgacccctgtgatttccccaagtgtgggacactcgcctgcataatttgtggtagtgggggactgcattcataccttcccctgaaaacaataaaataaaataaaataaaagttgcttaaatagaatcaggtgcctgtctccaggcttctctgacaggcgggaacagggaggcggggggcccaatagtgacagcagagaccgtggctctgatggacctacccacattccagatgtggaaaagcaaggccaggcccctgactttcttattgataatgtgcatgggtctccatgccctggtgggttggttgaggactagaggatttcagcctggcgtgtccttgattacagagccggaagcacagaaccgctccctgatcgccacccctgggcccccggcctgaggggactttggccctgcatctttcttgtcatgactccctcttctgtcctcatcccccgggcagggctggggccgcaaaatctccttggttttctcccaagatcaagggccccaggggctggggcagagcggactcaggagtcccccactaggccctggtttcaggggagaggcaagaaggcagaggtcaaatctctgggcctgaggcctcagcac

SEQ ID NO: 2028 - DNA, 1146 bp, Homo sapiens
ggaagtcctcgcggggctcgctgggaaactacgctacgcaagcattccccagctcccagaaagccgttcgtccactgagcccgccttctccatgaccgatggccaatgaacaggaagaattctcaggctgcctattagaagacagaaactccatacgcgtcatacacctgcacccgggaggaaaggcgaggctctgcatctagatttacctcgttctcttttgtctccgcttttttttcacatttccttgcgaccctggcccttgagcgacaaaaaggggaagccaaggctggcccgaggaacggagagggcacatggcctagccacaagtggagcttctgctccgcccgaagggatgcgctggagcggcctcttccttctgccacggtctttctttgccaactagtaggtgagggccgaaaggccgcgggccgtggagctcgggccggggagactcttttctagcctcttgggtcccgctcctcccaattccctggagaggcgtcgagcttgctgggaagtgccctcgggtaaggggcgcggagcctcctgcggcgatcctctgtcttcgggtcgccttagcaggacgcggcaagcgggacactgacctggccggagtcccgcgttctctcaccagctgctttgtccacgagttgctgctgggcgtcaggggtcccacggcccggagggatctagagcaggggggctcggggtcctttccataccctcggatcctctcccactctctccacgcctcgacccggagatgatttcaggctccagatctctttcataaatggaaagagtttttttggtttgttttgtcttaattatgtaggtgttgcatgcttggaagagaaaatttagaaaattaattggaaaaccataaagatagctttctcgtgatagccacaaggcttgctccctcattctgctcatatgtcaccccctcaaggaggccttccccagctctgtaaacaacctgtgctcggcgttaacttttctccctaatgtttatcactacctgacatatacgtgtttcccacgactcaacgataagtgttcatgagggcagacactttttaatgccctatgacaagcacctagaattgtgcctggcacatggtagatgcttagtaaatattt

SEQ ID NO: 2029 - DNA, 1176 bp, Homo sapiens
gacgttcccgctcccgggagctgcaggtgccgcacacacccatgagggacggcagacaggggacacacaccgcaagggacggcagacaggaaacacacaccctcgagggacagcagagaggacacacacccgcgagggacggcggacaggacacacacccgcgagggacggcagacaggacacacccccacgagggtcggcagacaggacacacccccacaagggaccgcagacgggacacacgcccgcgagggacggcagacgggacacacgcccacgagggtcggcagacaggatacacccccacgagggtcggcggatatgacacacacccgcgaaggacggcagaccgcacgggcctggcggcgtcctcggtccgcgccgagcttagggctctagcgctcaggatgtagcatgtctcatgtctcggatccaggactcatccccaccaattttatatagaatagggaagttcgggagagctccaacagaggtgtgggaaaccattttcctcatagccgcccggctagctcagtcggtagagcatgagacccttaatctcagggtcgtgggttcgagccccacgttgggcgtgagattttgtcggatggattagacttgcaacttggaagaaagtaaactaaataagaaaacgtggaagtgactccgtataccttgcaaatcgggaattgttggtcaggcaaacgcaaaacgctccaccaaccaactggcttcaggatcccctttgtcttgtttcataaaaaaaagaggccgagcgtcgtggttcatgcctataatcctctcactttgaccctaggagtttgagaccagcctaggcaacatggtgagacccccggcccttaaaaaaaatacaaattttcgccaggcttggtggtgtgcgcctgtagtcccagctattccagagactgaggcaggagaatcacttgaacccgggaggtagaggttacagtaagccgagactgtgccagtgcactccagcctggacaacacagtaagactccgtctcaaaataataataaaaagaaattggccgggcgtggtggctcacgcctgtaatcccagcactttgggaggtcgaggcgggcggatcacgaggtcaagagatcgagaccatcctggctaacatggtgaaaccccgtctctactaaaaaagag

SEQ ID NO: 2030 - DNA, 1159 bp, Homo sapiens
actgcagggacccaggctaccagccctgccagcctgccttcagggtggaacagcggtttcctctaaaatcctgtctttttgtttgtttgtttgttttttgagatggagtgttgctctgttgccaggctggagtgcagtggcgcgatcttggctcactacaacctctgcctcccgggttcaagcaattcccctgcctcagcctcccgagtagctgggactacaggcatgcgcctggctaattttgtattttagtagagatggggttttcaccatcttggccaggatggtctcaatctcctgacctcgtgagccaccgtgcccagccaaattctgttttaaaaacggaaaaatggccaggcgtggtggctcacgcctgtaatcccagcactttgggaggcggggggatcacctgaggttgcagtgagccgagatcgtgcctctgcactccagcctcggcaacagtgagactctgtctcaaaaaaaaaaaaatgaaaaggtgccccatgcccctcataatgggtttctcctcttgcctttcagatatacgagaacgccatgattgctgctggacttgttgacgaccctagggccatggtgggccgcttgaatgagctgcttgtcaaggccctggagcgacactgacagccagggggccagaaggactgacaccacagatgacagccccacctccttgagctttatttacctaaatttaaaggtatttcttaacccgagtgtgtgttgggctttttttctgggtcctgtggcaggatgggtcctctcttcctgcagttcaactggtgtggggaggggctgctcacttcagcatcacctccactggatagtggtcactgatggcttgggcctgcaggcaagtgggcacagggtctgggctgagcctacctgagctcctgtgtcccatcctcatgtggctgtgcaagggaggacacataccagttggtcactcaggccataggcagcctggaagttaaagggaagagccgagtcgggaacaacggcgcctcggagcagcatccctgcaaccacgatcctgatgggtgttgggaagagaaagtaggttcccctttcacacatgggcctggctcagcacccgcaggaactaaactaagagccctgggacctgccagtgcaggtctgt

SEQ ID NO: 2031 - DNA, 1099 bp, Homo sapiens
atcctcccacctcagccccctgagtcactgggaccacaagtgtgtgccaccaccgtcagctactttgtgtattttttgtagagatggcgggatccctctgtgttgcccaggctggtcttgagctcctgggcttaagtgattctcctgccttggcctcccaaagtgctgggattacaggcatgagccatggtgcccagccagactttgtttctgtctgcttctttctttttgttcatgatcttaaatgtgtgggaggccgaggcgggccaatcatgaggtcaggagatcgaggctatcctggctaacatggtaaaaccccgtctctactaaaactacaaaaaattagccgggcgtggtggcaggcacctgtagtcccagctactcgggaggctgaggcaagagaatggcgtgaacccgggaggcagagcttgcagtgagccgagatcgtgccactgtactccagcctgggtgacagagcgagactccgtctcaaaaaaaaaaaaaaaaaaaagtttaaaactcataaacttaagctttctttggaatgtgacgtagcgtattcttgcacaaaaatagaagttaaactttgttggttgtgtctgtgtttcattactaggttccacttccaaacatgagttccaggccgagacaaagaagcttttggacattgttgcccggtccctgtactcagaaaaagaggtgcgttccctgctaaccatgcccgatgctagcaaagtttcttttcacaaagctggtttttatgccattctggagaattgccagataatatattagctgtgagaaagcattaaactttggacaggtcctcatcttaagctaccagtgagaggagttttaccagaatctgttttggtttcctggataagtgtatccagatggttctttgggctggatcaactctgggaattaattgaattttgccaataattttaaaagttcccgaaatacaggcctggtgtggtggctcatgcctgggaactcagtgctttgggaggtcgaggcaggaggatcacttgagcccaggagtttgagaccagcctggtcaacacagcaagactccgtctctacaaaaaattta

SEQ ID NO: 2032 - DNA, 1169 bp, Homo sapiens
cccccagcaggagtgcgctgtccagcgaactgtccctggtcggggacaccacgggggacacgctagagaagtttgtggagggcttgtagcattgtgagagcatcaccttttccctttcatgttcttggaccttttgtactgaaaatccaggcatctaggttctttttattcctagatggaactgcgacttccgagccatggaagggtggattgatgtttaaagaaacaatacaaagaatatatttttttgttaaaaaccagttgatttaaatatctggtctctctctttggtttttttttggcgggggggtggggggggttcttttttttccgttttgtttttgtttggggggaggggggttttgtttggattctttttgtcgtcattgctggtgactcatgcctttttttaacgggaaaaacaagttcattatattcatattttttatttgtattttcaagactttaaacatttatgtttaaaagtaagaagaaaaataatattcagaactgattcctgaaataatgcaagcttataatgtatcccgataactttgtgatgtttcgggaagatttttttctatagtgaactctgtgggcgtctcccagtattaccctggatgataggaattgactccggcgtgcacacacgtacacacccacacacatctatctatacataatggctgaagccaaacttgtcttgcagatgtagaaattgttgctttgtttctctgataaaactggttttagacaaaaaatagggatgatcactcttagaccatgctaatgttactagagaagaagccttcttttctttcttctatgtgaaacttgaaatgaggaaaagcaattctagtgtaaatcatgcaagcgctctaattcctataaatacgaaactcgagaagattcaatcactgtatagaatggtaaaataccaactcatttcttatatcatattgttaaataaactgtgtgcaacagacaaaaagggtggtccttcttgaattcatgtacatggtattaacacttagtgttcggggttttttgttatgaaaatgctgttttcaacattgtatttggactatgcatgtgttttttccccattgtatataaagtaccgcttaaaattgatataaattactgaggtttttaacatgtattctgtt

SEQ ID NO: 2033 - DNA, 1190 bp, Homo sapiens
gcatttctgagaaatgaagtgacttttagaagaaccgagtaaatacaccgcagtagtcctgcaagaagcaacaactcagtaaacagcacaggtcatgggtctgggtgaggtcagtcgtagctagcagtaatgcgaatataatacttcacttcctctggagcggtgtgagctacatcagtctctgcacagcccaaatcaccctaacttccttttaccttttccacaaccctttgagatggccctgaggttcacgtcaccaaaaagacagtctgtccagtaactaatttgccaagttatcaaaaaattgtgtaaatttttgtttatgttcctttttttccctctaatccttagaacctgtaaatgtcgtaagtattcttgaagaatacatatgtatatatcaacagtattcaagaagagtattctaaaaactttaagtttttagtaaattggtaattctcttgaacttggtcattcgactcctggtctggtccagcagtcactttgaccgtaggaatagatctggtgccttctatcttctatcttgcaggttgtcttttttgttgtttctttggttggttggtcgggtgattttttttttttaagctggggtctcactgtcaccccatttggagtgcagtggtgtagtcttcagctcactgcatcctcttcctcccaggctcaagcgatcctcccacttcagcccccgagtagcttggaccacaggcacgtgccaccatgcacagcaaattttttgtattttttttggtagagacaggtttcgccatgttgctgaggctggtctcaaactcctgagctcaggagatccacccacctgggcctcccaaagtgctagcatcacaggtgtgagccacctctcccggccaccttataggttttctttgtgctgtaacaagtaactcccaccccttctaggtagaatgctgggttctgaaggctgtggctgtgggtccaggaagagagtggggagggagtggcaagtccctcgcccttggccacatttcttaccctgagccttggccttgggctcaggctttcctgctccccttagccatttgctttctactttaaatcacagctttaagattacttataaatcattctggattatttccctattgaatttagatgttttgttttttttgttgttgttgttgttgagagagagtctc

SEQ ID NO: 2034 - DNA, 1753 bp, Homo sapiens
atatctgagtttgccctcaacaccacactatttaattattgttttagaatatgataaatatagtagggctgtccttctcatctctgtttaacttttctgtcttcagaatttgaagggtattttttctttattttcccaaacaaacttgtaaatcattttgacattactctttttttttttttttttttaattttttttttttttttgagacggtgtttcggtcttgttgcccaggctggagtgcaatggcgtgatcttggctcaccgcatcctccacctcccgggttcaagctattctcctgccttagcctcccgagtagctgggattacaggcatgcgctaccacacccagctaatgacatgactcttaagacatgctagtgttcgtgctgaatgccccattaggttaagatcatagaaacgtggcagttggagagctgtaaaggttgcttagtttctcatttccatttctgtttaatttctagattttggatcattgtttgacttggaaaatgatcttcctgatgagctgatacccaatggaggagaattaggccttttaaacagtgggaaccttgttccagatgctgcttccaaacataaacaactgtcggagcttctacgaggaggcagcggctctagtatcaacccaggaataggaaatgtgagcgccagcagccccgtgcagcagggcctgggtggccaggctcaagggcagccgaacagtgctaacatggccagcctcagtgccatgggcaagagccctctgagccagggagattcttcagcccccagcctgcctaaacaggcagccagcacctctgggcccacccccgctgcctcccaagcactgaatccgcaagcacaaaagcaagtggggctggcgactagcagccctgccacgtcacagactggacctggtatctgcatgaatgctaactttaaccagacccacccaggcctcctcaatagtaactctggccatagcttaattaatcaggcttcacaagggcaggcgcaagtcatgaatggatctcttggggctgctggcagaggaaggggagctggaatgccgtaccctactccagccatgcagggcgcctcgagcagcgtgctggctgagaccctaacgcaggtttccccgcaaatgactggtcacgcgggactgaacaccgcacaggcaggaggcatggccaaggtaagtgaactgaagcactttcaatacttcctacctaaccgcgggctttccctccgagtaatgcgtaaaatgggaccacgtggcccactcctgtttttcctcttgggctctccacgtgccactcatgcttggaagagacagatttctttctaggataaagatctctgccccatttctgtctttaaaatgagaattcttaaagaagtaggacagcttgcaggtcaggcagttggaaagtacagggcctaatgtgtccgtgaacctggtagaggttgctttctgcctgtgtactgcccactgaggaggtgatcactggtctgtatgctcctctgtggccatccagtgaagtatctgttggcacagtatccatttcactgaatgagaaagctgtgttccagggttgtcagctcactccctgctatgttaacaaggaagaggtggcagagccggggagaagcacaggcattcgggtcccagaggaaacaccagtgcagtggttcttcaagtggggtcccctggaccagcagcagcagcagcatcccctagaagcttgtt

SEQ ID NO: 2035 - DNA, 1175 bp, Homo sapiens
ggaattctgttccggaggagagactgctccctgtgaggaaagccagggaggggatgggtttttgttgttgttgttgagacaaggtcttgctctgttgcccagactgaagtgcagtggcgtgatcatagctcactgcagcctccaactcctgggctcaagcgatcctcccacttcagcctcctgagtagctgggactacaggcatgcaccaccacacctggctaattttatttttttgtagagacagggtctcactacgttgcctaggctgatctcaaactcttaggctcaatgatccttggccttgacctcccaaagaactgggattactgtgcctggcccggggtgggttctgagcggactatcttacccgcagccagctgattcagtccgccccggtgtcccagagagcacccctccatcactctctgggggtggcctggcatcttttgcagcaggggagggatgcagtttccactggggccctctggagatgaatgatgaagagggcgccttggccgagcctgtccctgtcctctctggcagccttgccaacattccactaacccccgagactcagcgggaccaggagcggcggattcggcgggagatcgccaacagcaacgagcggagacgcatgcagagcatcaacgcgggattccagtccctcaagaccctcatcccccacacagacggagagaagctcagcaaggtgggtgagagcagggagggcttcctggaggagccggcaggttcccgctgggagaggaaagtgagctctggtaaacactgccagcctgactctcggcttttccacgccctcaggcagccattctccagcagacagccgagtacatcttctccctggagcaggagaagaccaggctcttgcagcagaacacacagctcaagcgcttcatccaggtgcgccctgtccttcatggctccctctccctggcatgggcatgccttggacccagccatgggcctgggactcaggtgtggctgcaggccccttcttgcccactgacaagtacttccaggcactttttttcctgccccggcctcagtttccccatcggtcaagtgcggtggagtgggctctggaaggagccaggtgactgttatgtaaagcagcccattctcctggcatttggctggtttgttggacttgca

SEQ ID NO: 2036 - DNA, 1169 bp, Homo sapiens
ttgggcccaggtactttgttccttagccacaaacaccagcccttcaccctactcagttgcctgagtgggagagaaaagataggccctgtgaaaatttgtctccactttgaggaacatggttccaagggtaaggacatgtttttactcatagaagacacagggaaatatggtagttaaagttgtggcattttatagcatgtcactgtcctgtaggtggaggaagtgctggtgagaaggtggcaggcagggagagctctgcagaggaccttggcgctccatggggaggatggagagagagagccaggccggcagtggtgacaggaggttccctttcccccacgaggggacttggaaatagattactcaaaatggaaatgtgcccctttctaggatcccacaaaaagtttctgtttctgtctctgcctagtcaggagtctccaagccacagtctctgtgggaggtggtaaaggctaccttgcaatacagtgcagcagaggtggaggcgcctagggcctgggccagaacctccccatgcccagagggctgtccactcttggagacactggtctggtggctcctgaacccgtgggcctgatggccccggtcaccacttctcctactctgtgagtcatcaggcagtggtccatgacattggtggtgtcctgggaccagggctgcctagacgtggagacctctctgtcatgttgaagctgtgtgacagacaggccttgctggccgcgtctgtgataggtgaagagcatcacccaggccacaggaaggcctgcatctgctgttagcgctgaagagatgaagggtccctgacggcagacaaagcaaaaccaatacagagcctgcagtgcagggtgagggggtccaggagcattctgattctttccttgaaagcagttgtgatgcatttttggtaatactggaccatttttccaggaaacatttcttgtcaccttttcagtgctcctgatttgtgggtgagacctggcttggtctgtacattgagtgattcagtaccatcgattcttactgcaaggaggtgtaatgggggttcagtaaacactgagggtcttcctgagatgtaattgttcaatcaatgctaattaagtctgaattcagatctagtcccagtgtctgggtttttcccccaagaaggaaaa

SEQ ID NO: 2037 - DNA, 1124 bp, Homo sapiens
gcatctccagagacagccaaccctcctgtccacccccacttcataggctgtgaattggttcccctttaatgagttattttccattcaaagttgcctcaaatgggtcccagcctgattacagtgtgccagccttggggtcagccatacgccatgggtttccttggtcccttttcccccaacacaccccagtgcatcccagcaacagccccccgacttggaagccttcacggaaacaaccttggtgggttattatttatttatttatttatttatttatttatttatttattttttgagactgagtcttgctcttgtcgcccaggctggagtgcaatggcgcaatcttcgctcactgcaacctccgcctcccgggtttaagtgattctcctgcctcagccacccgagtagctgggattacaggcatccgccaccatgcccggctaatttttgtatttttagtagagacggggtttcactatgttggccaggctggtctcgaactcctgacctcaggtgatccgcctgcctcagcctcccaaagtgctgggattacaggtgtgaaccaccgcgcctggccgttagtgagttttttgctttttgcttgtttctttgctttctttttttgagatggtctttctgtgtcacccaggctggagtcagtgatgcagtcacagctcactgcagcctcaacctcccatgctgaagcaatcctcccacctcagcctcccaggtagctgggactacaggcatgtgctaccacgcttggctaattttataattttttttttgtagagacagttttcttctgttggccaagtcttgaactcctggcctcaagcaatcctccctcattacaggtttaagcctctgcacccaaagtactaggatcacaggtatgagccaccacatccagctaggtttttttgtttttgtttttgttttttgagacggagtcttgctctgtcgcccaggctggagtgcagtggtgggatctcggcttactgcaagctctgcctcccaggttcatgccattctcctgcctcagcctcctgagtagctgggactacaggcgccagccaccacgcccggctaattttttgtatttttagtagagatggggtttc

SEQ ID NO: 2038 - DNA, 1193 bp, Homo sapiens
tctgttggggaattgctttctatttttttcagaaaaatttatttttacttttttgaaattttcaatttcataaccattccagaaaaattaatttatatttaaaatttacaggccaggtgcagtggctcacgcctatatttccaggactttgagaggctgaggcgggcggatcacctgaggtgaggagttcgagaccagcctggccaacatggtgaaacccccgtctctactaaaaatacaaaaattagcctaacatgatggcgcacacctgtaatctcagctattcaggtggctgaggctcaagaagcccttaaacccaggaggcagaggttccagtgagctgaaatcatgccactgcactccagcctgggcaacagagcgagactgtctcaaaaaaataaataaaatttacatacagtaaaattcattttggtgttcagttctgtggtttcataaaggcatggagtcacagatccaccgtcacagtcatacaggtctatcgtcccccaaattccctctctgccccaacctccaaccctttaattttgccttttccagaatgtcatgtaagtgaaattatactgtaggcaggcttcttccatttagcgtaaatcatttgaaattcattcacgtgttgcatgtcaactgttggatccttgtgtttaatgctgagtagcatccattatatggatgtgccaccgtttgtttatccattcttttatgtatcataatagcagcctttttagatatgtccccgttagacagtgaggcactagggattggagttgctaagtagcagagctgcttttttgttgttttttttttttgttttgtttttggagacaaagtcttgctctgtttcccaggctggagtgcaatggcgtgatcttggctcaccgcaacctccgcctcctcagttcaagtgatgctcctacctcagcctcccgagtagctggccttcatgcccagctaatttttgtatttttagtagagacaggatttcaccatgttggccaggctggtcttgaactcttgacctcaagtgatctgcccaccttggcctcccaaagtgctgggattacaggtgtgagccaccgcaccgggtccaagctgaattttgatcaaaccccaaatccagggttcttccccaccacatcaaggaactgattgggttaaacaacccaattagcatt

SEQ ID NO: 2039 - DNA, 1186 bp, Homo sapiens
aacatttcctttagaccctccccgaaaaccccctagactcattaccagagtctctacctgtttttccctcagcctctggcaaccacaaagctccttcttgtctctgtgaatttgcctgttctggaaagagtttgcttgtttttttaatcatgcttccgggtcaatctggtgctacatctgggagccactggcccagaggcatcctgaagtcccccgtctgccgcaatggggtcctggggctggctagccacggagccaggggatgctcttgtctccctgtggagcatgggcctcggtggctgagtgtgcagtgggtccaccactcctcgtggcgaatctgtcccttctccggtggtgtcccagctctgcagcagtggcacatgggagcagtgggcggagacaccaggactcaccactgcaacgagagtggagaagaccagctgcaccaccaggcttggcgccagcctcgaggggcagtggcggtgcagctccctgggccagtggccttagttggggaggaggcagcttgcttggggccaggactgagtggggtgcgttctggcaggtgcccgtgaacttggaggacgtggctgtatacctttctggggaggagccaagatgcatggacccagctcagcgggacgcgccgctggagaatgaaggtaacttgcaagtgattgtgtcctctagggggcttgccaaaaataggaactgtcaggcaccagctccggggcttggttctgttggtccagttggcctggggcgatcctccgtggacagggctacccgtatccctgcagagtcccacctgcagggcctgcacagccactcggccgtgactcaggcagatgcccagcactgccttgccatcctgttcttctgcctctgccccctacatgctggtcctacttcacttcagcttccctgtgccctcctctcaagggcagagctgctcccacaggacctggttctccagcctctccccatcacactgagcactgccctgcctgttacccagcaccgtcccctaagctctttctctgtccgtttgtctcttcctgcctttcctgatgctgctgaagccttttctggttttttgtttgcttgtttgttttgagatggatttttgctctgttgcccaggctggagtgcagtggcacaaccttggctcactgcaacctccacc

SEQ ID NO: 2040 - DNA, 1228 bp, Homo sapiens
ctcttttagagaaaagacctttgtagattcaacaattatgataggatttttacagacacctattttgggctcagttttcatcattaccattaaatgcattggatagaaggggactgttcttcacacatcatattataggaagacataattccagtgcctttatggtggagcagaattcgacaacacatgtccattcagccctctgaatggatctgagacgaagacctttttaaagatatgtctgtattgaagagaaagccagttttgagttttttacacttgcacatcattatctgtgccgtcctgactagaaggttgtctgggcccccaaattccaagtcccagtatagccagggctcccattttgtttttccagagttcgtggaggtggactgcagagcccagagcccttcatctctctgagggtcaaggataccaggggtcccaagtcacagatagacattccagtttgtattcttaggaatcattcttaggcagtgcggcagaagcaggcctctgtgaagtgtctgccgggtagaaataggccttgaagtcctggggctctccaggcagtggggttatgtgtcgactgaagggtgatgtgcagaagagcttggagagtggatcagagagactaggacagttactgcagagctcctaagtcaccactcaaccagtggctgtttcacaaggatttgagggcacttgcctgtcttgtgaggtctgtgccacaaggtgagtctgaactgactgctccagctaagtgatcaggcacgttgagagtatacggtgtcctcagcacatacacctgtgggaaaacggaccgctcttggctcctgactcccagggtacagcgcccagtaactcatccttcattcagaggtttgctggccttcccggtttcccaaggagcaagacctctgtccgccctttggcccggcctctgctctgtctcctttttttacataagaaccaatccgtgtttcacattgggctaagtggattccttatccctttgttatatatattttttgcaacttggatttccagtttgtttacagagtagtcttaggtagtagcaaaagagccaaagaagagatttgtattgctgagctcaaagccaagcagaggccggcagtggaggctgagcagggactctccaggcttctctgcccataaacacccgggtcccaggccctccttcctttccctttggtgctccctcctc

SEQ ID NO: 2041 - DNA, 1099 bp, Homo sapiens
gatttctgtctacgacgtcgcccccactaagacctagggcttaggtgtcgaggtgggaaagatcttgaggcttttcttctcaaaattaatcagaaacgatgtgaattttatatctctttctgaggttttccccataagctaatcgggattagtagacttaaaggtgaatgaccaactgtatccctggttcactggttaggaagagtacatagtctttgtgtataggctattttcctcggtaaccttgggcaacatgcttgacttctccaagccagtctcctttgtgaaaggtgatatacttacaagacattatattaaatgagaacccaggcaggttacctaccctaccatgacactggaagtattctttgccttaagaaaaggagaattgctggttggttccaggtccggtgggtaccctcatttcccctgggcaattttactgtaaaaatagaccaaggatctcaaggcccagtggcttttgccttctgggatacttttttacctccctgtttagtagtaagggtcacattttaaattgcagctatcacactggagggatcagatcatttagaactttgactgcttaaatattactcttgctaagatcttgagcttgtctcatgttgacagactagtgaagttggttacgttgtctgtctcctcactggagggagagattcagagttgccctgtccaacccagtgctatctctggaaagggttggattgaaatctagtctgccttcattctgaggtataatcatgagggttaggtgaaagggtcccgagtgagaagatggcatgggtcctagggtggggagcccgatgccaagtcagacttcactcggtatgtttattcaaagccccactttcactcgtagcatatcataggtggtctctgcaagttgctgaccctgattcagactgttccataaaagtcagacacttggttttagttcccaaactgattttgatgacattcttgactgcagggcttggagttaaccccactgggcctgagttgtctctctgtaaagttacacatcatttcagactcaaaggcctctagcatgcagggtctggtgtcataataggca

SEQ ID NO: 2042 - DNA, 1200 bp, Homo sapiens
ttttttttccgagatggaatcttgctctgtcacccaggctggagtgcagtggtgtgatctcagctcactgcaacctccatctcccgggttcaagcaattctcctgcaccagcctcctgagcagcagggattacaggcacatgccaccatgcccagctaatttttgtatgtttagtagagatggcgtttcaccatgttggccaggctggtcttgaactcttggcctcaaatgatctgtctgcctcagcctttcaaagtgctgggattacaggtgtgagccactgcactcggcctcatatatcacaaattttgatatgatgtattttcattttattcagtgtaatgttttaaaatgttccttgacactttctatttgaactttgaattacttagaaatgggttgcttacttttcaattgtttggagattttcctgttattgatttctagtttgatttcattgtgattgaaaaacacaactgtaagaattaattcttgttcagttacttgaggggttgttttagaacccaagacatggtcttcttagaatatgttccatagcactggaaaaaatgtgtattctgttgttggtggtggaactttctattaatggtgattagatctgatgggttgagggtgttgttgtgttcctctatatctttgcacagcttctttctacttactctgtcaattgttgagagagggttgttgaagtctccaagtgtagttgtgcatttgtctactttcatttccatcagtttctgctttatatattttgcaggtttatttttttggtgcatttacatttaggattactatgtcttcttattttattgacactttcatttttatataatgtttatctctgtttctattttttcctataaagtctgatttattggatatgtatattgccattcctcctttttacttttactaatgtttacatcgtatatattttccaaagctttttttagacagggcctcactctgctgcccaagcagtggtgtgatcatagctcactataagcttgaacccctgggttcaagcaatccttccacctggtagttaggactgcaggtgtataccactatgcttagctaattttttaatttttatttttgtagaggtgggtgtctgtctatgttgcctaggctggattgaactcctggccttaagcaatcctcctgccttggcctccc

SEQ ID NO: 2043 - DNA, 1312 bp, Homo sapiens
tcccagcactttgggaggctgaggcaggtggatcacaaggtcaggagttcaagaccagcctggccaacatggtgaaaccccgtctctaccgaaaatacaacaaaattagcccggtgtggtggcaggtgcctgtaatcccagctacttaggaggctgaggcaggagaatcgcttgaaactgggaggcggaggtcgcagtgagccgagattcaccactgcactccagcccaggcgacagtctgagactccgtctcaaaaataaaacgattcaaaatcgaggcctgtggcatggtagggaggctgctttacgcgtgcctattattaaatgctcctggaggcatttaggtatttagatcagtctaaatatagctccattcagttcgtgcagatgacagttattgggcagtacctgtctgtgtaacacccagaaaacatgtctgtggaggggcccatggtcccgacagtaaatgcggtgagagggtcccatagagctggagttttcaagctttaggggttcccgtgctgcttgggacaggctgattcagagggtctgggtgaatgatttccaggtgattttaagactgtgctgagaaatagggcttttggggccttgtccttcaggatcaaagcatgatgctgtgtggcaatgcagaccacccaggaaccatcccaggagataagctctttgcacctcattgtctttttctgcttatgttggagcaggatgctgggggctgtcctgggatggggtgtgggacctcgtgctatttaaatacttttgcacttgaccttctgctgagtggagtggtggtttgccatcagctcagttccagtggagctgaagagacatctggtttgagtagttttagggccaccatggatatctcttcaatgcaggattggctctttccatctgctctttcattcatttgtttttgacagatagtattaaatgtttaccatgttccaggcactgtgtgaggctctgaaaatacaggggtgagcaaatccagatatcctccctgccatcatgaagtttggagtctatgagataggaccccctccctatggagaagccaccaatgcagtacagggtgacctggggccagagacaggacaaatgtcacctcctgcctccatgagatactctcactagtcatattgtgggcaagaatgtggcttacacccctagggttaacaggatgctacccaagctcatggaggaagttgaatcttaagttcccttgaaactttctaccttggtggcttttctataattttcttttttctttttctttttttttttttttttt

SEQ ID NO: 2044 - DNA, 1205 bp, Homo sapiens
ggttttatgtgacttgcccaagggtttgctgaataaaaagctaagaagaggcagaatcagaatttgaacccagacagtctggcactagggctcatgttcttgaacttgtttggattgttgtttgtgccttgtgtgacatcacactgtcctgttttcttcattggcttgtgacacacatcactttgcattgatgtctgtttgttctgtgtctaccagctgacacgggagctttggtgtggggagtttgtataattgattccctgtgtctggaatacctggtgaatgattgttgtgtgactaagcaagcagtctgttccttggtcaggttcccctctggatagcggcttccgcaggcagagcctgtctctcatttgtctgtgtcctcagtgcgtggtgctggaccaggcacacagttgtggcctaaagagctgtgtcaaaggcagctagcaccccatgtgcaggttagagaggggaggtgttcacccttgtgcaccgtgaggctcatacatgcccctcctcttttccagacccttcctggatatggtgtaccacgcgctggacagcccggatgatgattaccatgccctgttcgtgctctgcctcctctatgccatgtctcataataaaggtaagcacccttgccttgcctgacttccttgctgggccctgcatacccatagcatccttcccctctgctgcatggaggacaaagaaaggtgctttctgtacagaatttcctttctggttttggtggtcctttttggttttgactcccgctcctctttagcttctttagaatttctcaggtgtttttctaccaactgaagccacaggaattggttactcaggcaatatggaggaaggtgacttgagtgcctaacccaggatgactatattcaccctgtggttttcttttgaccccttgatttacaactgacttagcgtctgacctctttcctaacatcagaactgaaatcagtcaaattgtaatcttggttttgctatttataacacttggtgttcttattctgtgttcagagctgaaatagaccctgggtggacttggtggaagcataggtttcctttctgaagaaaggtgtggttctctggcttcccctattaaggctacttggccaggatccaactcccatggggttgacaggttttgttgggattcattcattcaccgccttgctgccgacccc

SEQ ID NO: 2045 - DNA, 1188 bp, Homo sapiens
gctcgcggcaacctctgcctcctgggttcaagtgattctcatgcctcagcctcccaagtagctgggattacaggtgcccaccacaacacacccggataatttttatatttttagtagagacagggtttcaccatgttggccaggctggtcttgaacttctgagctcaggcaatccacccacctcggcctcccaaagtgctaggattaagagcatgagcccctgcgcctggcctgtagtttaactgatgttttatttagcatgtgctaataaagcaaaaaggggataggaaagaatgtacctttttctgcagtatcttattcaccctcctttaacactaaatactttataatcacacaaatattatactccatgaaaaaaaatgaaagcttcacacataaggataaggtccctgttgatgttcgttctccaacatcaaaccactttcattatccttttagattctttatacatttctaaacatatgtgcctgtaggggaaaaaacatatatatatatatatatatacacatacatacatacacacacacacatacacacacataacttttataagtgtgagttctttttttttttttgttaacatcaaaagtctactctttcagcctctgtttgtggtgtatagtcctgcctcattgtttttaacatttgcagaatgtttcttggtgaatatccttgcatgtgactcctaacaaacatgtggatgcttagcagtggaaatcccagctgtgtccattcttgtagtcggtacagcagctgctttcctgagtggctgtgccgttttgcctttttccaccagcatcacatcaaatactcatttctttactttcatcaatacttgatgtttcctttgtcttaaattcttggcaatttgagggtcaaaagtagtcttttgttttaatttgcttccttttgggatagtgaggttgagtttatttccagtaattattagccatgtatacatatttccttttctgtggtttgtccatgttaacaattttccttgttgatttgtataagtctttatatatgctagatttgttcatttaataaatattttttgacctcttaactatacaccccggcacttctgtaggtgctgggatactagcatgaaacaaagtctctaatttcacagaaattacagtcagaagaggaaattgggccgag

SEQ ID NO: 2046 - DNA, 1080 bp, Homo sapiens
ccctggccaatatggtgaaaccctgtctctactaaaactacaaaaatggccgggcacagtgtctcacgcctgtaatcccagcgctttgggaggccgaggcaggcggatcacctgaggtcaggagttcgagaccagcctgaccaacatggagaaaccctgtctctactaaaaatacaaaattagctgggcatggtggcgcatgctctaatcccagctactcggggggctgaggcaggagaatcacttgaacctgggaggcggaggttgcggtgagccgagatggtgctgctgcactccagcctgggcaacaagagctaaactccatctcaaaaaatatatatacaaaaagtagccgggcgtggtggtgggcacctgtaatcccagctacttgggaggctgaggcaggagaatagctggaacctgggaagcagaggttgcagtgagccgagatggtgccactgcactccaacctggccagagcaagactcccatctccaaaaaaaaaaaaaaaaaaaaaaaaaaagaagaagaggggtgggggtgccgggcacgacctaggctctgttgcccaggctggagtgtagtggctccatctccactcactgcaagctccacctcctgggttcacaccattctcctgcttcagcctcccaagtagctgggactacaggcacccgccaccacgcctggctaattttttgtatttttagtagagacagggtttcaccgtgttagctacgatggtctcaatctcctgaccttgtgatctgcctgcctcagcctcctagaatgctgaaattacaggcgtgagccacagcatccatccaaaaaagttttattattaccctttaactctcaagacagccattatttgtgttgtattttgtgccatgtgagtataaaaatgaagtaataagggagctcattatcacttaacacacagtgatattggcatttgtagttagtctttctgtgtagtcaacttgccataaagttctagatggtataattgactgcgtttatataaaagctctaagggtttgaatcaaaataatacattctttcagttttattttattt

SEQ ID NO: 2047 - DNA, 1117 bp, Homo sapiens
ctaaatcctttcatatttctcgtgtgtcacgattttaaactttcctttttttcttactatcagggtgtctcaacactggaataactaggctgttgggaatgttagaactcttgtttgcattttgtttgccattatgaaaatgaagctttgctaaaatagcaatctcagcctgtgagtcagtgccctctgatgtgataccagcagtgagtctgccttgaaagctgtcacccatttctgctatgaaagaggttttcctgcttatgtgtcactaggcattaggaaatggaactacatatgcaaacttccatttgttgttttaaagctagtgtattttaaagtatagattgtaagtctttttcagaatactaagttaaaatgtctttcttcagtagaaaatggagagacagaaatgtctccagaagaatcatgggagcacaaagaagaaataagtgaagcagagccagggggtggttccttgggagatggaaggccgccagaggaaagtgcccatgaaatgatggaggaggaagaggaaatcccaaaacctaagtctgtggttgcaccgccaggtgctcctaagaaagagcatgtaaatgtagtattcattgggcacgtaggtaagctgctctcatagcaattaaagttactggatacataaaacatagaacatcctttttagctacctggagatgtttagtgaaactgaaggaaattaattgaaaatgtcttgatttttaacttgctgattttttttagctggcaaaaaattgcaagtacttttttcctgaagtttaggcaaatgaataattctgtaacggcatagatgctggaagaaaaacttcagtatattgtacgtaacatataattagtctattgaccattgatggtagttcagcatagtattatatatcagtatcttagaaaatgtgcccttttttatgtgaacctcagttaacttgttaattttaatgggattgaccttaccagataattttgtgtgaagcaggaaatcaataatttggagtaacttctggatgcttgccaggttgctggtttagcaaaaaacaaaagaacaaatttatttaatttactcagatattctctaattatctggcct

SEQ ID NO: 2048 - DNA, 1201 bp, Homo sapiens
actaaaaaaattttaatttgaagaaattcaagaactgagtcttaaattataactgtcagggtccagtggtgttattacactgaaactatttaaaataaattctctcatgaaaatacatatatttcttaaatgaccccaaatgtttcatgtacttttgagggttatataaatgtcaattaggttcagttgattaataaagttgttcaagtcttctatacctttattgattttctttttatttgttctaccaattagagagtaatgttgaaaactccaaccaccaacatggattatttctcctaaagtctactctgttttatattaatagcccctctaagtatcatgtgcttacaactacatgaaatatctttttctcatgcttttacctttaacccatctgcatctttatatttaaagtgagtttctggttggacattgtggctcatgcctgtaatttcaacactttgggaggccaaggtgagaagatcgtttgaacccaggagttcaagatcagcctgggcaataaagctagaccctgtctctacaaaaaaattttaaaaattagccaagcatgatgacacacacctgtagtccctgctacttgcggggctgaggtgggaggattgcttgagcccaggagtttgaggctacagtgagctaggatcacactactgcactctagcctggtgacagagcgagactcatctccgtttttgaaaaattttttaaatgttaaggataagcttgctgttaaagtagaaattaaaaaagaaattttaaaaataaaatggatttctcatagatagcatagagccgaatctttttaaaatgtagtctgacaatctcttacaattttaattgcaatatttagatcatttacatttaaggtaattattggtatatgtggtataatagttatctattgctttgtagtgaatttctttaaaccataacagccaaatgcagcatgcatttattatctcacagcttctgtgggtcaggaattcaggcatgtcttagctgagtacctctgcctcagagtctctcaggagtctgtaatcagagtgtcagccaaggccagagtttcatctgaaggttcaactagggaagggttcatgtccaagcttacttactttgcttttagcaagattcagttcttttaggactgttggactcagagcctgagttccttgctgaccat

SEQ ID NO: 2049 - DNA, 1199 bp, Homo sapiens
aatgaagactatcatgtgcaatcttttacagtggggttgatgatacatttggaaggatttgcttgtttaatatgtacattttttgtgttaacagctttttgacacaattactgggtaatttctaatataggcagcagactgttttacgggttgctgttttaacatgggtttttgtcagatccatggtcttaggacttgactgatgagctttcagtgaagaatcctctaagataaaacttctatttaaagactttaactagaaagtgtttattttggctacattgttcaccttctgctgtattggtatttgtctgttgggatttcaagggagtgtagagaagacagaaggaaagctgagagctggcccgacatggtctgggacacagagttggagctggcactgaagatctccagggacttcagagaccaataaaagcccatagggaagagagagaggatatagggaaacagaatcagatgtgtaatatacttggcacagcgaaaaaatggatttaaaagacaaaaatggaggtccaggtagatgtaattcacacagactgaaagtgagttcgggcttgtgtaaaacacatgagattggatttgaccccttggctctcaagtgtccccttagatctagaactgctccttggtggccattagatcgagtcagttttgatctgcatcacttagttattgggaatttctttgttggaaacaggaaaatttttttagattatttggtgtacggttttgctcacaacaataggtggaagttgctagtgcagtcttggtctgatggctgtgtgcatcgcacattcggcttggtgaaatccttctctaaagcctctttttgtatttttataactaaacagaggaagtcttcagaagacctcgctttaaaacaaatttgtgcaaacactgctagagtcattttgaagctcaagcattttcactttgtttcttacatgtgtacttttttgtttacttgtgaaaatggccatctttaagcatatttattttctgccactttatttaaaggcaagcaatattttcttgatcataaatattttgtaatgaaatacttcctcttttccagggctttgtatgcacttgtataattacattgatggcaatgtagagtttgaatttcagtctgtaaatacttttttggaaaatagaaatttttattgctttaaagt

SEQ ID NO: 2050 - DNA, 1310 bp, Homo sapiens
ctttctcttttctctacccttttccttcctttttcctccctctccccatcatccccctcatcttcgtcctcatccccatccccttccccctcccccctccaccactctctctccagcttccccctttcttctgcctgcacctcgctctctgccccctcaggttccccctttctcccagcccccaccctccggctccccctttttgcctgcccccaccctccctctgcctccctgtctctgcactgacctcacgtctgtctgcaggagacctcatccacctggccagctcagacgtgcgggcaccacagcgctcagagctgggagccgagtcaccatcgcggatggtggcgtcccaggcctacaacctgacctctgccctcatgcgcatcctcacgcgctcccgcgtgctcaacgaggagcccctgacactggcgggcgaggagatcgtggcccagggcaagcgctcggacccgcggagcctgctgtgctatggcggcgccccagggcctggctgccacttctccatcccctaggctttcagcagggccccggctaacctcagtgacgtggtgcagctcatctttctggtggactccaatccctttccctttggctatatcagcaactacaccgtctccaccaaggtggcctcgatggcgttccagacacaggccggcgcccagatccccatcgagcggctggcctcagagcgcgccatcaccgtgaaggtgcccaacaactcggactgggctgcccggggccaccgcagctctgccaactccgttgtggtccagccccaggcctccgtcggtgctgtggtcaccctggacagcagcaaccctgcggccgtgctgcatctgcagctcaactatacgctgctggacggtgcgtgcagcgggtgaggcacacgcggccccctggccttgttcttggggggaaggcgtttctcgtagggcttccatgggtgtctctggtgaaatttgctttctgtttcatgggctgctgggggcctggccggagaggagctgggggccacggagaagcaggtgccagctctggtgcagaggctcctatggcctttcaggcccgtggcagagggtgggctcaggagggccatcgtgggtgtcccccgggtggttgagcttcccagcaggcgtgtgacctgcgcgttctgccccaggccgctacctgtctgaggaacccgagccctacctggcagtctacctgcactcggagccccggcccaatgagcacaactgctcggctagcaggaggatccgcccagagtccctccagggtgccgaccaccg

SEQ ID NO: 2051 - DNA, 1156 bp, Homo sapiens
tagactttggcttactggaagatttaattaaaaggtagaggagaagtaaatttgctgtaataattttgctgtaaataaaacaaagagtttattttattagataaagaatgtgaagtaagcatgaagagacaggctttgggagaaataccagaaagggatttttcaaagatggcattgtttaatctccgtgtggccctcggttgtgcaatcacagatgagccagaagagggccagccccctacttgtttgggctccgaaactcttaccaaacatcaatttttattcttgggatagaaaaatagtatgtgctatctctaatacgctacttcgatatttattaaagaagtatttttaatgtagtgtccacaggctcatttcattgaaaacaactgactatgatgatagacagctcctgattggcaaaagttcgatggtatattcagaattaaattttgcctgcacacctaaacactgacaacatttagcttaaaggttttccatggagaagagtggtaagagctgtagttagcaaaattggcatcctctttagggtgtcaattctgtgctgctttgcaaattgttgaaacttttgattttctgtttggcaatgctagtcagtgttcacttcttacagattagccaagaatttttatctaaatgcagaaacttattaatgaaatccatttaaactatacttacacaacattttgggaggccctgctggtaaaattatatatggatgcagaagtattgcaagagtccattttccatttttaaatctgcaatatctgattacattgatgaattccgttgtattgtatgtgtgaatataaatatctgaattctcccgggggacttggttttcgtccaaggatgttggcagtggacacttagtttacctcaggaattgcaatcatgtaagactatattcggaaaaaatgctggagtatataattttggatactgatataaaatcatcaagatggaagttaagcagaattgtcacgtgtagtccatagcgcttttatatgcattattctgtaatttgtttgtactgcggcaactttttatactttcaatgtatcatttaataaaaaaaataagcaagtcactttggtgcaaagggtgttcatatcactgttctctcatcaaaagc

SEQ ID NO: 2052 - DNA, 1180 bp, Homo sapiens
agtgctggtattacaggcatgaatctggcctgtattcactgattttttaatcttttgctacatttgttttatcatgagcttttgttctctctctctgtatgcatgctataatttattttttctgaatcatttgagaatggatgcaccttgaaacatatcccacccgtagagggctctcagtaaatactggttgaatgaatggttgtcgtggagggctttcttgtgcagtgcgccggagttgcagctagagatgagctgtgagctgagctcttgagtgttcaggcaccggggagcatggtgaccagacaaacagtcctgttggaggtagtggggcgtagcaggctgattacagaccatcacgtgccggcctggatgccagctcaccataccgaggacttgtccttattccagtggatatgtgccatgtcctaggactgtggctgatcatttgaaggctggctggttctcctatccctggggctgagctgttcgtgcaggccctgggggaggttccagggcggtctgttgtaggatatgtatgtgcttctcttccaggccttgggatttttgctgtggatcgtctgctgggcagacctcttctactctttctgggaaagaagtcggggcatattcctggccccagtgtttctggtcagcccaactctcttgggcatcaccatggtaagtaggagctggctgtgacccctgggccatctgctgggctcagtggagaccaaaagtaataactcgtaagactagaatcatagttttttaaggcaatgatcagctggagctgggatataaattaaatgtagcctttttttttttttttttttttttaaagacatgagatctcgctttcatccaggctggagtgctatggtaccatcatagttcactgcagcctcaaacttctggcctcaagcaatcctcctacctcagacttctgagtagttgggactacaggtgtgtgtcaccacgcccagcttatttttggctaattttaaatttttctgtagaaatgggatctcactgtgttgtctaggctggtcttagactcctggcctcaagtgatccttccagagcactggcattataagcatgagccactgttcccagccccagctgcagtctttggatggggcatgtgttgtccagtttgccacagtccccaccatgc

SEQ ID NO: 2053 - DNA, 1192 bp, Homo sapiens
agttgacaggtggggctaaaccctgtgcctgtgatcccatccttggtggtggtggagctggggcctggctccaggtttgtgcaggcgtgacctcatgccttcagcatcaaacttaaagaagaggaggtgggtgcagctctgcagggccttcacccaggacctgctgtgtcctgagcaggctctatgcctttctttctttcttgtttaaagagacagggtctcattctgtcgcccaggctggagtgcagtggcccagccatagctcgttgcagcctggaactcctgggctcaagccatcttcccactcagcctcctgaatagctggaactacaggcgcacatcagcaggcttggctaattttttcttttcttttcttttctttttttgtagagacagggtctccctatattgctcaggctggtctcaaacccctggtctcaagcagtccttccaccttggcctcccaaagttctgggatcacaccacactcggcctgcttctacgtattgtgagtctcaagatttcccaggaaacccactcctgtgtgtgtctctccccagggcgtgaacctgtctgggggccagaagcagcgcgtgagcctggcccgggccgtgtactccaacgctgacatttacctcttcgatgatcccctctcagcagtggatgcccatgtgggaaaacacatctttgaaaatgtgattggccccaaggggatgctgaagaacaaggtgcctgctggcggggtggggcttggtgttgggccgtctcgccctttggttaagtcagaacgtgtcccctttaggagtcctttactttctctggctttctttgtttttaattggactttaaagaacacatttctcatgcttgtcttggaagccttcctaagacagccgtcttgtacttgtctttataggggtaagtcctccgcgcagagttaaattcattgcctctccatggccaagggaggcctctcttcctgattaagtcacagggctggcttcttagcggggaatcccactccaagacattgcctgtgacctagcaggctgcattttcttacttgcagaggtgtctgtgggtagaggggtcggaaaattgccacaacaccttaacataataggaaatagttcctgtgttctttttatagggcagttgtggtaatgggtacacactggctcttttttttctc

SEQ ID NO: 2054 - DNA, 1182 bp, Homo sapiens
tgctgggatactaggtgtgagccactgtgcccggctcttattttttttttattttattttttttaagagacagtgtctcactctgttgcctaggctggagtacagtggattgatctcggactctaactcctggactcaagcaatcctgcctcagcctcccagtaactgggactacaagagcatgccaccacacccagctaatttgtttatttttgtttttggagagatgggggtcttgcttttttgcccaggctggtctcaaattcctggcttcaagctatcctcccacctcagcctcccaaagtgctcagattgtaggtgtgagctgctgttttgagaatgattctgaacctgcatcttgctgaataggagatgtgctctgattgattagtgatgtctgctgcagacacagatgttgggagtggacatgctttcctggtcaagcaacatagagtgtctcctttcgcttctcccagcctgggcctaggttcagggtcaggggtggtttgacccaacactatctcctggtttttttcttccggtcaagtgtcgggcagcgccagcttgtgtgcctagcccgggccctgctgaggaagacgaagatccttgtgttggatgaggccacggcagccgtggacctggaaacggacgacctcatccagtccaccatccggacacagttcgaggactgcaccgtcctcaccatcgcccaccggctcaacaccatcatggactacacaaggtgatgccactggcacagtggcctctaggctttgggagtttgccttactcactggctcactcattaattcattaattcattcaacactgtccttatccctagtgacagccccagtgggtggatcctctcttcatcctggatggtaccagctatttctttttttttttttttttttgagacagagtctcgcttcatctctggagtgcagtggtgtgatctcggctcactgcaacctctgcctctggggttcaagcatttctcctgcctcagactcccgaatagctggaactacaggaatgtgccaccacgcccatctaacttttatatttttagtagtgacagggttttgccatgttggccaggctggtctcgaactcctgacctcaggcgatctgcccgcctccgcctcccaaattgctgggattacaggcatgaaccgc

SEQ ID NO: 2055 - DNA, 1169 bp, Homo sapiens
atattttacaacaatgttggaaaaatgggtttacgttctctgagaggaagatacccaaagcttcaagctcacctcaagggaaaattgagctaggttcccatgctctccacttggatctcacgcacatgaacacacatacaaccttctcctcaatattcacaagaggcctctgttgtctgcttctccagagagtggaggtgaatttacctgaagctaatgaggcttgggcttcagggtcttttccttgtacctgtctctttaaatgctggacttggggaaggctttaggtgagaagggaaagctgggtttcaataatgaagcacctctatgttcacatttctgattaattgcctacacagatcccagaagaatggaatggaaatagctaaaggctccagaattttctctttttatttttttgagacaacatctcactctgttacccccaggctggaggctggagtgtggtggcaagatcatcgctcactgcagcctctaactccctggctcaagcgatcctcccacctcggcctcctgagtagctgggactacaggcacacaccaccacacctggctaattttttgaatttttttttttgtagagatgggggtcttgccatgtcgcttaggctggtcttgaactcctgggctcaagaaatcctcctaccttggcgtctcaaaaagctgggattacaggcatgagctaccatgtccaggcagctacaggaatattatacttaatttctcattccaaaataacattctcttttgtgcctaattttaaattcataattttgtattctttttcttaaacagagatccccatattatataagcttcagtccccacaaaaactggatctggttctgccaaaatgatatatcctttatgatatttatagagacgttctgattatttctgaacatctcagactttctggaaccaagacaggttcgattatgaacatctgttgtctaattttaaagaccaagggggaagccgggtccttatgaaggccataaaggctccaagctagatggatattgggggagtgggttagcagagatgtcctaaaacaatgtattacactaatgggaagaacaaaaggtaagtctaatcacagatgtcttggttttcaagctagtcagacttcagataactgtcaaatc

SEQ ID NO: 2056 - DNA, 1209 bp, Homo sapiens
ccttccatcattctgtcagatttgtttggaaaaatttgtctggggctgtaggacattgtttcttggaaatatgtaacggtacttcattggtgggagcagcgttcttagttcagtgcctggacagcgtgttccttagatattctaataatttgtagagcttcaggatttgagaccctatgattttatttcagccttattatgtaagaaagggttggctgtagtctctcttgtcgagacttgatctctaggctatgtaaaatctgatcatcctggacagctctccagccaacagggagcacgccagtggcctgacactgccatgtattgccttgttccatctctttgcatgcctttgctttttctcctaggcaggcgtagtcttacttaggtgtattttttgaaaagtatgtcaagcattgtgcacagaataagtacccatctgaatgctgggttggttggtttggaggactgtttatttatgaatgtcatcttgtgttactcagtttttctgttattggtaaagtgaagaatgtttttgttgttgttgttattttatagtgtggggtgatcagccccagatttgacgtgcaactcaaagacctggaaaaatggcagaataatctgcttccatcccgccagtttgggtaagttggcctttccttaattaaaagaagttaatgctaagaatttctgtggtgcagtttgacttaagggtttttttctttttttctgtttaaaacaaagcagtggtaatttgtctactcttaaccattttgacctaatagctcaagtgttatccatatttcttttctctctctttaaaaagagacagggttggccaggcacagtggctcacgcctgtgatcctagcattttgggaggctgaggcaggcggatcacctgaggttgggagttcgagaccaccctgaccaacatggagaaccccgtgtctacctaaaatacaaaattagccaggcctggtggcacacacctgtgatcccagctacttgagaggctgaggcaggaaaatagcttgaacccgggagagaggttgcggtgagctgagattgtgccattgcactccagcctgggcaacgagtgaaactctgtctcgagaaaaaagagagagagacagggtttcactttgttgcccaggctggagtgcagtggctgttcacaggtgcggtcataacacgctacagccttggc

SEQ ID NO: 2057 - DNA, 1246 bp, Homo sapiens
tgaccctcccggtgtgtcccgggcctgctctgggggacacagcggcgaatacgttgaacgaggcccctgtttcacggagctaaagatccagtaaggacttcacccagcgagaggcaactacgccgggcttcgatacccaatacctctgcagaaaggtggagtggcaggaatctcctgaagcctccaacgtccaggaacgcggaaacccagggcctccagtgcaggtgtcatcccggagggcgcatgcggagtcccaagagaggcgcgtcccattggacaatgctgagcggaagagcccaagatagcggggggagttgtgacaggctgctgcagacgtacttagaaaaggggtgcatactggatattcaggctaggagaagaacgcaaaaagcagtgacgtacattattctctgcatatatttacttgggaaattgtgcgtctccctattctgagtcttggaggaattggactggtccaaccttataaagagagcagtagagcgcggcagtatagagagtacctcacgaaggggacgtgggaaagtgttagcggggaacgctgggaaactcccggcctccgccaccatcttgctttcctttaatccggcagtgaccgtgtgtcagaacaatcttgaatcatgaagctactaaccagagccggctctttctcggtgagctcaggtggcgggtttgggaaagggctggggagcagtgtgtcgacaaggtgatacgaggcggaggtgtctggtctggggtctgggccttgggattcggtctgcccttcagctgaaccctgcgggccaagtgggctgcagactgggtcaggctttggaggcccagctcatgctgtgagcacaagagacctaacaccgggaaacctgaagagaggggcaggacgtgagagcggagttgaagcgagtccttggagagacttctgaaggtcactccggtactcaagtgctggagaaagagaccgtgaaacccagggggagcgggaggacggcgcacttagccccccaccttcactttatccgctgcagcctctgctccttggtttatcacggagcgtcagtttccccagcgaataaaagtataagaaaggagctaatgcagatagaacacttattacagtacctggaacttcattgttaaatactatggtgtcttagtagtctaacgttgcttttcttgatcgtatgttagacggttcctccaagacgtctctgtttgtcctcaaaagctcctt

SEQ ID NO: 2058 - DNA, 1237 bp, Homo sapiens
cgcacagcttatgaaagcttaatagtttttgatatgttaggagcccacacatgcaaagaatctgcaacaacgttcaatggttttcctccctgaactcttgattcttacatcgcgagggcaagggctaggacatgaggccactcagggctacagaggggccttgaactggacagagcgtctgcaccttggggacccaacatacaaactggggctccacgcaagatcccggcccacccgggaggaagcggcagcacgggagcgcccctacgtggctgtaggcaggatcacgcccaaggaaaactcaaaatcaaatccaaacacacttgtgaggatttaatattaaaaatattaatttttgatatgtaggcactcttcattttaatagtgcgttcctagtgtgtttactgctgctgatcgcgagagcactgtgactccaagtctccgtgagcaacgcaggagacagcggttctatattgagcatgcgcaaactttgagggcggggcgcctccgtcatcacactaatatgccggcataggaagccctacgatcgggaggtagcgtggccgagtggtctaaggcgctggatttaggctccagtcatttcgatggcgtgggttcgaatcccaccgctgccacacctcagaaggtctcacttttctatccataaaccatctctttatgtagtcctttgccaacttctcttccttttttctcctttctgatgtatttcttttttaaagctttagattgcttataatggattttttttaatggaagggggaagggaagagaaaaggcagaaactgcagtgcaggctctttcactgtctagcccaatacacaaacctctctttcacctacccatccagctccctcaaaacaaaacaaaaaaacaaaacacatctccccatttccaggggaaagcatctgagctagcttgaaaagttcccaacagcctgtctgggtcttcctggggttagttgggggtggttgtaatcatgacctgagttagggacgggggtccctttctggcctgctccgtgtactttagagggctccagggaccccataaacctctgttgtcaggtgaccctggagtagtaggggtctggccctatgtgggggtgccaaccttgaggtctctgcttcattgattcacctcttacttggttttcaggcttgatttaggggccttcatttataaacagttgttgagctgtttatgaagggcctactat

SEQ ID NO: 2059 - DNA, 1121 bp, Homo sapiens
ttaatgtgttcacagaacagaaagaaacccagtgtacctggagagcagccagggccggaggagaagtgggcagcacgctagatgaacgcagctcttgcagccttaccaaggcatttggattttattatgaatgtgaaaggaagctgccaggggtgggcgttaagcagaggagtgcctcgatctaattgatgtgctaaaaagagcactctgcttaagaagccattcctttcccaacctggttccaacatttgcaaacactgagttcttaaaagtggaatgacgactgggtcagcgggtttcgaatttaaaatgtgcctgggtgctgccaactgcctccccaaaagatagctctaggttttaccccaagggtgccagctcctgcgatagcctgcagcatttggggtgagggtcgggcgaattcgcagccctgggccccagcacccactctctggcccttgctttccttgtaggaccttcgcctctgcatttgtccagtaactctggctgtgccggatactgcttgggtaaaacgggcaccccaggaacatggcagacgaagatctcatcttccgcctggaaggcgttgatggcggccagtccccccgagctggccatgatggtgattctgatggggacagcgacgatgaggaaggttacttcatctgccccatcacggatgacccaagctcgaaccagaatgtcaattccaaggttaataagtactacagcaacctaacaaaaagtgagcggtatagctccagcgggtccccggcaaactccttccacttcaaggtgagtgagccacctattccaccttccccacctggcttagctgctgtaagggatggagggttggagtcgctggttggggacttcttcgtatttccaaaccctggacagtgctctaaactctgagctgaggatatacttgttaagcagggagggtattattgatttaaaataaatttcattaccttggaactgggtgtttttcaaatagtagcccaggacacactacggagttgtgaaaaccttttgctgagttttgtccaatgttttgttttgtttgtttatttattttagctttctttagagacagagttctcctctgtcacccaggc

SEQ ID NO: 2060 - DNA, 1180 bp, Homo sapiens
tttgtaagtttttcaattagagttctttcttcctttttaaccacattgatttgagttttaggagcttgccaagtagatggtttttggttttggatgggctagatggttgttaaagttgggttttcatttcccaggatgaaatgagttgactagctcaaccttgatatgctgtaaaaaatgtctctagccattacctttatcctttctcttttcacacagattttttgtttgtttgtttcctactcttagagcactggttttcaacacgggcacttttgcctgtcctcaccccaccctgcccccaccccctgggacatttgtcgatgtctggaaccctacttggttgtcacagctgggatcagggtgctactggcatgtggtggtagattccagggatgctgctaaatgtcacacaatgtgcaggacagccccccttactaaagggttttcaccccaaagtgtcagtagtgctgaggctgagaaactgtttggaggaaagtttggagactcagcgcaagtttccttttacttccccagcctttaaaatggttaccttgttatctctcgcgctctctctttctctctctctccccccccccaacctctccctctctctttctccttctctgtctctgagtgtgtatatgtgtttgcagcagcactagggtaaaacttgggcttcactggcaggacccttgcatcactttcctagtaaaatagtgagagtaaataaatcactttgaatacataatatgccattttaaagggaatcagcttattgctttcataggagcatgggtgccccagattcttacaaatgctttctgagttttagagctcagagccgttttgcagcaagtaaaaagatggatggtcatctttcaagcaagaaagataaattttatggcagcagtttttaaattgtgctggcaaagaacagctagcacagagtgatctattgataaaagaattgtggggactccttccagatttgcagtgaaacaaatggtaattgatgaatagaattctctctcccatttttttttccttgaactttggtgccttgtggtgcttatttattagtgagaattctcaagtcacaaaaggaataaacttgtataagagactagtggtgaacaacctggcaatcagaggctcacacttgctgagtttcccagcc

SEQ ID NO: 2061 - DNA, 1177 bp, Homo sapiens
caagactctgtctgaagaaaaaaaaaaaaaaaaaagaaatattcttcttaagaaaaataaaataaagtcaggcatggtggctcatgcctgtaatcccagcactttgggaggccaaagtgggaggattacttgaggccaggagttagagaccagcctgggcaacacagtgagatccttatctctacaaaaaaaattttttttaattagccaggcatggtggcacatacgtgtattcctagctacttgaaaggctcaggcaggaggacagcttgaacccaggaggccgaggctgcagtgagccatgatcatgccactgcactctagcctgcatgacagagcaagactctgtctcaaacaaaacaaaacaaaacaaaatcctaagaatgaattaggttagttcaaggaaaaagaacaaggatggagaaaagtgctttaaccaacaacttgaatgacatgacccggtataaggaattctctccaaccttagtcaaattcattccagcaaatgactgatgaacatctgaagagtgattcacaactatagtaaaaaataaaatatggggaacgtgacactaaaccactcgtagatgacctgcttctaggttggggtttcgtacatagcagagcagctccctcactgcaatctatttcaatagctctctatctgagtgctattgaaaatcagccctcaacacaagggtttggagaaaaaaaataaataaataagaaaaaaataaataaaataagccacactagaaacaggcccagtaagtcattactgcaaagtaagacaggctcttcccctgcttacaagaggttctactgtgcctcctgtctcaaggcaagagaacaacggtttaaaacctttatggctggaaatgcctagagacttgaggaaagtaaatgatggatagttgccacttgaaacaaagttcctctgtctctcctcactcctagtcagggggtacctttaaaattatctcttcccctacttcttggtgtatcatgagaacaagggagactcacttcaggtaggtaaattttacctgaagtaaagataaaaacattcctgttcattcgaacaccacctgacgaggggcctcctgcttttagatgggaagaaaatggccttcaggaattccacaggctcccttgctggacaacaggcggcattgtc

SEQ ID NO: 2062 - DNA, 1153 bp, Homo sapiens
gcttgggtctttcagctggttcatctcttcagcactgctgaataaatttagccagatgattggtgttttgggagacagaagctccctaaagacagaagcaagccaccatacttacatttcaagtccctggtggcagatggagaaaaaggacctaccccttcatttttcacccctcacgcctctttcaggtgttggtagaaattgaccaagtgaagtccagaatgcaacttgctgccgaatctcttcaggaagcagataagtggagcacgttgagcgccgatattgaggagacatttaagactcaggtaggtttcttgtttaggggatgttatgaaaggtatttaagcaagaacttgaggtttggagaaagcaaaagagatacaaagttgatagccaatagcagcattcagaaaccttcagactcagggtggggaagatctgaagctgctcggtgtgtttccagcctctttagcttgcaccctctgtgtgactgaagcctcttagtcacagaatgagttcaagagaagccttgataaagatgtacaggcaccaggcactgtggctcatacctgaaatcccagctctttgggatgctgaggtgggaggatcacttgaggccaggagtttgagaccagcctgggcaaaataatgagacccccgtctctacaaaaaaattaaaaaattagccaggtgtggtgctgcacatttgtagttccagctactcaggaggctgaggtgggaggatctcttgagcccaggagttgaaggctacagtaaactatgatcataccactatgctgagggacagagcaagaccctgtctcaaaaaaaaaaaaaaaaagaagaagaaaagaaaaaccagcacaggcagagaaggttgggggtaaatggacgagagggtggaacatggggaaaggggagccttatataccttggggacttggtgggttattgaccccttctgaggctgcaaagtgtggaaaatagtaacattttccacctgggatgtaaggatgaagtaagatgatgtcttatgaagaactcttactcaattgtaaagcaaaatgaatgatttatcagtcagtttttttaaaaagttacaaatgcacatgggaacaaatttattacacaggaataaactgcaaaaaataag

SEQ ID NO: 2063 - DNA, 1129 bp, Homo sapiens
agggggagacctgcaggggcacccactgatagcaaaggagggatgtggttgtaacgtagttttgctccttaaagatggaggagaatgaggaaggagaagagagaactttgaatttggtaaccaaccagttatttaatgagacatccttgagttaaacagtagagacagaaggtagtagttttaggaggcaatggagaacagaaggcttagactggagttgcaaaaattagaaaaaaaggctgttcatgcctgtaatcgcagcactttgggaggctgaggtgggccaatcctttgaggccaggagtttaagaccagcctggccaacatggtgaaaccccgtctctactaaaatacaaaaaatagccatgtgtggtggcgcacacctgtaattccagctacttgggaggccgaggtgggaggatcacttgaacccttggggcagaggttgtggaggtggagccaagattgcaccgctgcactccagcctaggtgacaaggcgagattctgtctcaaaaaaaaaaaaaaaaagtagccggagtaagagaaagtagctgcctcaggtggaggagataaaaggagtgcctggaactgaggctgcccaaggacacagttcttcaactccagctttttttgaaacagagtctcactgtgtcacccaggctggagtgcagcggcatgatctcagctcactgcagcttacccctctcctgggctcaagcatttttcccacatcagcctccccagttctagctttttttaaatgtatttttatttatttatttatttatttttgagatggagtcttgctctgttgcccaggctggagtgcagtggtgccatctcggctctctgcaacctctgcctccttggttcaagcaattctcctgcctcagcctcccaagtagctgggattacgggcacacgccaccacaaccggctaatttgtgtgtgtgagagagagagagagagatggagtttcattcttgtccaggctggagtacagtggcacgatctcagctcactgcaacgtccgcctcccaggttcaagcaattctcctgcctcagcctcccaagtagctgggattacaggcattagccaccatgtctggctaatttttgtatttttag

SEQ ID NO: 2064 - DNA, 1180 bp, Homo sapiens
gcagggctaaggctgtttacaggagcctatgaggttctgcctcatctacttttccttttatatttctttcctactgtttctgccctaactacaagttaaagtccttttttttagaagtctatctcattcattagaggttctcatttcaaagcccaaaacatagttttctattttcctactaaccctgaagccttccttcctgttaactctttttctccaggtccttggtaaagaaaacctgttttatagaggcagagtggtacaagaacttgccttttatttttaaatggagtttcactcttgtcacccctggctcaggtcactgcaacctctgcctcccgggttcaagtgattctcctgtctcagcctcccgagtagctgggattacaagcacccaccacaacccccagataattttcctatttttagtagagatggggtttcatcaagttggccagtctggtctcgaactcctaacctcaggtgatctgcccgcctctgcctccgaagtgctgggatcccatgcgtgaaccaccacgcccggccaagaacttgccttttaatttgttttcagtccttgggcttgagagaactctgctgcaattttaacaacaaccagacacacaatatcaaggtgccacctgtggcttgtccgaagcactttgtactaggtcgtattggttctactttacagatgtggacactgaggttcaatccagtagaccaagatattctctctacaataataccctcttatttctatttattagctgatttataaagtattccaccctatgtccttgaatgtaccctctggtagtagggtcacccaactccaccatcctgaatagggtttattagtatgttgacttctaaggtgtgaataaagcaagaaaaaggataaggaagaggagaaccagagtccggaaattccatgtcgtaccccaaacttctgcctccaacccatcagccaagcagtcctggccagattgaagtgaacctcagccggccttagaaaggaatacagattatcataccacattcagtgaatgagatctctcaatctggatctaggctctctttccaagcagctttgtctaggacacagatgtgtgcccaaatctagccctcccatctgctgaactacaccaaatgttagcacactagagatggagaaaga

SEQ ID NO: 2065 - DNA, 1207 bp, Homo sapiens
ctgtgtttgctgctgctcgggtggctctcgaggggcaggggcggcctggagccccgtgggtaaaggttctgcagacattgctcggtgtgcgcgtcacctcaaggggccatggtgaagaagagggctgtcaccacagccatgtctgcgtttgaggggccggactcaggagcaagtgtgctggtctcttcagtgtgagctggggccagcttcttcatggtgcagcgctttggtctttctgtccttagactagtggttctggtagggcttggtggcagccttgtggtgaggactcagtgagttgatgtctgtatgttgattgcagcagtgtctggcacccgagaggccctagggacgtattcctcttgttctttttctcccacagcgcctggcacagagtctctgtgacacgcagtgcaacagtgaatagaagttttgagttttagaaagtgctcccctatcttcagtgcacactctgggatggaagtagctgttggggtctggtgggtgggtgacctggtgtgttgttggctgcagctatgcccctgccttccaggacctgccctcattcacccagaatgtgcacaggctggtcaacgacctgcgctactacagactctgcaacgacagcctgccccctggcactgtgaagctctaggcctgctactgcctggggacacggacttctgctgctgccacctgcgccagccctaccttccaccacagatgtctcccagatgggccttggtcacactccttggcttctcccaccgcaagcaacgctgcctgcctctgccgctcctccacatcttgccgctgcccagcagagctggcttctgggtccacctgagcactggacggtgctcccagggcgttggagcaggcggaggggtgtgtggccaggtactaggaggcaccaggaaatcccgcggggtggcccatgcagaccaggcgcacgtggctcatggggcagaattgccaaggacagctcacgacagtgccaccttctcaccattccagccaaggagagatgtgacgttggaactgctctggcacttctgtcaagcctcccccgccccaattgccttgagatctctgctctttgtcagagatttgcaaagactcacgtttttgttgttttctcatcattccattgtgatactaagaaactaagaagcttaatgaaaagaaataaaatgcctatgttgtt

SEQ ID NO: 2066 - DNA, 1100 bp, Homo sapiens
atcaaatatcagttgttttgactttaatcataatgtagtcacagacaactttgttgtggcttccatttggatggtatagaaatgtcattatggattgtctatgtactgatgttgttacgtgtaacttttgtgctcttggttttacattttaatcctgtgcttcctattgccctgtgaaagctgagaggtgcctgggagcagaaaggtgacataaataatgctgtgtgcttgcttcctggctctgggtcccctaccactaattctaaacagctcagtccattctcagttgtttaggagctgctaaccagatccttggcttctctttccctctactgccttttcccctaactttctactgttcattagcacctgtaccagaaggtgggcaagggaaagaaaatgaggtgaaataaaatctgtagttttagctactgaacagccttgtttgtatttttaaaaaattgggttagatactaaagtaaaattgagattgttctgtatttagcccatggcttttttttttttttttttttttttaaatgggtagtagggaattgagtgcaccttcctaaagaacagtcagctgggtggtgactttgaatatccatgtaaaactatcatgcggtacataagtgagtgaggaaggagttcctactcttgagtattagtgattgatgacaccagagagaagtgtctttgtatgttcctgtctctaaaaacagttgattttagtgccttactgtttttcgagtacttggccccatgatccacagagacagccattctctttatcaaaacaaattaatatgtattttttaaaaagctgcaaataagctcggccgcatagaggtcaggcaggcaggctggccaccctcagggagataggtcccaggagcaacatgggacattttatttccgggccagttttgcttttctgagtagtagttttctctgcttttattatttcacatatctctgttttgaaaaatagcttttgcagtaatgagcttcagaattgcttttagccattatttcattttcagctaaggcctagtatgtctttacctttttgtgttggtctctgaaatgtgatttatgaa

SEQ ID NO: 2067 - DNA, 1222 bp, Homo sapiens
ttttccagaatggatgctaaaaggaaaaaaaaaaacaaaacatctataataatacttatggtaaaagcagtaacagccaccatctgctgtgtgactacttgcttggccctatactgaaaactatatatgcatattctcatttaatattcacaactctaaggtgggcattattacccatatttacagaccattaaaataactaaggcacagacagaccaagtgtttccccaagtccctctgctagcataaggtagaaatgaaaccaaaccagggtctggcctcaaaaccaatgtttccttccaaaaaccaagttaactggaaagattatgcaaccaggaaaaatgagcaataagaaagctaatatttaaatacagaaaaatattcctaattgttctcctctgtattaaagtgaaaaaataaatatggaaaaatatgtatggcctaaaatcatatgtaaaataatagcatgtgtataccatgactacaagcatagaaagacaaatatgtgaagacaaagactgaacaagattatgcaaaggcaaaaactgtttaggtggatatgaatgatctgcgattacttttgtcctcaaaagaaagaaaatagcaggaccatggtcatggaagtcagcatctgctaaggagtgtaccacaactcatttgcctaaaaaggttggggtgagggaaagaacctgttaaggctatttctccataaaaacgattttactcaaatttaaatgtttcaaggtattttagtggatggcggaagtgtttttcaaaaattacaccgtaatcaaagtggaaggaatcagcacaaaacagattctgcttcatgcagcagcacttccaatgcaaacctaagagagctttatcaagttctctatggaagagggtagcttgattacaaaacctgtgaccctggcagcgatacgcaccaatgcccacagagctgtgtagacaactctggtgcatttactgacttagaaggaatgaagacatggttggcatatttgtaattttttttttttttttttggagacagggtcttgctctgtcgcccaggctggagtacagtgatgcaatcatggctcactgcagcctcaacctcctggactcaagccattctcccacttcaaccctcccaagtagctgggactacaggcaggagccaccatgcccagatatatatatattagagatggggtctcactatgttgccaacaca

SEQ ID NO: 2068 - DNA, 1177 bp, Homo sapiens
aagtgcaatattgaccggcttttagtatattcttgaggttgtgcaaccttcaccgctatctaattccagaacattgtcatcactataaaaagaagcatcatacccattagcagtaccctcccccaccccgccccattctcctctcccccaatccctggcattcactaatctacttagtctgtctctatggatttgccttttttggaattctcataaaaatggaagcatacaatatgtgatcttttgtgtctggctttttcacttaacataatgctttcaagatttattcaggttttaatatgaaaaatttgagaataagatattttcaaaagcctttgtgatcaccttatgttccgggttctgtacgggtacaaagaggaagaaaacacagttcccaccctcaggtaatttacacttgagtggggagacacaagtaaacagttaaagatgttttaagagctaaatagaggtatgttttatgtgcaggaattcctgaaggaggtgacagctgaatggaattttgagcgacagacaggtggcatttagtctggtggaaaggtgatgttgaaattgggaggaggagagcaggtcagaggttgagagggacacatgtagaaggaacagcagacagttgagcatagcaaggccgcgtctgtcgggtgagctgaagcctgggtcaggtgaggctagatgaggtcagcagaagccaggatttccagcctgtttcctgcatgaggaacgaaaaaggattggtggcaggtttgtggggaacgaaaagttgagtttgggatatgcacgtagcattgtccaggaagcaggtggacatgcaggtctgttactgccttgccttgtttctgaagcccccatcgtgtgaggcagagcttggtgtatatagtcaaggtgagtttgggccaagaacaggagacttgagaggcttcagaatatattgaagccatagcagtggatgagtcactctagcagtgagagtgaaatgagaggagaagcaggtcagtcagggaacctggggaaacgtgtgtttaaatgactcatgggcagaggatggaagtaatagtgaaagggatagaattgagttcaaagaaaccagagaaaagccaggaaagagtggtgctaccagctcagagaagggtttaggcaatggcctgtaatgccacagtgt

SEQ ID NO: 2069 - DNA, 1142 bp, Homo sapiens
cgctgtggggccgcccggcgctcgccacttccggcgcgttggggctgttggtcgggggcggccgcgcggtactagcgggcggctccagggcgggcgcgcgcaaggatgctctagggggcggcggcagtggccgtgtgggttgaggctgcgaggacagcgcgggcccccgggcctctcccctgagccggccgcctgggccgcgcggtcgaggcctgtcagcctccgcccgttcagcctcggggccggggccgccgccacctctgcccgcggaggccggggagcccctgcctgggcccgcagcctcccccgcgggggtcgggcccgggcgggggtcccgagcagctgccctcctcgccggcatccgagcctcatttcctgctttttcagtttccttggggaggggcgggtgggtctggatgaattgtctcggggtcccccgatgaggcgacccgggcggccctgccctttttagagggtcccctcggggcccggtggggaaggggttgtctttgcatgggtgggggacttcccgagtctgccgggaccatgacctgaactgtgcgagcgggacgtgtccgaagcccaagaaccagctcatctgagccgccccctccccggccagcatggtaagtggaattggagcccccttccctcctggggtgccctaccggaagggtgggaatgggccccggggctgctgagccatcgctgctctccccatggcggggagaggcgcgtgcggagcctggccggtgacacatgcgtgcagagtgtgcagccccggccctgcgctcccatccccccagggatgatggctcaggcctgggagggccctgggagcgcagcaggcacaacccttgcatctggtgtttgcctcctgcagctcctccggataataactatcgtttattgagggcttactacttgccaaggccctgcgcgaagtgattgacagtgcagtagtatttaatgatcacaccagccctctgttcggaagtggggagactgaggcacggagcaattaattccccagctcaaggtcaagcgactttttaacagtgttaagatttgaacctaggcatctgactttgaacctaggcatctctaatacacttagagagctgggtgattgtaggagaaac

SEQ ID NO: 2070 - DNA, 1215 bp, Homo sapiens
cgggctggtgttgagattttatctagacctggcagccctctccttcaccagtaactcctaaaaccagggacccctggaggggaggccacctctccttccctgccccgccctggtcccaggcttagcctctccccctgttcacagtgcctcaacctggtgttcctgctggcagacgtgtggttcggctttctgccaagcatctacctcgtcttcctgatcattctgtatgaggggctcctgggaggcgcagcctacgtgaacaccttccacaacatcgccctggaggtcagcattggccgggcaagggctgggggtggcctgtccagggacacccagggcagggatgtctgggactgaagcctcacccctgctctctgccctcccagaccagtgatgagcaccgggagtttgcaatggcggccacctgcatctctgacacactggggatctccctgtcggggctcctggctttgcctctgcatgacttcctctgccagctctcctgatactcgggatcctcaggacgcaggtcacattcacctgtgggcagagggacaggtcagacacccaggcccaccccagagaccctccatgaactgtgctcccagccttcccggcaggtctgggagtagggaagggctgaagccttgtttcccttgcaggggggccagccattgtctcccacttggggagtttcttcctggcatcatgccttctgaataaatgccgattttatccatggacttcttatatcgtttttgtctctaaaaagaaacttttattatgaaagtaatacatgcccactttcctatatatagacagcataaagaaggtatgtcagcagatttctcccttttttgtttgtttgtttgtttgtttgtttgttttgacagagtctcactctgtcacctaggctggagtgcaatggcgtgatcttggctcactgcaacctccacttcccggttcaagcaattctcctgcctcagcctcccgagtagctgggattacaggtggtcactaccatgtctggctaatttttatatttttagtacagacgacattttgccatgttggccaggctggtctcaaactcatgacctcaggtgatccgcccaccttggcctcccaaagtgctgagattacaggtgtgagccactgtacctggcctctgccatctttgaggccttacgtattcattcattcatgcattcattg

SEQ ID NO: 2071 - DNA, 1154 bp, Homo sapiens
ataagaatgacctgaagctggtcgtctttgttcgcaaccagaaacagtcctgcctcaaaaaaaaaaaaaaaaaaaagggagtaggcaggtggccatatttgtttctggcaagtgagtgctgaaggaaaggagctgaagcctcccacagtcataactggtgctggcaggctactgtctcggtcttgggcgccactgatctaaggtcacggctctgcttgctgctcccacccgctccagtttaaaacctgcggttccagggttctccagcccctccctttttcacgctccgaagccgagaaggcccaaagcgaagacagagaggacccggaagtagggaaaacctctgagcacgtgatgggggaacacgcgggtgctgtcacgtgatccgacaaacggcctctgcatagtgcagaacattctgctgctcttaaaggtacaggcctcagggtccctgctgtagacggggcgggggagagtacgatgggtggggcgtggtgggtcgtagggcgctcgagatggagcccccagcttccttgatggatcgcggggcgcgagtgccctagacaagccggagctgggaccggcaatcgggcgttgatccttgtcacctgtcgcagaccctcatccctcccgtgggagccccctttggacactctatgaccctggaccctcgggggacctgaacttgatgcgatgggaggctgtgcaggctcgcggcggcgcttttcggattccgagggtgagtattcccgcccaccctcatggaacgaccacctctggctcgcagcccacctgaggggaatgagagctgactcggccccgggaggacacgcaaggagcggtcgtgcacctgagagtaggtgggggtcatgccctcttctcgctctcccaggggaggagaccgtcccggagccccggctccctctgttggaccatcagggcgcgcattggaagaacgcggtgggcttctggtgagtggcctgagacttcagcgagtgacaatggcatgagaagagggaagtgaccggaggaaagggggaagaaagagttaagctgcgcaaaggagctgaacccacaaatatttactgaatccactggtttgccccaggggcagcatgtaaaatttccaaacttcactccttatcaccttccgg

SEQ ID NO: 2072 - DNA, 1172 bp, Homo sapiens
tttgtgatttgtctccaaagcctcacccagctctctggccctctagtgctgcccagattgagctgctgcaactgctggttcagattgcagcggaaaacaacctgggagagggcgtcattgtcaagatcaagttcaatatcatcgcctctctctatgactacaaccccaacctggcaacctacatgaaggtgagagcagtgaagaggctcatctcagggcatcgctggtgggttgggggaagaaggtacctagcatcttaagactcaggggctatggaggcagtcttggtggtggaaggccccatgattcctgctgaagggggaggcatccgcttactctaccttcacacctctgactctgatgtggcctgaaatcttggcagccagagatgtgggggaagtgcctggactgcatcaatgagctgatggatatcctgtttgcaaatcccaacatttttgttggagagaatattctggaagagagtgagaacctgcacaacgctgaccaggtaaagggaggagttggcaggataactggaggtgtgtattttatgctttgggaaggctcagtgggacccgagggttgaggtttgagactgagatctgggctaatttgttgactcctccttcgccttccttttcagccactgcgtgtccgtggctgcatcctaactctggtggaacgaatggatgaagaatttaccaaaataatgcaaaatactgaccctcactcccaaggtgagcctgagcaagcgtgggctttgctgagaggaaaattgtggggaatattactaggtttagagctttgtgaggattatactaagtcagagtgcttgaaaagccagcctttcaacttacctagcgttcacacggaagggcctgatgagatgctggctcccagtcccatcgtttctgattccataggtctgagtggggcttgagaacctgcacctctagcctgctcccaggttgctggtctcagggctatactttgagaacctttggggtaaggcatctattcacttctcttgtttagcttggatgagaggcattggggtgtgaaagtgcagcatagtttactcagtaaaagtgtgaatgtgcccatcaagtcaagggtgtagtgattaacaaggcagccaaaagcttaccttttgtgctggatggagaaaggca

SEQ ID NO: 2073 - DNA, 1172 bp, Homo sapiens; identical to SEQ ID NO: 2072

SEQ ID NO: 2074 - DNA, 1153 bp, Homo sapiens
ctttaaaaagtatttttatttatttatttttattttattttatgtttgagatggagttttgctcttacccaggctggagtacaatggcgtgatctcggctcactacaacctccacctcccgggttcaagcgactctcctgcctcagcctcccgagtagctgggactacaggtgcccaccatgcccagctaattttttgtatttttagcagagacagggcttcaccatgttggccaggcttgtcttgaactcctgacctcaggtgatccacccgcctctgcctcccaaagtgctgggattacaggcttgagccaccgcacccggcctaaaatagctttccagcagtccttttggtcccagtaggtaaagcctcaaggcaggctgtagagtgccaaccctctctgacccagaggtgagggttaatgttaataggatccctttcagcgaaagttagggccacacttctcatgtccctaagccatttgtacttgttttttttctctgacccacctgtgtatgtggtgagtatgtgtgtatgtgttgctttttttttttttttttttggaaagtgattttcagtaacagaaagggatgtgctctctgcaagggtgaacctattcttgcccctgtgtgtaaggcaagaaggagaagttgtgttctctgaacaggcagaccctgctgagagacggaggtgtgttggggttcaatcattctggtgggaaagatattagagatagttatagaaatagacacaaatcttggaaggccgagaagttggcataactttggtaattagctctggctgaaggcggcctgatccctttacctttagttaaacaaataaacatagaaataaaagaaaggcagagtagtttacctagctagcttgtttactcatataatcttaagaccctgggtgcttaaatgctttttactcgggaagtccacaatgtctgttacactctaatggtgttgactcaagcttttgttaattaatcatactgaataaatgcgcgtctgactagctgatcagggccaagtagcaactgtttacaggactcagcagggagcctataagcggctgggaccctcagctggactggcagagcagaatatctgtgtgtctgtactttattcatctgtcacggggtcac

SEQ ID NO: 2075 - DNA, 1215 bp, Homo sapiens
ctgccgccgctgctgccgccgtcgctgccgcgcccccggcccctgccgccgcctctacggtggacacagcggccctgaagcagcctccggcgccccctccgccacccccgccagtgtcggcgcccgcggccgaggccgcgccccccgcctccgccgccactatcgccgcggcggcggccaccgccgtcgtagccccaacctcgacggtcgccgtggccccggtcgcgtctgccttggagaagaagacaaagagcaaggggccctacatctgcgctctgtgcgccaaggagttcaagaacggctacaatctccggaggcacgaagccatccacacgggagccaaggccggccgggtcccctcgggtgctatgaagatgccgaccatggtgcccctgagcctcctgagcgtgccccagctgagcggagccggcgggggagggggagaggcgggtgccggcggcggcgctgccgcagtggccgccggtggcgtggtgaccacgaccgcctcggggaagcgcatccggaagaaccatgcctgcgagatgtgtggcaaggccttccgcgacgtctaccacctgaaccgacacaagctgtcgcactcggacgagaagccctaccagtgcccggtgtgccagcagcgcttcaagcgcaaggaccgcatgagctaccacgtgcgctcacatgacggcgctgtgcacaagccctacaactgctcccactgtggcaagagcttctcccggtgtgcacggggcctcggccgcccgctaggccgtggggagggagggacgcgacggaggtggcctggccgtggctggcggggagggaggcggctgctgaggctggggaaggggagccactcccagggcggagggaggaagcctctcccggttaccagggagcaaggggtggtcctttgtcgaggaggtgggccttggggttgacggaagcttcgcgtgggaggaggcggcggcggcggcagcggctgctgggctccaggggagggatttcctgcttaagtgtcgctgtgacggcctgggctccgggaggaggcgcagggatcctcggaaaggcctgtggtgcggtttggtggatttggggcgcaccacctccgccctaaccccaaccccaacgtgtccccaggccggatcacctcaacagtcacgtcagacaagtgcactcaacagaacggcccttcaaatgtgaggtaggaagccc

SEQ ID NO: 2076 - DNA, 1583 bp, Homo sapiens
gggatctcaggaaggcgagggatgcccatgtaccactcaggctagggagacttctgggcacagggaggatccttgagaactgctctgtctgggtgaggatgcaggctgaggcctctggggtccagataggaagtgagcaacggctgtgtcccaggggaagcaggctgggaaggtgtggggtgagggcaaggctcttgccattcagatcgcgctgtgatccgtggtgtttctcctgtgcaggtactggtgaggtttgtccaatggcggcggcagcggcagcggcggcagcggcagcagcggcagcagtagcagcccctcccacagctgtgggctccctctcgggggcggagggggtgcctgtgagctctcagccacttccctcccaaccctggtgagctccaagttggttgcgggggagaggggagaatggagtagagtcccttggtacaagctcctctcccccctcttttcccaccaactcctatttccctaccaaccaaggagcctccagaaggaaaggaggaagaaatgttttcttaggggaattcgctaggttttaacgatttgtttctcctgctcctcttctgtcagacctgaccccacacaaacctgtcccctcggttgtgttgaagtcccctggacagtgggcaggggtggcagaggacacgagcagccactgcccgtaccccctctcctctctgtaagcccatgccctgtcttcccagggacttgtgagcctcttccctcgacggtcctcttctctccttccagtcctctccccctgctgtctgcagcccctccccggggagttggtgctttcttttccttttttttttttttccagggggagggaggagaggaaggagggggatcagagctgtcccaaagagggaaagcggtgaggtttgaggaggggcagaagcagggccggcaaaggttgtaccttcataaggtggtatggggggttggggtcaggccctgaacatcgtcctacttgagaatctgtcaggggaaaaagtcaaggggagcaggaggaagagccaggagggccagaggcagagaagagatggagtcttaggggccagggtgagcgaggggtccagggcctagaggtgcttcctgggggcgggggaatgcagccagtgtccccctcccctcttccaccccagctccagccctggtcttgtcttttcatccctcttccccacgacagaagaagttgtggccctggccatgtcatcgtgttcctgtgtcccctgcatgtaccccaccctccaccccttccttttgcgcggaccccattacaataaattttaaataaaatcctgtttctggctctggattgaatgaattgccctcactaagaactgccgccaaccccaagggtttcttctcggcctggtgtccgtcaatccagccttgctctgccctgtgaggctgtgaggttctggctccgccctccccaggggcagccttactggcggcagcacagatacagggcggggccaaggctgtggctgtggagagcaagttccaggtctctggggaattcccaactcggacaggcccagaatagcccctgg

SEQ ID NO: 2077 - DNA, 1235 bp, Homo sapiens
tcccctgcccagtatgttcctccctgttcttcacattacctgtgccttcctgtcaatcaagatctttgcttctcaccctctctgaggtccaaccctgaacctcaggtcctccaagacagaggcctggggacctgcatgtttaaccagctccccaagtgatgagtgaggtccaggcaggtatggtgtacaccacctccatcccttccatgtatcttaccttcctcttctccaggaagctcagcccggagccagaaacgggaggcccgcctggacaaggtgctgtcggacatgaagagacacaagaagctggaggagcagatccttcgtaccgggagggacctcttcagcctggactcggaggaccccagccccgccagccccccactccgatcctccgggagtagtctcttccctcggcagcggaaatactgattcccactgctcctgcctctagggtgcagtgtccgtacctgctggagcctgggccctccttccccagcccagacattgagaaacttgggaagaagagagaaacctcaagctcccaaacagcacgttgcgggaaagaggaagagagagtgtgagtgtgtgtgtgtgttttttctattgaacacctgtagagtgtgtgtgtgtgttttctattgaacacctatagagagagtgtgtgtgttttctattgaacatctatatagagagagtgtgtgagtgtgtgttttctattgaacacctattcagagacctggactgaattttctgagtctgaaataaaagatgcagagctatcatctcttaaaaggaggggctgtagctgtagctcaacagttaggccccacttgaagggagaggcagaattgtactcacccagattggaaaatgaaagccagatgggtagaggtgccctcagttagcacctgtcccatctcgggccctccaactcctcccagtcccactccagtgcagccagctggctccaaggtagaaacccatgagcactcagggagcagtgtgccttcagctgcagcagaagcagcccggaggataaaatgagaaccagctgcacacgggccctttaactcccaagccccacccctgggcttggcctgccttgccctgccgggaagtgatccccaaggcagggtgagagttccccatctgaggcgtttgttgcagctacctgcacttctagatgtgagtacattgtactagccccccaaaccccaaatcaggggcagatc

SEQ ID NO: 2078 - DNA, 1235 bp, Homo sapiens; identical to SEQ ID NO: 2077

SEQ ID NO: 2079 - DNA, 1196 bp, Homo sapiens
gggcgaggcaggctaacgcacgactgcgcgatgtggcccctatggtgacacgcgctgcagccgcgaagaccggaagctggggcggccccgggccgcgcgcgctgggcctgggaggcgaaactcagcttccttcgtttccgacttttccatccgcgtcctccacttccccgttccgccctcccccattgccaacattctggctgagtcacggcgccccagagcgcgccaggctgggggaaaggagcagaagggagggccctagcgacccgcgggatgtggtccgagtcacgtccgaggggggtggggagggatcgtgttctcggcgcccgccccttcctagcgcggcctctgggctgcgcctctcgggggcggcccgtagcccagtccgtcgcctgccattggacgccgcccgctcctcgtaaaggaaaaagctcggcggagggcggagtggtgcctttaaaaggccgggcgccgccttccgcctgcccgcctcctgcgccgccccttccgaggctaaatcggctgcgttcctctcggaacgcgccgcagaaggggtcctggtgacgagtcccgcgttctctccttgaatccactcgccagcccgccgccctctgccgccgcaccctgcacacccgcccctctcctgtgccaggtgagcgcccctcttcacgtgcggggaccagggaccgtggagagggatcttgggggcagtggcgggttgggcgtccgcgtggaggcctcccccatcccatgccagcgtctccccactaccaggcacacacaggctccccggcccctccagcctgaggtcctctaactgcgcaatgcagcggctgcgcgcgctgagtcatggcgggggaggaagccggacgagatgaaggaccattctcccccttttcttgcagggacccctgtggcaaaggattagggccccttagccctggcggggatcctaagaggcagtgaggggtgggggccggcccatgtacagccccagggttctcgcaagtgggagcttggtttctgtcctgggaaacggggcgcccttcgcgaggagggaaacccctccgcggtgcttgatgcccccttaacactttccctgtctctccttatcgggcgaccttgattctgagcccggaacagctgcagccatgcgaagcgacgggagcatttttcaggggaaggcgcttgctcct

SEQ ID NO: 2080 - DNA, 1138 bp, Homo sapiens
agtggcagtcagaagagctgggttctaatctcagatctggctccggggttgctgtgtggcttgaagcacagacctttcccatatctgggccctttcccacgagggtgttgggccctctgcttgattcacgatctttacattctaaaatactccggttcggttttgttttcaggcaaggtgaccccatggcaaggcgcaagccagaagggtccagcttcaacatgacccacctgtccatggctatggccttttcctttcccccagttgccagtgggcaactccaccctcagctgggcaacacccagcaccagacagagttaggaaaggtacaggggcaggcctagcaaagggaagttgggcgtaagagagagctggggaccagaagtgccccagggcctgctgggtgtggggcaggggaggtagggaacatttccctgacctccaggagaggggccctggtcatcgggagatgatgggaaaccctagctaactagtccttcccctctgtttcctgtatccaggaacttgctactaccagcaccatgccctaccaatatccagcactgaccccggagcagaagaaggagctgtctgacatcgctcaccgcatcgtggcacctggcaagggcatcctggctgcagatgagtccactggtgcgggcaggagacagaatgggtggagggtgcagggttgggagtggcaggctgatcccctaattcccatgtgacactcccagggagcattgccaagcggctgcagtccattggcaccgagaacaccgaggagaaccggcgcttctaccgccagctgctgctgacagctgacgaccgcgtgaacccctgcattgggggtgtcatcctcttccatgagacactctaccagaaggcggatgatgggcgtcccttcccccaagttatcaaatccaagggcggtgttgtgggcatcaaggtaaggggagggcctccggacgtgaggtttgagatggaagtggaggaaggaaatccaggttagtgaggcagggaatgaatgctggattggtggcctagagacttgcatggagcctgcttcaggcttagggcatttactcgacatttttaatcctcacaattctgagagaacagtatcattcccacttta

SEQ ID NO: 2081 - DNA, 1117 bp, Homo sapiens
tctcctgatctcgtgatctgcccacctcggcctcccaaagtgctgggattacaggcgtgagccaccatgcccggcttaagtaactaaatattttaattgtaactaagtgaaaatatttgccagccctgagatgcagtttaagggattaagtaaatgtgggggaagactggggctaaagaagaggaaagaggggcacgcccagctacctaggaggctgaggcgggaggatcacttgagtccaggaagtggaggcttcagtgagctgagattccaccactgtactccagccggggcgacagtggaaagggtgctagaggtcatttcctgtgtcttaatgttgttaccctgaccccaacaggtagacaagggcgtggtccccctggcagggacaaatggcgagactaccacccaaggtgagaactgtttgattctctgccctacgaacccaaccagagcaggtttgggtgctgggaggagtggaaaccacatgcccctccccaccgtgctctgaccccttcctcttctcttagggttggatgggctgtctgagcgctgtgcccagtacaagaaggacggagctgacttcgccaagtggcgttgtgtgctgaagattggggaacacaccccctcagccctcgccatcatggaaaatgccaatgttctggcccgttatgccagtatctgccagcaggtgggcctgcaggtcctcaataggcaacctcctacctcatttggttccagtgttgttaatttgcctattacctgccatgatgcctacctccccaaaagcaagcattagctttggcccgtggaggacactcaagggctgttgaaggcagaggggccaaggagggatggtgggtggatctgaggcggctcttgtctcctgtaatctgagggctttgaagcctgagtccctggcatcatcaagatacggtcttgaccagtggctgtggagagatgtaggtgggactctgggttaggaggcctcacagtgaccctgtccctcgccctgcagaatggcattgtgcccatcgtggagcctgagatcctccctgatggggaccatgacttgaagcgctgccagtatgtgaccgagaaggtaaatggctacctg

SEQ ID NO: 2082 - DNA, 1202 bp, Homo sapiens
tgcctcaaaataggtgcgatttgattcattcatcctccccggaaacaagatgccctgtggcttgggacacttccaggtcatgccggctgtcttggcataaacattaacggggccacctttctttctttcttttcttttcttttttttttaggcagagtttcacttctgttgcctgggctagagtgcaatggcgtgatctcagctcactgcaacctctgcctcccaggttcaagcaattctcctgcctcagcctcctgagtagctgggattacagttgcccaccaccatgcccagcttcgccgtccaagagcctggggccgtggggggcggggctgcctgctatcggccccgccccgccgacaggacccgcctctctccccaggcccggcggggccgaccccgcctctcgctcccagcttgccgtacgacagcggcggcgcggcgggcggagccgggaggcggggaagcagtggccgtgtgagcgtgaggagctgccgccaccgcctgctcctcgtcctcctcgtcctccggggccccagcgtcgtgggccgcgcacggccctggaagagacgtcgcctcgccttcatccgcctctctcaccgcgccgctccctcgtcctgccctgcgggctcaggcggaacccggaacggccgtcctcttcccccgccctccgccgccgcctcctcctcctccttctcggcttcctcctcagccccgggccggagcggggtgtcggcggcggccggttcgggcggcggcgcttggccatgtcgtgtcggggaaggtaatgagccgcagagccccggggtctcggctgagcagcggcggcaccaactattcgcggagctggaatgactggcaacccaggtgggtgaccggcccgggaccccgccccgacctcccgggctccgcctcgggcgggccgaggcctagggccgcggggctgggaggcgcggcctaggccctccacccaccggagccgggcgcggcttcctgggtctcctcctccccggctaggggaggaaggccgcggggaggcgaggcctaagtgcctctcccctccctgcttgttcagcccggggctgaagccgagccccggggctcccggcggtggcactgacctagggtcgggaccaggaggtgagaaagaggcgggggtggtggggggggcattccacttaccgcctccccctgaccccgag

SEQ ID NO: 2083 - DNA, 1166 bp, Homo sapiens
cccatgaggctcagctggggtctctgtcgctcctgccccagttccctctgggtcccctcctaggtgctgtcctgaatggcccgttgtcatcccaggggtgactcctggtgatgggagtcagcagtttcagattcttacactccatagctccccttaccatgaggtggagctggcttccttttccctgtcttcagccctccctgtctcccccacttcctggccagggctctcattctggacctgtgttgtaattgtgtacagaggatggcgttggcctggggtgggggtgctcgctttgtcttctgtcctttggttctccttccataatgctcctgtacccagtttatttaaggggacatgcactggaataggaaatgtcccccatctcccttcctgcaccctgctgtgctccctccaaacccaccttgctctgtgttctcaggcccccctgcttttgtctcaccaggacccatacctttcaccttgttcccttccacccctccagttagtccctatctgggtaagggtcttcccttgagctccagggggtggaacccaatgtttacattctcttctgtctctgcccccaccccatgcagcgctttgaggaattggaaaagaacctgctgttgtacctgggcctgttttctgccttgttatttgatgagggggggatggggtaaggacgagggagggagggacagagccaggacctgggtctctgttgaagcagtctgctgtcttggcaagtaggtacctcttagctttgggtccatctctcagtcactcatcagacactggttgagctcctgctccatctttgcctgggatctgctgtctccattgtcactggctgcctggagctctctatgtaccacgtgcagcacccggatctccttcccaaagtgctcatgcaactcctggaagctggagggggtactcacagtggctagaaagccactgtcctctggggatgagatgggttcttggccagttgcctggcacagctcccagtattgggttttggtggggggggaggggggacagcagcccagccagccgcctccagctcgcgccagccagtgcccacagccaagtctccagctcttcctgggtttctgcagccagcttgtaggcccgcccacctgtgccctccaccccagggg

SEQ ID NO: 2084 - DNA, 1880 bp, Homo sapiens
tttttatgggcaagaaatggaggtctgagctgcgaatggctgtggaggtggagaggagcaggcaggaatggaattcagggtgcagcgctgcttaggcttggagtaaggggctcttttctgatgtggggctgagtgaatagaagtcctggacacggcagtggggcaccctcaagaagagcagatctagggtacagattttattcttttggatgcagagacaggagaaagggctgaggcacagctggcttccaagccttccccaagaaccatgaaatccagtgagaccgataaggcaggccctgccctggggagctactgctttggggtgacaaagacatttagtgctagaggagggctgatgctgcagctgtggaaagcttcctggagaaaatgacctggaaggtttctgggatgtggctgaggaaggagggcgagggtgcagcctgtgctgggatggccaggagcatgtggagtatgtagccaaaggcggagccccggggcctggagtgctctgctgtgggctgagcctttagctgaagctcgctcagcaggactgggcaggtggatggaggagcctggtgataaactctgggacgaatctggaactgggtttggggacagagctctcagcccgtgactgccctcacagtcttccccaacccccacaggcaacaggacctgtaccgaatcctgaaggcctacaccatctaccggcctgacgagggttactgccaggcccaggcccccgtggctgcggtcctgctcatgcacatgcctgcggaggtcagcgccctggtcctgggccgggaggggcaggggggatctcaccctacagtggtgatgggggagctccctgctccctgcttctcaggccccacccctcctccttgttcttgctcttctcagcaagccttttggtgcctggtgcagatctgcgacaagtacctcccaggttactacagtgcagggctggtgagtgtctggaggctgggtgcatccggggctgtggcgtttcctccaggctgcaggcaggtccttgccttgccccaccctggccttcccggcttctgcccacagggccggccagttctcccctgatgggggcacagctgacttggccctcttctcatggcttgtcccacctgcaggaggccattcagctggacggggagatcttttttgcactcctgcgccgggcctccccgctggcgcatcgccacctgcggcggcagcgcattgaccctgtgctctacatgacggagtggttcatgtgcatcttcgcccgcaccctgccctgggcgtcggtgctgcgtgtctgggacatgtttttctgtgaaggtacttctgtggccctccaggccatgaggggctggggtttctgtggtggctaccaggggttctgtcatatttctggtggtccatggacaaaaggtacttgttgggtggaggtttcaccataagcagctgggggctggagaaacaggcctgattttagttctgccaccaacccagagcctgctctccctgccaagatcctgagactgatagcagctcatgtactttcacagggcctcagtttcctcatctgagattggcagtagatggggatgggggctgtgagtctatcctgatcaggacaggctgagatcttgggtctgaccaccccatgctctctactctccacccctgcaggcgttaagatcatcttccgggtggccctggtcctgctgcgccacacgctgggctcagtggagaagctgcgctcctgccaaggcatgtatgagaccatggagcagctgcgtaacctgccccagcagtgcatgcaggaagacttcctggtgcatgaggtaggcctgtgccctcaacgcagcccctgcctg

SEQ ID NO: 2085 - DNA, 1134 bp, Homo sapiens
ggtatctcactgtggttttgatttgcatttctctaatgactaatagtgttaagtatcatttcatgtgcatgttggccatttatatgtcattggagaaatgtctactcaaaccgtttgctcatttagaaacttaggtaggttggtctgagtgcagtggtgtttaaaactaatttttttttgagacaaagtctcactctgtcgcccaggctggaatgcaatggtgagatcttggctcactacaacctccatctcctgggttcaagcaattcttctgcctcagcctctcaagtagctgggattacaggcatgcgccaccacgcctggctaatttttgtatttttggtagagacgggggtttctccatgttggccaggctggtctcgaactcttgacctcaggtgatccacctgcctcggcctcccacagggctaggattagaggtgtgagccaccgcaccaggccgtttaaaactaatggagcacaaccagttaccaatatctttgttccttctccactccctctgcttcacttgactagcctaaaataaataaatttaaaaaactgggcacagtggctcacacctgtaatcccagcactttgggaggccgaggcaggaggattacttgagcataggagttcaagatcagcctgggcaacatagtgaaaaaccatctcaaaaaagaaaaattagccaggcatggtggcatgcacctgtggtttcagctacttaggagcagaggtgggaggatcgcttgattctgggagttcaaggttgcattgagctgtgatcgcgccagtgcactctcgcttgggtgacagagcaagaccttgtctcaaaaaatttaaaacaaaacaaaaaaaactggttatttgtctttttattgttgaattataagagttttaaaaaatatattctggaaacaaatcccttattagagatatgatttgcaaatattttctccaattttttttttttttaaagacaaagtttcactttgtcgcccaggctggtcttgattcctggcttcaagagatgctcttacctccacctcctgaagccccaaagggctggaattacagccagtgagccactgcacccagcctccaattctttagattttacattttagaacc

SEQ ID NO: 2086 - DNA, 1197 bp, Homo sapiens
cggccactcgctgggagaggaggaggatcgcagagggatccagcggaaatagcctcccaggaccgggatccccgtggatcccgggggatctcggggcataatctgcagggacaaaggcctcgggaggctcgggccgcgggagaactggggccgctgcattctgggttctggcggcaggtgccaggcagggcgcgagtgatccgctgatcgaggcggtggcagcgggaggacacccgctccgggcgaccggccgggggcgccctttcgcgccccagggctgcggccgctgggctacggggagccgcgggcggaccatgaagggcggagccccagggaaggggccggccctcaccccccgctcccccgctccccccttaccccaggccgcagcctgggattccccagggacccccccggagccgccgcgtctcccatggacttgcccggggactccaggtgagagcgtacccgggcggcccgcctgtcttgaccccgggagatggggatcctggcgaccgtgccgggaaactacagagccagcgacaggttcgggcgaccgtcctctgcttctttcaccctccagcccgcctggccagccgcgtctgtgccgccagcctctgactcgagcattatggggagccaggagcccgaaacggccgaggctgcagctcccgggggccccttctcccctggaaaaggcctctcggcgggtcctggccgtggtgctagaagatgtcatggctgttcacatggtgagccccctgaaccaagagactctctattcccccatgactttcctcactaccaaactcgggccagatccctactgaggataactgaagtccaaatccatcattgttgtactcagccctcaggcagcctccctcatggtagagtcctgcttggctcccacttactccaacctagaattgggcagtgcccattccacccaccaacgattttgggctggaaccacatccctgtaactctgagaaactcttctgcttctttttttctatcttttttttttttttagagacagggtcttgctatgttgcacaagctggtctcaaactggcatcaagcgatcttcccatctctgcctcccaaagtattgggattacaggcgtgagccacggcgctgggccgaaactcttctgctttcttcccagcccagcctccttaggaagcaggctg

SEQ ID NO: 2087 - DNA, 1167 bp, Homo sapiens
acctaggggccctggcccagctcgggctgacaggtgaggggaacgggggggggtcggggcaaagctccatctccccttcctttaaccaggtcctagggctgaggttttaagccagggctggagggcaaaggtcataacctcaccagccacctctgaggtcatggaacctgggaacagaagcctcaacccccacaagaccaagcatcacatggagtgtagggtcactgggagagcagaggtcacagcctctagagaagggagaggggcgtgtgcatgggagtgtggctcatctcgggggccatggggcctcctgaggtacacctttgcccctgtaagggcctctaggccctgggcctgcctccccaagggctcactaagccagaggccaaagtgccccctcccgttcacctaccacccaagtcctcatgccctccgagggctgggggaggaggggctcaaggaaggggggttccatgtacatatttatcacccctttcacatagccccaagaccttttgtacatttttacaggggtgcccctcccaacagttcccttcctggttaattaaaccctcagactggtgctgtgttcctagcctctggcctctctgtggggaaaggggactgcagggggaagagccgggaagggacagtcaggcttctccctgggaaggtggggccagcaggagatgaccaacagggggcaggacctggggacctgggctggagggaagggcagaagcttcctacttggctgacagccccggttcccccaacatgttcccgttcactctgcccccacccccaaaggctcagcctctaaatctcagactccaccacctcttaatggctcagtccccttcaccccatttccaagtgcccccaggactcctgggccctgcttccctgaaccctgttctccaaaaccctgccccaggctaagggtggccagagaaggtcaccatgtaccacacaccaaagaagggggtcggcccaggggtgggcgacacaggcagcttcttcggcagcctcacggcagcaaccccagccttcccaaagcagcaggcgcctccaggctggggcccaacctagaaggcaggggtcaatctaacaaaaccctaacgttgacttttttccctggtggggcttcttctgtaacatgacttg

SEQ ID NO: 2088 - DNA, 1213 bp, Homo sapiens
tccgttcccttccccctcagctgttggaagggccttccagcccctctcaaaccccctcatctcatgatagtgacacccgagatgggcctgaagaaggtgctgaagaagagccccctcaggtgttggaggtataggcagaaggagcagagggagggttcagagggggaacagagggagaggttcagggtctgagttccgggctgtgaggttggttatgagttttaggagttctgctagtaatggacatttgggctctttggggatgactggggaagaatctgtttggggcaagttgcattttgtgattggcaggttttggcgctatagtggaagagcgtattgcactttcctctttaaattgctgtgtggtcttgaaaaagtacttcctctgaccgttacttgccacttctctgaacatgccctaatgttcccttattggcttacaggttggaagctggcatggtacccttaagtcttttctgtttctccatatgtctcaagtgcatggggaagtgttgggtgcctttatttgttacctggcactttcacagttccttccccaggcagtggggccaggatttggtagctggtgctgagagaaaacccttgattgtattcttgccctgggattataccagtggcaactgtcactcaatgggacagtgattctcctgtgacacctttttcaagtttgtgccattcttctgctactgtaaccttagacccttcccttttttatcttttgccatacagataaagcccccaccctctgctgtcacacagcgcaacaaacagccttggcatccagatgaagatgatgaagagtttactgccaacgaagaggaaggtcagggctgttcggtttgtcctattgccccttaccccttgaatgaattgtctggacctaacctttcaggctttctcatctgtttcatttggactgtgtcctgtgcctctagcctctatccctattaatcttgcttctgtctctttcctagcggaggatgaagaggatactatagcagctgaggaacagttggaaggggaggtggatcatgccatggagctgagcgagttggctcgagaaggtgacatttaccagacattttactaagcatccacttggtgtctgcggtgtgcagtaccaaggataaagagatgaataaggcactttgtatccaccctggaggaattccatgtctaatgactaaga

SEQ ID NO: 2089 - DNA, 1213 bp, Homo sapiens; identical to SEQ ID NO: 2088

SEQ ID NO: 2090 - DNA, 1206 bp, Homo sapiens
cccactctggtgaggcctcttctcaagctggtccacagtccttcacctgaagtcagtggtgagtccaggtggctgaggccagaaatccttgccaggaatggagacgagatggggtcgcctcaaggtttcttagttttagtacaggttttttcatatcagcgtactgccttgatttgtagtgggccccagaactgggctgcctgagccctgacctaatttcaagatctatttgctggaatcttggaggggaagaaaatctaaagttgtcagattacttggatgtttgacttcatgttgtgggagtgaatgccttctgggaaatgggaagcttgggggtatgggaaagatgggacagggagtagaaaggctcaggaaaagaattctggggctaactcatcctctctctccacagcttcagcccccggagctgcccccttgaccatctcttctcctctccacgtgccatcctccctccctgggccagcctcttctccaatgccaattcccaactcctctccccttgctagtcctgtgtcctctacagtctcagttccattgtcatcttcactccccatctctgtccccaccacacttcctgccccagcctcggctccactcaccatccccatctcagcccccttgactgtttctgcttcgggcccagctctgttgaccagtgtgactccaccattggcacctgttgtcccagcggctcctggacctccctccttggcaccatctggtgcttccccgtcagcatcagccttgactctaggtttggccacagctccatccctgtcttcatctcagacacctggtcaccctctgttgttggctcccacctcttcacatgttccagggttgaactcaaccgtggccccagcatgctcacctgtcctggtgccagcttcggctctggccagtccttttccgtcagcaccaaatccagctccagctcaggcttcccttctggctccagcatcttctgcatctcaggctctagccacccctctggctcctatggcggctccacagacagcaattctggctccttctccagctcctcctctggctcctcttccggtcctggcaccatcgccaggtgctgctcctgtcctggcttcatcacagactccggttccagttatggctccatcgtctactccaggaacctctttagcctcagcttcaccggtaccagctcca

SEQ ID NO: 2091 - DNA, 1229 bp, Homo sapiens
gaatggagacggagcactgctcgccatcaccccacctgctgtgaaacgtcggagggggaggccccccaagaagaacaggtctccagcagatgctgggagaggtgtggatgaggcaccctcatccaccttgaagggaaaaaccaatggggctgacccagtccctgggcctgagaccctaattgttgcagatcctgtcctggaaccacagcttattcctgggccccagcctcttggaccccagccagttcacagacccaatcccctcctgtcacctgtggagaaaagaaggcgaggacgaccccctaaagcacgagatttgcccatccctgggaccatttcctctgcaggggatggcaactccgaaagtcggacacagccacccccacacccatcacccctaaccccactcccaccactgctagtttgtcccactgctactgttgccaacactgtcaccactgtcaccatttcaacgtccccacccaaacggaagaggggccgacctcccaagaatcctccatcacctcggcccagccagctccccgtcttggaccgtgacagcacttctgttctcgagagctgtggattggggaggcgacggcaaccccagggccaaggggagagtgagggtagttcctctgatgaggatggaagccgccccctcacccgcctggcccgccttcggcttgaagcagaaggaatgcgaggacggaagagtggagggtccatggtggtggctgtaattcaggatgacctggacttagcagatagcgggccaggcgggttggaattgacaccacctgtggtctcactaaccccaaaactgcgctcgacccggctgcgtccagggtctctagtccccccactagagactgagaagttgcctcgcaaacgagcaggggccccagttggtgggagtcctgggctggcaaagcggggccgcctacagcccccaagtcccctggggcctgagggttcagtagaggagtctgaggctgaagcctcaggtgaggaggaggaaggggatgggaccccacgccgacgtcctggcccccgccggcttgttgggaccaccaaccaaggggaccagcgcatcctgcgcagcagcgcccctccctccctggctggccctgctgttagtcacagaggccgcaaggccaagacgtgagtgggctgcccctccacctaggctttccaccgtggccactccctccatgaccaggcctgac

SEQ ID NO: 2092 - DNA, 1188 bp, Homo sapiens
ttctgaggctgctgtgaagccagggtgagctcctaagcttgttgccctgtgatccagatgggtcttcagagtctggcacagcgggcatgaggatgctgaggccccagcctgtgcggaaatgtgagcacagaggccctgacttgtgctattttccggctcttgcagaggagtgagctctgtggtccgccgttgtgttcatcgagctactggccacgagtttgcggtgaagattatggaagtgacagctgagcggctgagtcctgagcagctggaggaggtgcgggaagccacacggcgagagacacacatccttcgccaggtcgccggccacccccacatcagtgaggctgtcttccttgctcctgttagcagacgaccccccacctcctgctggccctgcccatagcccacttccgccaacattgcctccacacctctcctcccttcattccactaaagagtggccatccgttgggcgcccactgcctcctctggttctcctttcttcccagtaacagcccgctgctgtcccagggtggccaagccccgttaatgtgcatccactcctttccatctctgtctctctgcctctcttcctctctccctagtcaccctcatcgattcctacgagtcttctagcttcatgttcctggtgtttgacctgtgagtatctccctgccaccatctgagaagcctcctccccacctccatgtatggcccagcatttgtggtgcagtgggctggacccatcctgctcacaccttcctgttccagctggggctctctatcacctgggcctgcctgctagcgcatggctctggccttctcccttggtgccatgattgaggcaaattctttaatagtgactagtggctgggtgcagtggctcacgcctgtaatcccagcactttgggaggccgaggcgggtggatcatgaggtcaggagatcgagaccatcctggctaacacagtgaaaccccatctctactaaaaatacaaaaaatcagccgggcgtggtggtgggcgcctgtagtcccagctactcgggaggctgaggcaggagaatggcatgaacccgggaggcggagcttgcagtgagcccagattgcgccactgcactccagcgtgggcgacagagtgagactccatctcaaaaaataaagtaatagtgaccagccagacgtggta

SEQ ID NO: 2093 - DNA, 1094 bp, Homo sapiens
ccttgttccttgtttgagactgggctgcaggccccaggaagactttccttcacccaccatccccctaacctcggcagggcttctgtcctgtggagttccctggacaccttggtctggctcttgtgccaagggctgaaggaggtaccctcttggcagatgggggcatcacttgcttcctttgggaagctctaaggttgctgcagtcaccttcctcatcttgcaggtgctgaaccaacatcatcagtttctattctaatcaggccccttcccaatctccatttctctgccaagcccatttacccccacctcatgcatcccaaggctctactgggtccctggacctaaccctgctttcatcctggtggccttaactacagtggaggtggaacttcccaggaggggaagggacagaccagccccagccgctgggccaacttccaatcattccagctagaagagcttccccctgacaccctgtgactgagcctgtgtcctgtctgcctgcccagccatgctccatcggctgtgagggcagtgcccggagaggccagagggttggagctgcagggacccgtttggacccacagcctctgttctagagatgcttgtataggctgttaattgtgatgaataaacgttcaaccctcggcctgcagccagagtagccaggccgcgcaccccaaatgtagtcccccgattttagctgcagcagctgagcagcactttgctggcttggtgtgagcctgggagggctcagacttaacggccggcagggatcccggactgggcctgaaggggagagcgtggtggtcgtcgcggagccgcctgtcctgctcccaccgaccccggtctgaccacgtccttggctgtcatggccgggggatgccgggactcctcgggctgcatcctgggaagtgtagttcctggtccgcacatggttaggaggttctcggagagagagctagtttcccggttgcgctggccaaaggccggcctgaactggatcctgcggaccgcttctcagcggcttcacccccacaccactcgaatgcacagatcgggacacctcagctgggtgacttccctcgttgcaa

SEQ ID NO: 2094 - DNA, 1099 bp, Homo sapiens
tctgacatttctcacgaggctacctcgaggcattttcagaaatatcaaatatcaggttcgttcctccacacagtgtcactgtcgttgttgtttttggtgcctgcttcctctgcatcctgggcatctggccctgggcttgcctcccgggcccaggaggggaggggagtggaggctttggagaaggcagaggctcagaggctggacgcctgggttctgtggagctcacgcctgtccacccttcctctccaggcccccgaagcttaccctgtctttgagccagtgccacctgtccctgaggcagcccagggtgacacagaggactcggagggtgcccccccactcaagcgcatctgcccaaatgcccctgacccctgagaagccggcctgcctgtcctgttgccccaggggcccctttggctttttacaaataaagacccttttgtaattttgtgtcatgtcatttccccgtcagggctggggagggtctttggagacagttttgtctcatgcaccattgctcagatgtggtcactgaggctctgagaggaccttcctgtagtgacaccacaaggcagagtggggtgggggcttgagccaggaccctgcctctcagtacttcccaggtctgtcctatctcccgaccttcacctcctcctctgggaggcccaggacccctcttcctgctcagccctcgcctgggcctaacaattatcaaaactctgggtagctaggccatgattcttttttttttttttttttttttgagacacagacttgttctgttgcccaggcaggagtgcagtggtgcgatcatggctcactgcagccttgacatcccacctcagcctcccaagtagccgggaccacaggtgtgtgccaccatactcagctaattttatttatttatttatttatttatcactatttttttttagagagttttgctcttgttgcccaggctggagtgcaatggcgcaatctcgcctcactgcaaactctgcctcctgggttcaagcaagtctcctgcctcagcctcctgagtagctgggattagaggtgcctgccaccacgcccggctaatttttgtatttttagtaga

SEQ ID NO: 2095 - DNA, 1248 bp, Homo sapiens
ctcacacgcccttccatccgcagcctaactgctacgccaaggtcatcaccatcgagtcccagaagaagatcgtgatctactccaagcagcccattggcgtggacgaggagatcacctacgactacaagttcccactggaagacaacaagatcccgtgtctgtgtggcacagagagctgccggggctccctaaactgaggtggggcaggatgggtgcccacacccctatttattccccctggtgccctgagctcccagcacccccccagccttagtgggctcagcagggcccacatgcccccatctccaagcgtggggttgggggccccaagcccagcgagggagcctcagtccctggaggcagcttctgcctctcctgtcacccctgcccaccaccccctgattgtttttctttgcggagaagaagctgtaaatgttttgtagcagccagcagctgtttcctgtggaaacctggggtgccggcctgtacagattctgtcctggggggctacacagtcctcttgctttgtgttaatggggacttccccttacgccctgcgtgtacccctccccagtttaggggtctctggggcagtggccatgttctccccctgggggggctctgcacccccagtcctggggactccgtgcctggaaccctgcctcatctgttcctgccagaccctgagggtcacccttccaccctggtgtcactccccggctcagccaggccaggatggcggggtgggtcccttttgctgggctggactgtacatatgttaatagcgcaaacccgacgccacatttttataattgtgattaaactttattgtacaaaagtgtttggtcggtgtatttgggcaggagcgaggggttgggggtagagggcacggagggttgtgcaagttgaagagagggaaaagtgggtacctgaagtgtggggcaggtaaaggggccttcaggcaagagcccagacctgcagagacagtccgagactgtctcggaccccctgacaggctgcagcagccgcacccgcaccaggaataccccaccagtgcccgccagggtggtgccaaggtcaggcctccccttcctacaatcacagctgcagctggacctccggcctcctgggaagcccagcaggagggaaggcctgaggtcacactgtgggatgaggtcaccgctggctccacccacagccccagaccccttcagcccactctgcaagttcgagcttcatccccaccaa

SEQ ID NO: 2096 - DNA, 1205 bp, Homo sapiens
ccactgcactccagcctggacaacagaataataccctgtctcaaaaaaaaaaaaaaaaaaaaagaaaaaaaagaaaagaaaaagactttgcccttgagtcaagactttacccttttacccttggctaagatggatgtaggaagtgacatggtacaaaatgctgcagcagagcgtgtgtatgtgctggaagaggagttgactagggcagtgattgacatctctgttccagatatttgcttaccttccctgctgggcccctccctataggagcattatatgctcattccctacttacaataggtttggctataggacttgctttggccagtggaatatgggtaggaaggcaaaatatcggccgggcgcaatggctcacacctgtaatcccagcactttgggaggatgaggcgggtggatcagctgaggtcaagagttcgagaccagtctggccaacgtggtgaaaccctgtctctactaaaagtacaaaattagccaggcatggtggcacgggcctgtaatcccagctgctaggaaggctgaggcaggagaatcacttgaacccgggaaggaggaggttgcaatgagcccagatcatgccattgcactccagcctggacaaaaagtgaaactccgtctcaaaaaaaaaaaaaaaaggtaaagtatcacttctgcatagaagctttagggcaccattgagtactctagcagcttccagtctcttctccctctgctcaggctcataaacctggcagtttccagatctagacttctctttcagcctgcaacccagaatgacaatgacatgaagctgggctacagcctacctataaaatgatgcagaatttaagaaataaatctctcttgctgtgagccattgatatatggaggttgtttgttagcacatccaaatgtttaaacaaactgttacagaattaatacccagaagtggtgtgctgcaacaataaaaattgagcctcagccgggcacggtggctcacacctgtaatcccagcattttgggaggccaaggtaagtgggtcacctaaggttaggagtttgaaaccagcctggccaacatgacaaaaccctgtctctactaaaaatacaaaaaaaattagccaggcatggtggtaggtgcctgtaatcccagctagaggctgaggcaggagaatcgcttggacccaggaggcagaggttggcagtgcg

SEQ ID NO: 2097 - DNA, 1563 bp, Homo sapiens
ttgctgcccaagctggaatgtggtggcatgatctcggctcactgcaacctccacctcctaggttcaagcgattctccaccttagcctccccagcagctgggattacaggtgcccatcaacacacccggctaatttttgtatttttattagagatggggttttgccatgttggccaggctgctctcgaactcctaacctcaggtgatccacccccattggcctcccaaaatactgggattacaggcatgagccaccgtgcccagctgaatttctaaatttttgatagagatcgggtctttctatgttgcccaagctggtcttgaactcctagcctaaagcagtcttcccacctcggcctcccagagtgtttggaatacgtgcgtaagccaccacatctgccctggagcctcttgttttagagacccttcccagcagctcctggcatctaggtagtgcagtgacatcatggagtgttcgggaggtggccagtgcctgaagcccacaccggaccctcttctgccttgcaggttgcctgcggacacgctgggcctctgtcctgatgctgctgagctccctggtgtctctcgctggttctgtctacctggcctggatcctgttcttcgtgctctatgatttctgcattgtttgtatcaccacctatgctatcaacgtgagcctgatgtggctcagtttccggaaggtccaagaaccccagggcaaggctaagaggcactgagccctcaacccaagccaggctgacctcatctgctttgctttggcatgtgagccttgcctaagggggcatatctgggtccctagaaggccctagatgtggggcttctagattaccccctcctcctgccatacccgcacatgacaatggaccaaatgtgccacacgctcgctcttttttacacccagtgcctctgactctgtccccatgggctggtctccaaagctctttccattgcccagggagggaaggttctgagcaataaagtttcttagatcaatcagccaagtctgaaccatgtgtctgccatggactgtggtgctgggcctccctcggtgttgccttctctggagctgggaagggtgagtcagagggagagtggagggcctgctgggaagggtggttatgggtagtctcatctccagtgtgtggagtcagcaaggcctggggcaccattggcccccacccccaggaaacaggctggcagctcgctcctgctgcccacaggagccaggcctcctctcctgggaaggctgagcacacacctggaagggcaggctgcccttctggttctgtaaatgcttgctgggaagttcttccttgagtttaactttaacccctccagttgccttatcgaccattccaagccagtattggtagccttggagggtcagggccaggttgtgaaggtttttgttttgcctattatgccctgaccacttacctacatgccaagcactgtttaagaacttgtgttggcagggtgcagtggctcacacctgtaatccctgtactttgggaggccaaggcaggaggatcacttgaggcca

SEQ ID NO: 2098 - DNA, 1185 bp, Homo sapiens
ctccagtgaaaaccaatgaaacagggtcaaaccctgtgtctactaaaaataaaaaaatgagccaggcgtggtggcgctgagacaggagaatcactggaactcaggaggcagaggttgcagtgagctgagatcatgccactgcactccagctggggtgggggacagagcaagactcaatctcagaaacaaacacacgaagccaataaagttgtttcactcaacgtgtcaggctcaggtctcttgacaggatacatccggcatccggggaaacgtcgaggggtggggtggaatctattttgtggcctcaagggaggttttgagagatagtcttgcaaacgtgatggcctaaggaagcccctctgcccaagaagccatattcatttgtatcctgtagccacccacgagggagaatccggctctctacagacaccccaacccccaccccaccccaccccctgcctcgtgaaatgagctctcgctccatcaggctctattcacaccgtctggttttgtaacctccagcgtgtgtgcatgggttgcggggtggggtgggggcggctgtggacagagaaggggataaagcggcggtgtcccatgggtgcccgggacgtgggacatgagtagagtggccagagcctagttaactcatcgcctgtcaggacgtctcccctcctggtcccctctctgacctacgctccacatcttagcagttcagtggggaccttgtgggtggaagttgccaaccctttgtactttagccgacgaagactgggctcccaagagtctccccggagtcggggccttgggcaggttcacaaggatcctgatggcgacggttggtgatggtgatgtaagttggaagcctcggaccaaatcagaggtatccatttgacctcggtgggacaggtcagctttgcggagttccgtgcgtccttccagagattcatccagcgctagcaagcatggtcccgaggatcccagctcccagcagaggcaattttgttcacacagaatcctgggcaggaaagttctcagcagatttaggcctcctagccaaaaagtcaaagccacttctgggattttttttcaaagagccaatggttccacaatgggccatgggtagttgtggaaatggagagacgtgtttgcagatacatatttgagacagaacggacagggctcggt

SEQ ID NO: 2099 - DNA, 1529 bp, Homo sapiens
gagtccactttaaatcctttaacgaagatccattggagggcaagtttagtgccagcagccgcggtaattccagctccaatagcgtatattaaagttgctgcagttaaaaagctcctagttggatcttgggagcgggcgggcagtccgccatgaggcgagccactgcccgtccccgccccttgcctcttggcgccccctcgatgctcttagctgagtgttccgcggcccaaagcgtttactttgaaaaaattagagtgttcaaagcaggtccaagccgcctggataccgcagctaggaataatggaataggaccgcggttctattttgttggtttatggaactgaggccatgattaagagggacagctgggggcatttgtattgcaccgctagaggtgaaattcttggaccggcgcagtttggaccagagtgaaagcatttgccaagaatgttttcattaatcaagaatgaaagtcggaggttcgaagacgatcagataccgtggtagttctgaccataaacgatgccgactggcaacgtggcggtgttattcccatgacccgctgggcagcttccaagaaaccaaagtctttgggtttttaggttccggggggagtacggttgcaaagctgaaacttaaaggaattggtggaagggcaccaccaggagtggagcctgcggcttaatttgactcaacatgggaaaaatcccccgggccggacagggacaggattgacagattgatagctgtttctctgttccatgggtggtggtgcatggccttagttggtggagtgatttgtctggttaattccaataaccaacgagactctggcatgctaactagttacgtgacccccgagcggtcggcgtcccccaacttcttagagggacaagtggccttcagccacccgaaattgagcaataacagatctgtgatgcccttagatgtccgggactgcacgcgcgctacactgactggctcagcgtgtgcctaccctacgtggcagaggcgggtaacctgttgaacctcattcgtgatggggatgggggattgcaattattccccatgaaggaggaatttccagtaagtgcgggtcataagcttgcctgaagtccctgccctatgtacacactgcccgcctctactactgataggatggtttagtgaggccctctgatcagccccgccgggtcagcccactgccctggtggaacgctgagaagacagtcgaacttgactatctagaggaagtaaaattcgtaacagtttcggtaggtgaacctgtggagggatcattaacggagaagagcctcgaagccgcggcggcgaagccacggcggcgccgccgcgtccttcctccttggcagaccctgttccccgtgtggcgcgtgcgcgggcggggtcgtgccctttgtttgttgcatggccccgcctgccctgagagccggagaactcgggagggagagggggggagagagagacacgcgtgcggggacgaaaccttgtgttcgtgtcgtggggcaggc

SEQ ID NO: 2100 - DNA, 1176 bp, Homo sapiens
aagaaatacctgagactgggtaatttttaagaaaagaggcttgattggttcacagttctgcagactgtacaggaagcatggtggtatcagcttctggggatgcctcaggaagcttccagtcaaagcggaaggtgaagggggagcacgcacatcgcatggcaagagcaggaacaagagagagaatcagggcggggcaggggatgccgcagactttcagggtctgctcccttgacccaaacacctcccactagacccacctccaacatggggattacatttcaatgtgagatttgggtggggacaaacatccaaactacgtgaacagtcgtgatctgtcactcaaaggaggatgctcagtcaccagctacagatgttcccatcagcttttggggaattaatttggcccagcctcgaaaggtacttgggagacccctctccagcctttggggcctgtatcaaagccatgtctcatgtctcccccagctgtgccctggcttctctaatgccatttatgacattcccttctcctgcgccactgttcatgcacttatctgttcactggctcagcgggcatgctctgaggcgctggagagaactaagttctgcccttatcctcacgctgtgtgtaacagcagtattatttgcacacactgggtctcatttcctttactgggctgaagtctttttaaggctctggttcttgcttagtcacttgtgtttcctttagcatttagtgaacacagcttttctggtgctcaaatcctggtttgcattccaacaggataaagtttgtggcatcacaagcatggaagggcaagaccaggaggaattacaggcaggttctgctgtcctcagaaaccagcccttctctgtctgtgagaatagtggctggtttcttatagaagctggggcctgccaccctcctggcatcccagaaccctgagctttttaaataggaagcctagttggtgctttcttggcagaagaaaagttggtccgttagtaaaggaattggttcattgcttagctagttcaagatagaaattctaatggaatcatgccacagtcttacaaggtacgtgtgtatgttttttccaggcatattttttatatttttccatagaccagaatataggtattattaacaaaaaggtaagatactctatatactgtttt

SEQ ID NO: 2101 - DNA, 1434 bp, Homo sapiens
attacacaccacacacagacacacctcaacacacctatacacacaccacacacagatacacacacactcatacccccaccacacccacacacacactacagactcacacacacaccacatacacacaccccacacacaggctcatatacccaccacacctacacacacacccccatcacacctacacacacacctacacacatacacagacacatacaccccacaccacactacaactacacacacaccacacagacacacacacacccaccacacctacacacacacacatcccaccatgccaacacaccacacacagacacatgcacatgtgagtgtatgcgtgcacacaccccaccacacctacaaataccacaccacacctacacacaaagccttcataaaaataagagccgggccgggcgtggtggctcacacctgtaattccagcactttgggaggccgaggcgggcggatcacctgaggttggcagttcaagaccagcctgatcaacatggagaaaccccgtctctactaaaaatacaaaattggccaggcatggtggcgcatgcctgtaatcccagctactcgggaggctgaggcaggagaatggcatgaactcgggaggcggagcttgcagtgagccgagattgtgccactgcactccagcctgggtgacagagcgagactccgtctcaaaaaaattaaaaaaaaaaaaataagagagccaggtgagaaccccttctccctcgcataactggctgaggagagtcagacacacaggctgctcttctgggcgtccctggaggccgactacaccatcatgcatggcagctggggaggggggcctctgcggggagggtgttctatgggtctcaagggaacacagggcactgagtgattctggatgggcttctgacctggggacaatttaaacagcattacaaccgacattttggttttcttggggattttataggccaggtacaaagcagaaagtgcatagaagatgtgatccactttgcctgggaagagaagctctttctcctggctgatgaggtaagaatgtccccactcagagggagtgggcactagctttctcttctagagggagggacccagcccccattgttctgcagccagagagaactgtcttggtgttggaggaatgattctggcctagggtgaggatatttagttttacaacttgtgggactgtgacttaatttacccctttattggtttgtactcttggttgtaaatttcagaaattcagcccaaatcacttaagctccaaaagaaaaaggaaaaagaaaaaatgccagtggggtcacaggtacgcagctggatccaggggcttggaccttatctttcaggtcctctttcccttttctacccctctgtgttggcctcatacacaggcctgttatcttt

SEQ ID NO: 2102 - DNA, 1147 bp, Homo sapiens
gaaaaacttctttctctgataagaaacttaaacttactggcatcccttataaggcttaattcaaatttatgtccacataagtgagttcttttcatttcttctgtttatttttctgtgtattgtggtacgttgtatcttgaactaagtattagcttcttgactcttcagtttgaatcactcaaaaatatttaatttagtagatagcatatgccaatggaaaagattactatagttctacagagtagcattatttttaatgtaagatacatttatcatgacttgtatagcaattctcactaagacctttgtctatgaagcagttagcagaacagttattctgcttttctcatttgtgtcaatacatttatattctttcttgtttgtgttgtcctgatttgcttactcttattttctagctgctccacgtcaaagaatagagttgacctttgatgaacattattatatagaaccatcatttgagtgtcggtttgatcacttggaagttcgagatgggccatttggtttctctcctcttatagatcgttactgtggcgtgaaaagccctccattaattagatcaacagggagattcatgtggattaagtttagttctgatgaagagcttgaaggactgggatttcgagcaaaatattcatttattccaggtaaagaataagttatcttttaagtggttgggcatctcactctaactctgattttagaatcttaaggttagaaaagagattaatttggtcaagttaatcaaatcaagattttaaacaaattagcaaagtcaaagggaaattagtccatgaacaaataagaagttaatagaaattggacatagaaacgtatcacttgaattttgaagcatatcagagatggtgccacattttcttagatttttttctgtcttatagcacatgctcaggctaacatttaaaatacatttaaaaataaataattttaaaaataattcaacaaattgtcttgttttcagaattcccacaaaaattgttttgtatgatttttctcatttagctgttagaattaaccactcaactgaatgaatactctagaatatattgagcaatagaaagaatactgctctgcacttggatgtcaaagatctgggtttgaattcttt

SEQ ID NO: 2103 - DNA, 1160 bp, Homo sapiens
gccggctctccgggcgcgccgcttccgacccctgcgagtccggccgacgttcgcggggcgcgtgtgggaagagggatcgggtcgggaaggcggccaggaggcccctgggcccagcagggccctccgggctgcgccctcgcgccgcttccgtagaattccgcgcatccctttgcaaagttgtgagattcctgtcgtggagcggaggccgctctttctccagatgtgatggcaaaaagtaattccacgagaacaataaaagccgcggccgtgacgtcgtgcagtggttttcgaatagccccgcggcgcctgcacctcgcggcggggaacggggcctgctgggccagccgggtcccacctgctgcggccacggaggctgcggcaccactgcgggctccgggggcggcgcgcgggcgccgcggacccggcttgtcccggcccccggggagcgctgctgctcgggtgcttcccgggacgcggcgctcctcgcgctccgccagaggtctcagaattccccgccgctggtgttcggttcttactaatttgttgtactgggaattaaaacagttggcttgtccagagcacagagctctaaaacctactccaccggctttgcatttcccaggaggtggtaatttagatgaaaatttatatacatagataattaggattgggatacaaagttgctcctgaaactcggactgaataaatcgtcttttcaatttccagagggaaaacagcaccaccactcagtaaaggacttccctttttccccctgctgatttaaattgaaagctgacgtgtttgtaatgtcgtaacatgttctttttttaaaaatttcgagggtacggctgaggcattattaacggtgttatgtataactcagcactgtatcttaatatttgtagagtgacttttttcctgctccctaacagcacttttttcaaatttgttttattagaaagttcagtgtaattttgcttttgattttaattggacacattgtctactctccacatattcctaaattcgtaattgagatttcagtaattcgaaacgtttaactaccccactgtaaacgtatctacagcttgtactaaggtaacctaggactttctagctgatgaatatttcacaaaccgtaaatccgtagtgatttcttt

SEQ ID NO: 2104 - DNA, 1321 bp, Homo sapiens
attctacattcccttcctttgaatgacaaagtcccaggtgacatggcttttgcctgcccctctgacctcctcacagaattctcctcttcttctccactgctatctttgggtccataagatgcaatctaatttgcactttaggctctgtagtatagctttttaggctctctctaatagctattttatctgcctggaaagctctctatactgctgtttgggtagcttgttccttctggttgagttttaggttcttatcttaaatgtagcctctttagaaaggctttttctgcccacccaatctaagtagcccccagacacatcactcttaattttaattctctgtagtgtccttattattaggtaatttttcccccttcttagttttcctgttcatcttcatccactagaatataagctatataaaagcagagacttacttgttttgtgcatagctgtatccctaaagtccagaagagtgcctggaacataaaaaatgttcagtaaatcatataatatctatcacactggagactgtcctgcttcttttgagagacagtgtcataatatggttattatatagatgttagactcgtacaactaggttcaaatactagtattgaatcttacaaactgtgaactcaatagcaaagacatggaatcaacctaggtgcccaaaaacagtgggttggataaagaaaatgtggtacatatacaccagggaataattcacagctgtggaaagaatgaaatcatgtcctttgcagcaacatgaatacagctggaggccattatcctaagtgaattaacacaagaacagaaaaccaaatactactgcatgttctcctaagtgggagctaaacattgggtactcatggacataaacatggcaacagtagaaactggggattgctagaggggagagtgagggagaggggcagggcaggggttgaaaaactaactgttgggttctttattcactgcctgaatgatgggatcattcacaccccaaacctcagcatcacgtaatatacccaggtaacaaacttgcacgtgtacccctaaacctaaaacaaaatttgaaattattagaaataaataaacaaaatgtttttccccctaaaaccaaacaaattgtgtctaatgttttgcacttaattttccatactatggagtggagataatagtatatccctcataagttcttttgtgaagatgaagtaatgtctggaagtacctagtggtggtagtagtagtactaatgataataatgatttttcatgctatgatgacagcagtgacaactttttaagcagctaatctt

SEQ ID NO: 2105 - DNA, 1099 bp, Homo sapiens
tgaaacctagctgaatattcgtggagtggatggctttggagtatgtgaacattatcttctttccttgagggtttgggggtatgattatttgagaaaaatttgtgtaatgaaacattagcataaggaatgaagtttggatttatggtcccataattagacatatttcttaataactagaatctattgacaaatgactaccacatgagtattagtgacacttagttgtttggaccatgtacacatcagttagttggattgagtgctggaggtaagggtgggaatatcccatgacatttcaagttcttctgtatttattttcaaaggtactttattccccctcttgttcccccagcaagaaggtttacaagtagtaaagtatggtacttcacataaaataatggaagttagattaagcactgcttcttcatttgtttagagtttttctttgtttatctttgtgaaaatgactgaatttgatgggtttttattttttcttttaggctcagtttatgaacctcttaaaagcattaatcttccaagacctgataatgaaactctctgggataagttggaccattattacagaattggtgagtaaaacctgaggaaaacgtgtccttaggtatctgcgattagtattccccttgccctagttaaattatgtacattatgtggatgatattgttctgtcattgggatttggggtactttcagtgcttaagtagctgtgtattccaattgtatgtcgatatcaggactataaaaggaatctggcagatcatatctggcccttgaagaatttgaaaactgtcaccaatatcttctgtgtttttttaatcttcctaaacattaccagatttgagaccttgaggatgtttcttgattaatacacagatatttcatataagtattaatttgctcatttacctaaacatggttcccagatagtcctaaactttttatatccgtttctaattcattgagatacaagagataatcacaagttagtattattaatatcagggcgcttgtgttttgtttgttttattttgtttttccaggaccagccttgcaaattttgtttttcaatgtgagtaag

SEQ ID NO: 2106 - DNA, 1124 bp, Homo sapiens
gtgggtatcgcgccattgcactccagcctccgcgacagagcgagaatctgtctcagaataaataaataaataaataaataaataattagttcgaatcaaaagttaaaaacacttcaagtatatgtaaaaaatcgaagaaaacgttaaaaacacttcaagtatatacaattcaaataagatcatccttccaaatatactctgtaagtgaggcgaaggtcgctgcacgcttgagtgcacgtctttccgcataggtaggacgctcaagtcttaccgggaggctctcctagagagcagcgcgaagccatggcttttgggcccggggacggaccgtagcgcgtagccggaagcggaggcgtggaggcgggtctgaggtttggtgactgcggggcaggccgggggcagctgtctgtctggctctttttgacagcccccagtgcgaaaggctgccagcatgtcatcagtgagccccatccagatccccagtcgcctcccgctgctgctcacccacgagggcgtcctgctgcccggctccaccatgcgcaccagcgtggactcggcccgcaacctgcagctggtgcggagccgccttctgaagggcacgtcgctgcaaagcaccatcctgggcgtcatccccaacacgcctgaccccgccagcgacgcgcaggacctgccgccgctgcacaggtaggcctggctgcccccgcggcggcggcgggcggcgcggcctcctccggggacctgggcccaggccacggcctgccttgagcgcgaggctcagttcggggcggccttcgcggctcggttccgcctctctggtgctatcacttgcaaaatggggatgtcagatacctgccccatgaccatgaatgagatcgttcatgaagtagtgcctgacacctggtgaaactacgcagttccctaccgttctggataatttaatttgaatcctcttccccctctccgcaattcctcgccctcggtcttcagcctcctaggccagtgcttttaactttccaggccctttctttctccccggtgatctctgccttcacttgccttcgcttttcacctttctccccactgccctttactcctatccgcctccccttttctgtcacccatca

SEQ ID NO: 2107 - DNA, 1150 bp, Homo sapiens
agttattattctagccagtaatggacttcagaatcttttattacacaatataagaatatgtatgtaaagacattttggaatttcctggatgagaaggaagtctgggctgggcatggtggctcacgcctgtaaccctagcactttaggaaatcgaggcgagtggatcacttaagctcaggagttcaaggccagcctgggcaacatggcaaaaccccatttctacaaaaaatacaaaaattagctgggcatggtggcacccgcctgtagtccagctacttgaggctgagatgggaggatgagggaggtcggggctgcagtgagccaagatcacgccactgcactccagcaccctgggcgacagagtgagaccctgtctcaaaaaaaaaaaaaaaaaaaaagattgggccaaaatactgtgataaaatagcaggcctgctgataaaagtttatctgaatgcattgagaggaaaagtccagacctaggactagttatggcagttggagagaaagaacatcgggatgtttgaaaatatgccattgactatcttaactactgtaattttatcatttccaacgtcatctaactggggactagaacaaactgtgaattcactttcagcaaccagagggcgctaatccacacccacatcgctctgccctgttccacccagcaggggcaacaaggatataacttggggttctcggtattcttcctttagtcctgacacaggcagccttgcactttgtagcagcaggagggcacttgctttaagcatatctttcgaaaggcatccattgagagaataatgcattctccccttgctgtgtatgacatggaacagtatgaccattgcactagctttgtttttggtttgttttgttttttttttaattccaggggtgggaggttggttggttgaagtctaagctcttcctttttcacctgggttttttttttttggggggggtggggggttaggggtggggcgggtggggaagagccaaaattttaaccatttttaagcatataatttgggggtatcagttactggatctaagcatgtccactctacacgctttttttttttttttttttttttttttttgagatggagtcttgctctgttacccaggctgcactgcagtggca

SEQ ID NO: 2108 - DNA, 1184 bp, Homo sapiens
aagaccctgtgctgagcttatttaattcaagtctaggctctgccacttgctagcagtgggaccttggacaagccatttaacattcctggcacctcagttttctcttgtataaaatggggataatagcacctgtcctacaggcctgggaggggttcaagaagctcacccctgtaggtgtctggctgttgatgatggggacgaggaagacagcattcatttgtctgtggcaggccatcttttaagcactttatcaatatcccatttgatcctcccagccacccagctagggacatattataatcttcattttttgagtgaggaaatggagcccagagaggttaagtgacttacccagggttgcacagccactaagtaccggagctcagcttatctaacttgagcctcctctagtatgtgctaagaacactcccagtagcccactgtttggctgactgtacctatgccacagtgatccctgcctgcgagtgttgtgggggcagctgccacaggaggctgggctggtgtcctgagcttggccctgacagccgtgtctgtgtctagtcttcgtccaggccaacaagttgcagcagcacatctttgccgtgcacgggcaggaggacaagatctacgactgctcacagtgccctcagaagttcttcttccagaccgagctgcaggtgggtgcccacatccgctgcaccacgccgcctgatggtcctcggttcccccgtcagcaccgacggtctcagggttaaggcaagctggtggagtcttatgctggcaggtctgcaatcaggggctgacctcctggctagcaggcatggagtttcagccccctggcctctgccagcccagcgttctcaaaagaaccaactgccactggctgagcccagagcaggagtcagaagcttacatttgaggtgtttcgtggcaagtcctgtctgctcttggggattccaatttccctacctctattgtaaaatgatatttcactgagctttggttctgtggctagaagcccatgatgtctttgtggctgggtcctggggctgtgtgggaacaggagttaggtctggggccttggagcctccagttttgtccataaaagccagaaaagaagagtagtggtgcccgattgccccagcttagaggcagtcaccagaggtcctgagactgatgtggcc

SEQ ID NO: 2109 - DNA, 1147 bp, Homo sapiens
gggctgtgcatttcacttctgaacttgcagtcagaacctgcatcctctctgctcttctggtctattctacgctcccaaccactcatctgttctctatggtgaactggaagtggccttctgaatgtgtctccctgtctggagccttcagtcgctcccattgtccttaggtagagaccctcagtgtaggccacaagtctctgtagagtggtcagacacccccatcctcccctcccctccatctgacacttgcccctcactctgcattccagccacaggcctttgtgcatgctgttcctcttctgggacttgcgctccacgtgtcagacctgccaagacacaggcctgatgccctcggagcagctgcccctttgtctaccctcctgggcatccatctctcaggctgcagttaggtggtgactcgtgtgtacagttggtgaatatcttcctccctggctggactgggagctcctggtgggcaggcaccacccagacctgaggctttatgcacagtaaacatttgatgcttgttttttgaatgaatgaataaatggattaaaaaaaaagatacaaggtaggtgcttagtagatatttattgaatgaataaatggacggcacactatagatgcctagcaaattcttgttggataaaccaaaaaacccaagcaaatcaagaaggctcagcaccttgttggaaaagcctggccaatgactcttccagttaggccttctccagaccagggatactatctgtctgtccatccagccctcctgctcttttcctgttagctcaggaggccatgcatggccatgcctttgaccctcctgcctgctctaccccagcacacgggcaggacctggaggagggtggcaatggggccctagagacctctgctgacacacttgtgctgggggtggccttctggtgagtgatgggatggaggctgccctggcctctggcccctggtatcacgactctctttgcacttctgtaatcttttaaactccagagccgtctggtccagctatgatctggaaacatcttccagaacatctgttttcctcctcaatcaatacactccccaaagagggccaagttgccaaatattatatataacatcaaacatgctatctgaattcaattaagtg

SEQ ID NO: 2110 - DNA, 1162 bp, Homo sapiens
cagatcagctgtgtgttcttgacaatgtgaaaatgaatttgcgaagatttattgcttatcaagaaactgttgagaaaagactgacttcttaaacaatccaaaaaagaaaccagttcttcccccaaagtattcaatgcttagaatactaaaaggttttctttgaatgtatatgtttctgaaagtcattttttaatgattacattctgtacattctgtaaaaacttcaaaacctggccaggcatggtggctcacgcctataatcccagcaccttgggagaccgaggcgggtggatcacttgaggtcaggagtttgaggccagcctggccaacatggtgaaaccgcatgcataagcatggtggcacatgcctgtgatcccagctactcgggaggctgagggaggagagtcggttgaacctgggagacagaggttgcagtgagctgagatcacgctactgcactccagcctgggtgacagagggagaccctgtctccaaaaaaaaaaaaaaaaaaaaacttcaaaacctgtcagaaactctgttgctggtttttttgtgtgtgtgttttgtttgtttgttttgttttgttgtttttttcttttttgagatggagtctcactgctgcccaggctgtattacagtgctgcgatcttggcttactgcaacctctgccattccaggttcaagcgattctcatgcctcagcctcctgagtagctggaattacaggcacccaccaccacaccttgtttttgtttttggttttttggtttgtttttttttttcagtagagacgggtttcaccgtgttggccaggctggtctcaaattcctgacctcaagtgatccgcctgccctggcctcccaaagtgctgggattacaggcatgagccaccgtgcctggccagaaactcttttttaagtgatgagatctgtgtggcatttctagcgctctctaaattatgtctctggcatattttaatcactggaaactcaaagagtggaagagtggaagtgcgaaggaatctcaggtagctcttaactaattcgccagcagtgaagaaacttcaaccaatcatgttttccttgaattttgcaaagaaagaaaatccaaagcattgcttggatgttcttttaaggcattttatatcagttgaaccttaaact

SEQ ID NO: 2111 - DNA, 1214 bp, Homo sapiens
gtgcttttatttcacccctggtgaaactaggggagctaatttttttaaacatgatttttggcccccttgaaccgccggcctggactacgtttcccagcagcccgtgctcaagactacgggtgcctgcaggcggtcagcgtcgtttgcggcggcgcaggcgcggtgcgggcggcggacgggcgggcgcttcgccgtttgaatggctgcgggcccgggccctcacctcacctgaggtccggccgcccaggggtgcgctatgccgtcgggaggtgaccagtcgccaccgcccccgcctccccctccggcggcggcagcctcggatgaggaggaggaggacgacggcgaggcggaagacgccgcgccgcctgccgagtcgcccacccctcagatccagcagcggttcgacgagctgtgcagccgcctcaacatggacgaggcggcgcgggccgaggcctgggacagctaccgcagcatgagcgaaagctacacgctggaggtgcgctcgcgggcggaggggcgcttccggcctagttggcgtgaaccggtgccttccgagccgcgtcgcgcgcctcgagagactctcgggcgggttgcgggctcccagccccgagaggggtggggacttcctctgcgctattccgaggctcttagccgctccgagggctaacccgctctcgccgcgctttcctgcggcttccgaatggggaacgcgtcttgccctaaagtagcacagcaaggctgagatcgcgctggggtcccgttgaggaaaatgggtgtgtgtggcccatctgaccccccgcccgccttgttagtagaatgaactagtgtcgttgtcaagaccacacggacaaggggaggggacttgcccttatttgcaccgcgattaaccgggttgtggcacctgggtctccaggcgtctccgtctgttcgcttccccctgttaaccaaattgcctttgccctggcgttgcgggcgtttgagtcaacgtgctgatgcgttttgggctgtgtttacgtctgtgtaaacaaattaatactcatttccccccaggccagatgaaatgagccctccgccgacccggatgtagacacatgcccccatttgtcactaggatcaggactgtggctacctcgagggctttttggtcaccccgggcattgcacaggactcctgttgttgttgcgatccgggtgtgttaggtcgcagccttcgga

SEQ ID NO: 2112 - DNA, 1229 bp, Homo sapiens
cagaaaagtttacagggcataaccaccctcaccttgcttttcttactgacttttaaccatcacaaagtaattactttccctcctctatccctcccttggaatgggtctttttttttttttttttttttttttttgactcactctctcgcccaggctggaatacaatgatgccatgatggctcactgcagactcgacctccccagctcaagtgatcctcccacctcagcctcctgagtagcagggtctacagcgcccaccacgatacctgactactttgtatttttttgcagagacagggtcttgccatgttgcctagcctggtctcaaactcctgggctcaagccatcctcctgccccaacctcccaaagtattgggattactggcgtgagctactgtgcccatccagaatgtgttactttttaaagtacattgtgaggcaggacagtattcacattgcctttcccagagcccctaaagcatcaactgaagatggtgtccctactgcagtcaaacagaaatgctgagtaatgactggtttaataatgatcagatagacgagaaaaggccttgactaagtcagtgatattgggatatgattattttaattattttaatattgattcttttggtgtcttttggattgtttagctgtcgctttttctcttggcttttgaggtttcaggacacggagtaaaatgatggaaatgtgtttgtttttcagggcagagaggagtgttggtaagtagagaaattacattgtgtcctcagctgccattgatgtccttccaaataggtgaagtttagtttaaaacctgccgttaatttctggcctctggcaagagtggtacaaggttacctgtttgttccagtatgtgtagggaggggctgggggttggggagagagaagggtggcaattagtcaatgacatttatgacccatttataaaatacaaatgaaataattggttacaaaatcatgacaagccttcacttgtcttttacaaacttgttctcaacacactgtgaaacttaatggacaccctttgtagaaagtgaggaacaacagccattctgaagagaccgattcaaagcgttcaacctgagactagctgtggtggcgaagattctctgagtatgtttctcattctcatctcagatacccgcattattatcgcagatccagaggcagggaatttgtagattcctcagccagggaattgccacagt

SEQ ID NO: 2113 - DNA, 1200 bp, Homo sapiens
ctctttctgaatgaggccctaggtaatcatttgcagagtgggatctcccaacccaaggcctcccgtcctgaggagcggatgacaaaaaccttatagagcgtcctccttccaacaataattctccaaaccccgccccctactccgccagtgccccattcacagcccgaaacatccgaccggtattagtaatagttcataataccaccacttgaggctcagagcctgggcaggcagctagaatttagcaacgttatttcgttttcattgtgtttatttctgttgatggtaagggaaactgattttccatttaaattatctgtgtattcagttgaaagcgccagtttgaccacagcagtgagtctcgctgcaccggatgggtttggttgtggataacctaagctgcaggccggactcggaactgcccgggacaccgcctctgggttctgagtcccgagcgtcgttgaagcatgagaggaactacatcagaccccaaaatagtctctcctaggaagtcaggatggccgagcggtctaaggcgctgcgttcaggtcgcagtctcccctggaggcgtgggttcgaatcccacttctgacaagcgctcttttccggtatttcagaagagaaatcttcgacgaccgcacaccaagagaggccctcaaacacagaggaccgtacgttttacacacaatccaaagtctaaatgaatgtctgtggggaagaaaaagtctgacaggacgtggtcgtgtgattctgaactcccaacttcggaggaggttgaggcgggaggatgtcgccaccacactccagcttaggcgacagagcgagattcttttttaaaaaagaaaatgctcgttaataagaaaatactcgttttgtaaaacaattaagattatgcgaacatatacgcacaagacatcataacctcattgatctgtaaaagaataaaaaaagattataagaacatatacacagaacacatacacacaagacatcataacctcactgatctgcggtgttgatgaggaaaagtaattgagctctgtcagaagtgggattcgaacccacgcctccaggggagactgcgacctgaacgcagcgccttagaccgctcggccatcctgactgcttgcagtgtgtggcgcataaagcctcttcacaagttctgcaatatgcgcatgcgtagtgggcagcgaagaccca

SEQ ID NO: 2114 - DNA, 1204 bp, Homo sapiens
gagtaaatgaattataacacatatacaaatgtgaagctgcagctggggcgagtattcggaaggagagcgcggtaagagtgccaggcggccttgcaatacctgggctttacctagattgggcgccagcccacggaaatgtctgcgaatcagtgcaggtatacggacttgattgcattgtgcacaagggaaatgcaaggttgcttgcagatttcaggaatcaaagctgacatgatagtacatgtatgaatgcagaatgaatacaggctggaggcacgaatgcatgtgtattgaagtaacagtcttcggtctcggccttctctagtaggccttgcgcaccctctggcgtcgcctaggtgcatcgcgctgaccttccttgtcccatctctccacgcccattggagcaagtgagtgtatctcgctccacccaacgccgggcggacaactaggagtgggtcttcgctgcccactacgcatgcgcatattgcagaacttgtgaagaggctttatgcgccacacactgcaagcagtcaggatggccgagcggtctaaggcgctgcgttcaggtcgcagtctcccctggaggcgtgggttcgaatcccacttctgacagagctcaattacttttcctcatcaacaccgcagatcagtgaggttatgatgtcttgtgtgtatgtgttctgtgtatatgttcttataatctttttttattcttttacagatcaatgaggttatgatgtcttgtgcgtatatgttcgcataatcttaattgttttacaaaacgagtattttcttattaacgagcattttcttttttaaaaaagaatctcgctctgtcgcctaagctggagtgtggtggcgacatcctcccgcctcaacctcctccgaagttgggagttcagaatcacacgaccacgtcctgtcagactttttcttccccacagacattcatttagactttggattgtgtgtaaaacgtacggtcctctgtgtttgagggcctctcttggtgtgcggtcgtcgaagatttctcttctgaaataccggaaaagagcgcttgtcagaagtgggattcgaacccacgcctccaggggagactgcgacctgaacgcagcgccttagaccgctcggccatcctgacttcctaggagagactattttggggtctgatgtagttcctctcatgcttcaacgacgctcgggactc

SEQ ID NO: 2115 - DNA, 1236 bp, Homo sapiens
cgagattctttccaaggaggacttcagtggccgtctctgggatgcctttcctaggcccctaagcttagcttctgactccgctctcccacatcccacacgtcagacaaaaacaacgactcgcaggaaatctatgtgaattgcagacacgtggtcttctccgccccactgcggctgctgcactttaggcagccagcatcccggaacagagctgcagctcattatcctggcctctgggaggagtttctttttccttacgttccaaatcaccctacctgaggtgccccctctgcagattcccaaacctaatttgcagtgcagcttctgactctggtggctttggtgggtgtcagtctttatcaagtggtcttggtgatccagggagcaacagctcttaccaagcattttctaacatgacgtcacctcttgtttgtattgcagccctgtattgagctgagatggctcgagcctaacattccatgatccaggatcgtgacagatgtgcacaggctgctgctgttgctgctgtgggtaatttggaaccacgaggcaccccagggccagaagacgaggcattctgtctgcctggatgtgtgggaactctctgccaacttgattggtggatctggggggggatccacccccaccccacgaggaaagcacagtttattttgtgggtggggcttcaggtgccagccagctgaaggatggccacccctgtggtcaccaagacagcctggaagttgcgtgagtggttttcatttttctttatcaccccatttattctgttagcggcttgttgctgggaggcctgaacccacagctttgtttcctgttcttggcacaggaggagactcctagacttgggagtaagatagaccattatgtaaatcatgactgtggcacttcttagctgggtgacactgggcaggtgacttaacctctctgaggctcagttttcttatatgtacaatgagatgacgcctgcattctatggttgctgtgaaattcaagtgacaggatgaacccatcctaaagcacttagcacagcatttccagttaggctgacagtggggtgagaaatcctgaaagatgttcacagcattctcagacatctcacaagtcaaacttccccagtcagataaaagcatcttgggcctgggatgggggaaggagtgggagcgaggaggggcgggcagagggatgcagacagggctcggattgtaactgatgggcact

SEQ ID NO: 2116 - DNA, 1201 bp, Homo sapiens
ttcctgctccccctccaatctcctttatcaccccaccccactcctcagccctccctttttttttttaagttgcctgtctggaccaggcaagaggtgcctactggagggtcttggtgaagcggtaactccattcctttcccttgggtcccccaaaggtaataaaagtacctggaggagaatagtcaggtgattgacctctgcctgtctctctgacggtgatgtaggtgcagacaccgcctgcctgccttgtcctggggttttgtaactgcagctttgacacaggcattcttcctttgaagcacacagcttgcttttccagcacctagacttttacctctcttcatgccttagacttagaccataactgggcttgaaatgctcaccccttcctgggtctggtcttggcacctaggctattcctttccaaactgaagtgagtccagtttcagaccatctcttttcctgtctccaaaaaccatttttgtttccaaacctagctcccccgaaattttaagactatttacctagattcggagatggtcttggagagttccaaaaggggtgtgtgtgtgtctgtgtgtgtgtctgtgtgtgtgtctgtgtgtgtgtctgtgtgtgtgtctgtgtgtctaatatttagactaaaccatggtaaatgtacgcacccagtatccttttcagttagcatattctttcttaaactcatctcagtacttttcatttgtttgcttcattatcttaaacaggttaaaagtgcctatgataaggacttaattatttcctaaagaaaagcaaaaaatgtggggaacagggtagtgttatactatcatctcaggtactgcctatgttcaagaacatagacctggtatggtgagaacaaaaggttcctatgccaaatccagatggctatatcatttgttggctacaagtgagcctgactgcaaggtttgcttctgctgagaaatcccatggtgagagtagaactcatgaagtgctgagtcacatttgcacctctggtgtggtggcagttcactctcccctggatgctgtcagctggccttgctttcatcctatccctgtaggcagggtaggtggctgggtaggagaagctattgagtgtatgacgcagaccaagctttcctgggccttctcaccaactagagaagcgctgatgtcgttcattgaggcacttaaacaccag

SEQ ID NO: 2117 - DNA, 1166 bp, Homo sapiens
gcacccaggaggatgaccagggtggcctgggggtgcttttccccatcacagcttagggtccatctctgaaagtgcctgggttgggaaaggccgaattaccctggagtagagcatggtgttgccattcgagtgtggtgggaaaggcctgctgtcaagcacgtagggccctctgaccccgcactggggcccggctgcctgtgtgtgattgccaaagggagaggcgggatgctggcttcacccgaccccctgggaccatgcaggagagaataacttagaagttacgttaggtctcttgggtgcaagtgacagaaaccgaactcagactgatacaaagagaggaagatggggtgtccctggccagcacagtggacacagggccatcggcctctgtctctctctccctcattcctactagtttggttctctggattggttgagctctaagtcaggcccttcctcgcaagggcagtgtggttgctggctcacagaccgtcctcctgaaaaccccattgctggggaagagcttcccctctccaaggattccagtaaaggccttcgagaccgggcccagggctcggtccacttggtttccaggccacccaacccctctgtctcctgcctcagtggcttctcattggctttgctgctttatcctcattgtcttcttctggggctcagtgctgggacatcttcttccctgtcctcattcactccctagatgacctcatctagtctctctatgatgatatctttgaagtgactcctcccaaggttctgaagtacaaattgttttctaaaaactgtattatgtattatccttccctctgttccttctcctccttcctccctttctcttcccttcatttctttctttagaaagacagggtcttactttgttgcccaggctggagtacagttgcctgatcacagctcactgcagccttgacctcctgggctcaagcgatcctcacgcctcagcccccgcccctaagtagctgagaacacaggcatatatcaccacacccagctgacttttaaatttttgtggagacagggtctcactatgttgcccaggctggtcttaaactcctgggctcaagtaatcctcccaccttggcctcccaaagtgctgggattacaggcctgagccaccgtgctaacctgaa

SEQ ID NO: 2118 - DNA, 1245 bp, Homo sapiens
cttcagcctcccgagtagctgggattatagttgtaccgccatgcccagctaatttttatatttttagtagagacggggtttaatcatattggccaggctggtcccgaactcctgaccttaggtgatccaccctcctcggcctcccagagttctgggattacaggcctgagccactgtgcccggccagtcctcttttttaaaaaacagaaaaatatagtcttgtagaaaaccattgtatgtatttgtattgctgctgggcatttgtgttgttaatcacttaaactattataaacaatgctgtcctgaatgttttcgtttgtatcttgtagtattcaagtgcaagatatctttagactctaaatctgtttgtggaatagctgttgtctaggagtctgtgcagtttaaggtcaaattctactgagctgaggcttattcaacaaaattcaagtattttaatttctaaaccatcatttatttcttaggaggaaaaacttctagaaccagcatacagctgtggtcattctttgctcaataacttgggtcattggcttaggaaccagcactatatttaaacctgtggatgggaatattccccattcttggttacgctgtagtgcaaaagaattcctggctctctgttgcacagctgacttgtgccattctgctgttgctgtatagagttaaggaacatggctctatttcgtttttattatctgatagcaagggtggttgggatacataaaagtttccacatactctgtagcaaagtttcaagaccatgttttttaaacagaagtttaaatatagccctaagtcaagaggtaccacagagtagatgggtatatacatgtgtgcatacctgcagccaaaacactctcctatgttagttctgcccccccttagaaaaacagtaaccggagaatcagttaaatggtttgggttttttagaaatttgaaaagaagtatataaacagtattatactatatctcagaaagttatcttggttggctgcagagatttgttaatgacctgggtatactgaagattgcaataggaggctaatttgattatattcctttgtatgcttgctgcctttaaggacttaagcatggctatcatcctcatttaaattaatttagcacttcaaaatagctttgtagttaggtctctgctttaaacctagctaaggttttcagagttgaaaatacttttctaggggaggatagctggcacataactttgtg

SEQ ID NO: 2119 - DNA, 1209 bp, Homo sapiens
tgcagtgaattgatatcgtgctactgcactccagtctgggtgacagagtgagactccatcttaaaaaaaaaaaaaatcagatcggttggtttacttacatgtgctagagaataggaactgatattttttaccttttcccctctattttaggagtgtttctcaggagctatcagaaactatcctcaccatggtagccaattgcagtaatgttatgaataaggccagacaaccaccacctggagttatgccaaaaggacgtcctcctagtgctagcagcttagatgccatttctcctgttcaggtaaatgagtgctacatttgatacatcttcatttgccatagatttggaatagaataagctcctatgtcattaataaattgtctgaatttattacattttagataactgcatgtctagcatccacttattttaaaggagatatgtaaataggcattgtagttaacaatagattttatcatcaaatagaacgtgactctaagaggaaatatacagacaatttatttaggtaaatgaagagggtttctttttaaaatatgaattacgtagactcttgagacataagcactgcctttgaacctgatgtgtcttgtttgtagcttcacgggccaagcaacagtgctagagcataacgacttgttataactggggctcttcagctctcaactgaactgctcttttaaaaacaaggtacatttaagttactccctgacatcaaccacccccttctctctgggagcaacatattgcgcttctattttcagatgcattgaatggcagattgggttttaaggaagaaagaggctaaaagttagtgattcagtggctacttccctataaaaggcatttgcttgtcattttctatagccatgaaggtatgaagtagtgccacacacttaagcctggaagtgcagttattagatattttaaaaatacatattttggtgaatagcataccttgtttttgttttcaaaattggagctgatcttcccccacctcaaaaatccccaaatttcgactaaatttattttgggagattcgtttctaatttctaatacttttatttatgttgaaacttacttaaatttagcttgattgttttaaagtggcttattggaatttgtgaggatttattaatataataagtgtcccatgtcactactaaatgtttagtttagggcagttcatc

SEQ ID NO: 2120 - DNA, 1209 bp, Homo sapiens; identical to SEQ ID NO: 2119

SEQ ID NO: 2121 - DNA, 1125 bp, Homo sapiens
cacacacacacacacacacacacacacacacacacacacacacacacacttttaaattgtagagatagggtctaggtatgttatcccaggctggaatgcaagtggtgtgatcatagctaactgcagtgttgaactcccgcgttcaagcagtcctcctgcctcagcatcacaagtagctgggactgcaagtgtgagccaccatgcctgggttttgagttttttatgattgaaaattatttttctctggacattatgttgagaatagaccataggaagcaagtgtagcagggagatgaagttagagggctagcatagtaatccaggtgagagatatgatgatccttatcatagcttggatattgtgagaaatggttggattctggttatattttataggcggagccaaaataatttcctgtcagattggctataggttttggctataggtattggctccaagattttggcctgagtaagtttaaggatgaaactagcatcaactgagatggggagtgctttgcagggtgtgacatcattaagtggggggaagacaaggagcttttttttgaatatgaaacatttgagatgtgaagtagagattatattatacaaatttggacactatgagagaggtttgggctgaagatagaacttttgagagagttattggtatagatggttttttctttttaaaaaaattttttttattattttattttatttttttgagacagagtctcactctgttgcccaggctggagtgaggtggcatgatctcagctcactacaacctccacctcctgggtttaagtgattctcctgcctcaacctcctgggtagctgggattacagatttacacctggctaatttatggatgggttttttttttttttttttttttttggagacagagtcttgctctgttgcccaggccagagtgcagtggtgtgatcttggctcactgcaacctccgcctctcaggtttaggcaattctcctgtctcgacctcccaagtagctgggattataggtgtgcaccaccacacccggcctacagatggttttttaagccatgagactgttagtaggccagatgcggtggctcactcttataatcccaacact

SEQ ID NO: 2122 - DNA, 1211 bp, Homo sapiens
catctcacaccagtcagaatggctattattaaaaagtcacaaaatagcagatgttggcaaggttgcagagaaaagggaatgctttaacactgtcagtgggaatgcaaattagttcagccattgtggaaagcactgtggtgatttcttaaagaacttaaaacagaattactatttgacccaacaatcccattattgggtatataccccaagggatatggatatcaattattctaccataaagacacatatgttaatcacaacactattcacaatagcaaagatacataatcaatctaaatgcccatcaacagtagactgaataaagacaatgtggtacatatacaccatggaacactatgcagccataacaaagaagagatcgtgtcctttgcagcaacatagttgaagctggaggccaatattctaagcaaactaatgcagaagcagaaagctaaatactgcatattctcacttataagtgagaactaaacaatgagaacacgtggatataaagagaggaacagctttgcccagtggcggcattgtagccaatgaggtttacctgaagtacaattattgctaattgaaaacttttcccaatacccctccatgacgacttgaaatatagtcagcactggcaatttttgaccgtctctacagagactgaaaagaaaaaaaaaaaagaggagaacagcagacaccagggcctacttgaggatggagggtaggagaagggagaggattaaaaaaactacctcttcggtgctaaacttattacctgagtgatcaaataatctacacaccaaactcctgtggcacacagtttacctatataacagacctgtacatgtacccctggacctaaaataaaagttaaaaaaaaaaaaagatgccttatcaaaccacttcccatgggtaaatagagcttaattctaataggaaactctgggcgtcagtgtaaaacttgtgcctctgaatgatctcacccaaggggcaaggtagccaagccattaatacaccaattctgatcattgattggggctgccaggacgaggtatgctgaatacaagacacttgtaaagtgaccttccagttaaacagccacgtgggctccggtggcaaaaaacacccccaggaactgaaatgctggtgctatctatcagtctgcagtagtgagtaagagtgtaggtgggggtgcaaagtcatatgct

SEQ ID NO: 2123 - DNA, 1202 bp, Homo sapiens
caaatcatgtggaatagagttaacagagtgcctacagggaaattgaccttaagtgtctacattagaaaagaagaagtgctgaaaatcaattatctaagcatccacttcaaaggggctgaaaatgagaagaaaattaaaattaaaaagtagcagaaaggtgaaaataagtataggatagaaaataatgaaattgagaataaatgtatgatagtgaaattcaacaaaactaacggctgttcaaaaaatgaataaaattgataaaaccttgcaagggaaaataagaaggcaagtcatcaatatcagaaatgaagaaggaagcattgctacaacttctatagagattcaaaaagataatggaaggatatgagggcgatcaggctgtgacgcctgtcaccccactgattgccagggttgatttggctgatctggctggctaagcgggtgtccccttcctccctcaccactccacgggcatccctcccgaagctgcacgcctcgtggaagaaaatgaccatccccgaggaggaccggtctttggtcaaggatataggagtagctgtgctcccgtgatagattcttcagacacggtctcaagcttcatttgtaggagaacgtagggtagtcgagcttccaagacctcagacacatccaaatgaggtgtgacgtgtggcagtctgcttttaaaaaggaaaaaaagaaaaaagataaaggaaatatttattccaattttaaaagttattggcaaaaatataaatacatttagcataaacacagcatgaactgaacatatttatgtcaaaaacttttaaaatgtattgtgatagaggcgagtttaaaaacgcaggctttgcaaaatggcataaataagaaaaaatagaaaaatatgtctattacttctctattgaataattgaatacataattaccaactctgacacataagttctcatgctcaaatgaactcaccgatataaatttcaacagagaaaagtaaaagagggagcatttcccacttaatgtcccaaagtcagtgtaatcttaatgctaaaacctgatgagaattttacaagataggagaattaacagcctgcttctgatatacaaatcttaggtaacatattagcaaaacaaactcactaatataccaaaacattacactcagggaatacaaggacagattataacatttaaaaatgtttttat

SEQ ID NO: 2124 - DNA, 1234 bp, Homo sapiens
cgcgcgttaccgggaggccaggcccggcgctgcaccctccgcggcccggggcctgaggccgggctcccgcgacttcccggcccaaagcagcgcagcgcccgggcggcccagccccgcagcggccacagcagcatagccgggcgagcggatccagaggcccggggttccttcttgtgcgagtcggcgcggacgactgctagtccagccgttgggcgccgcctggatcccggcgcctggcccttaaagagacccggtcgcatttcatctcagcaagaggagaaatactcgaagggagaggttcgccgctggcagccagaagccttaccactgctaggacgctggcagaacgcacccataacttggcaacactcggaggatggatggcaaataataccagcgactgaagggttaattaatgattgcagattaattgaacaccttctgtaatcagacacctggcacacactcatgatgtcacttattcctcccaacaaccctgcaaatagataactgtctctcccattctccgagcttgtcctcagagaattaggtaacttgttcaaaatggtcagaagcaacagatataactccttgctctactctttccccccttctcactactgcacttgactagtctttttaaaacataaattttttggccaggcacggtggctcacgcctgtaatcccagcactttgggaggccaaggaaggcagatcacctgaggccagaagttcgagaccagccttggccaacatggcgaaaccccatcgctactaaaaatgcaaaaattagctgggtgtggtggggggcacccgtattcccagctactcaggaggctgaggcaggaaaatcgcttgaacctgggaggcagagattgcagtgagccgagatcactgcactgcactccagcctgagcaacagagggacacttcgttccccccgccaaaaaaaaaatttttttttaatgatcagaagcggctgggcgcggtggctcgggcctgtaatcccagcactttcggaggccgaggaaggtagatcacttgaggtcatgagttcaagaccagcctgaccaacatggccaaaaactgtctctactaaaaatacaaaaattagccgggcgtggtagcgcacgcctgtaatcccagctactcaggaggctcaggcacgagaatcgcttgagtctgggaggcggaggttgcagtgagctgagatcgtggccactgcaatccag

SEQ ID NO: 2125 - DNA, 1234 bp, Homo sapiens; identical to SEQ ID NO: 2124

SEQ ID NO: 2126 - DNA, 1133 bp, Homo sapiens
ccctggcaggaaggctcacgcctgtgggcagccagggaatgtgtctgacctccaccctatgtcgggtgcttctgggacagcttcgtgactcagttgaaaacattctgactctcttcaagtttgcagttacatctgtggttcttggaagctgtcctagtgagtcagccttgggttaagcctgaggagaccaagctccaacacctttgtgcactcatgtacgtgaattcttgcttgcagtgaatgagacctgaacaaccctagtgggtgccatgtcctgcgtgtggcccaggcgtaccttttcttgtagattcacatgagaaacccgtcacctatccatgtgctctgagaggtggactgaggtctaatccctttctgtgccagattttctgtgggttggtcttagcacctaggagatgaatagagcatggagacacctgaacaatttagtgattctgcaaggcagtgatgatttaagggttcctattgtctcatctgtgttcaaaacaaaacagtcatgaagtctttgtgccactgcctgactgtcatcttctccagatcttgtttacagagtaataatgacgttaaacaggtatcagaaaggggaaaaagtttctaggccaagagctgctggtggattctcttgagcagaataacaagttgcttcctgctccagggactgccattagcttgtgaagtctctaggtgccttgttatttcctagtgaagttgcagaatccagggttttttccaggtttgtcttattttatcagcacccacgtccaggcccaacagcttggtaggctggtgaggtccacacacggccaggtctgggagataagggaggaagcagtggcctggaacaccccacctgtctgctatcagcactagacagctcaggctgtcttggaaacgtgtactttgttaactgccttcctgtcctcttgtctttgaaagctgtctcgcgttccacagtcagcttgagggcaagagtgggatgctggggacaggtctttcccgtcctgtgggtgagctcctggcatctggctcaggaacatgtgggtccagcaggtgactctgaagctggcttggctgccatctcagacaggacgcaggcctgacaccctcagctttta

SEQ ID NO: 2127 - DNA, 1099 bp, Homo sapiens
taaagctaaatcttgagtaatgttaatattcattctggttaacaaattttttttttttgagacggagtctcgctctgtcccccaggctggagtgcagtggcgcgatctcgactcactgcaagctccacctcccaggttcacgccgttctcctccctcagtcttccgagtagctgagactacaggcgcccaccaccacgcctggctaattttttgtatttttagtagagatgggatttcaccgtgttagccaggatggtctcgatctcctgaccttgtgatccacccgcttcagcctcccaaagtgctgagattacaggcatgagccaccacgcccagcctaaaaaatcttacaaaaccatgttagtcaacttagtgaaatgacttttagcttagtgattaaccactcttgtacaggattatagatgtgggtggttagagtgagtctgaacttgatccaggatatccctgcctgctacccagagttttttggtcatttgcctaatcaaaaaagtagagtacaagtaatgtcatttgagaactctggatgatgatggttttgctctgttttaagtaatattctgttgagtcttaaacactaggagaagcagaattggctgggagcagtggctcacgcctgtaatctcagcactttgggaggtcaaggcaggaggattgcttgagaccaggagttcaagaccagcctgggcaacatgtcaagaccctgtctctacaaaatatttttttaaaaaattagctgggcatggtagcacatgcctgtagtcccacctacttgggaggctgaggcaggaagattgcttaagcctaggagttcaaggctgcagtgagctatgatcaggccactatgctacaaactgggcaacagagcaaaagcctgtctctaaaaagaaaaaagaagggaaacagagttgtcatacttatgcatgaaatttggatagttttacagtatgtttgcctgttccataaattgggggattatattgtgaccaagttttttctaattcaagttaaatgctttgtttttaaaaagaaccgagctgaagctgccatggaattcttacaagaattaaatagcgatgt

SEQ ID NO: 2128 - DNA, 1225 bp, Homo sapiens
gggtgatacagcgagactccgtctcaaaaaaaaaaaaaaaaagattttatagttttaggtctgtttcacttgcagctaatttttgtgtatgggttgaggtaggggtccaactttattattattgttattattatcttttatgcatatggatgggcagttgtcccagcaccatttttaataaggactattctttgtccattgaatcatcttggattgcttatcaaaattcaattgatcataagtgtaggggttttattctgtactctcaattctattccacttatctttatatttatccttatgctggtagcacactgtcttgatctagctttgaaataagttttaaaagtgtgggatgtgagggtgatctggctgtgacatctgtcactccattgattgccagggttgatttggctgatctggctgtctaggcgggtgtccccttcttccctcaacgctccacgtgcgtccctcctgaagctgcgtgctcagtcaaagaggacgaccatccccaataaaggaggaccagtcttcagtcaagggtatacaagtatctgctcttcctagctagaacctccaaacaagttcttaagatccgttgtaggagaacgtagggtagtcaagcttccaagacttcagacacatcctaatgaggcgctgcatgtggcagtctgcctttaaaaaaaaaaagtgggaaatgtgacttcttaaacgttctccttttttcaagactgttttagctattctggatcccttgtattttcatatgaattttagcatcagtttttcaatttttgcaaaaagtcaggattttcacagagattgtgttgaatttgtaaatcaattgggagactattgccatcttaacgatattaaatcttccaatccatgagcatgagatattttttcatttatttaggtcttttaaattttcaacaatgttttgaagtttccagtgcacatgtatttcattcttttgttaaatttattcctaagtatgttatttttgatgctattgtaaatggaattgaattgttttcttaatttcactttcagattgttcattgctgaagtataaaaatacaacatttttaaatattgctctgcatctttcaaccttgttgggctcatttttttgtttgtttttcttttttgagacaggatcttgctctgttaggccagagtacagtggcacaatcatagctcactgcaacctcaaactcct

SEQ ID NO: 2129 - DNA, 1182 bp, Homo sapiens
ctgtgttgtatgcttatcccaaaatggttttatgaaaccactatggataaactcgttttacctttctttttaatttttgttggctttggaggcttcatattaccaaccactttctctgcattaacctctgatagcagaccctcctgctgttcttcctcaaaatcgtagacagacacatctacatctttgccctcctctgtataacgcagtttgctctttttggttttctttgtttttttggctggtggctgatagtctgggtctttttgccaactaggatcttcctggggtggaagttccccttgttctagtgtctccacctctccattggcccccactttaaccacctgaaacccttcaggcaaaggtagggtgtggcatatcatgggttcactttccgcaaggccctctttagacacttcattttcataagccccctgaagttcttctactgaagtggtagcaacaggtacagtcacaggaacaggtacttgaacaagctgaagttctcctatgtttatgggctgttcctccatatttacaacctgtaaagttataatctgggtatcgtccacagcagcctctgcttctggagccactgtgccctccattacttcagtcttcatctgaagaagggtggggtccagctgttccatcatcaccatctgtacactgctgttgacatcctggaccacctcacccccatccgtctggttctggggtaagtggcaggcatcttcttcctggcccccttcccggcgtctctggtaagtctttctctcctttcctttaataaaagtttcggactcctccacaatggcttcgactgcatcaccttccatttcccctgcctttattaagggagaacacagattgttatttaaagcaaagcatgtctaaataaaaatatacattttaaaacaaaaagaccctttggtgaatgaattaggcatcaatggttgttaatattaaaaaagacacaacagacatgtgcctcttgatgaaagaaacaaccactactggccaggtgcagtggctcacgcctgtaatcccagcactttgggaggctgaggcgggcggatcacgaggtcaggagatcgagaacatcctggctaacacggtgaaaccccgtctctactaaaaatacaaaaaaaattagccaggcatggtggcgggcgcctg

SEQ ID NO: 2130 - DNA, 1772 bp, Homo sapiens
gtgatgcagtcgaagccattgtggaggagtccgaaacttttattaaaggaaaggagagaaagacttaccagagacgccgggaagggggccaggaagaagatgcctgccacttaccccagaaccagacggatgggggtgaggtggtccaggatgtcaacagcagtgtacagatggtgatgatggaacagctggaccccacccttcttcagatgaagactgaagtaatggagggcacagtggctccagaagcagaggctgctgtggacgatacccagattataactttacaggttgtaaatatggaggaacagcccataaacataggagaacttcagcttgttcaagtacctgttcctgtgactgtacctgttgctaccacttcagtagaagaacttcagggggcttatgaaaatgaagtgtctaaagagggccttgcggaaagtgaacccatgatatgccacaccctacctttgcctgaagggtttcaggtggttaaagtgggggccaatggagaggtggagacactagaacaaggggaacttccaccccaggaagatcctagttggcaaaaagacccagactatcagccaccagccaaaaaaacaaagaaaaccaaaaagagcaaactgcgttatacagaggagggcaaagatgtagatgtgtctgtctacgattttgaggaagaacagcaggagggtctgctatcagaggttaatgcagagaaagtggttggtaatatgaagcctccaaagccaacaaaaattaaaaagaaaggtaaaacgagtttatccatagtggtttcataaaaccattttgggataagcatacaacacagtgcatatgcaagttgttttatattaaccgtatttgtaaaaggtcgttatgtgggtaccgttctttaaaaccagtctaaaataagttttttccagattgaatgctctttttttaatcccaaagaagaaggaaatgtattagtgacatgagataattatgacttatattgggttttgttattaaaagctaatcaaatatatttgtagaaatttaagattaggattaatcttaacactttgaaactctgcagcaagtaagtgttttattttgcacataggtgtaaagaagacattccagtgtgagctttgcagttacacgtgtccacggcgttcaaatttggatcgtcacatgaaaagccacactgatgagagaccacacaagtgccatctctgtggcagggcattcagaacagtcaccctcctgaggaatcaccttaacacacacacaggtgctggataagaatgttgggggctacaacagcaaatgctcagacttcgctttttagtattcattcaagctgactccagcgggaatttaaaggaagtttttattatttcttatgatgccctttttgtaatcatgattttattgtaagcacttggacttagttattatagacaaatgtaaagaaaatttaatgaaaaataacaccctctctcttaaaaaaaagaagtctcaggcaatagatgcctggtactatgaggaagaatgttagaaatagaagtgaaatcccagtgaaaccctgtctctactaaaaatacaaaaaattagctgggtgtggtggtgggcgcctgtagtcccagctactcgggaggctgaggcaggagaatggcgtgaacccgggaggtggagcttgcagttagccgagatcccaccactgcactccagcctgggcgacagtgcgagtctccgtctaaaaaaaaagaaaagaaaagaaa

SEQ ID NO: 2131 - DNA, 1202 bp, Homo sapiens
atcacctgaggtcaggaattcaagaccagcctgaccaatatggtgaaaccccatctctactaaaaatacaaaaatcagccaggtgtggtggcgtatgcctgtagtcacagctactcaggaggctgagacaggagaattaaacccaggttgcagaggttgcagtgagctgagatcgtgccgctgcattccagcctgggcgacagagtgagactctgtctcaaaaaaaaaaaaagaaggaaaaaaaaattacctgggcatggtggtgcgtgcctgtagtcccggccactcaggaggctgagccacgagaattgcttgaatctgggaggcagagattgcagtgagccgagatcgcgccactgcactccagcctgggcaatagagtgagactgtctcaaaaaaaaaaaaagaaagaaagtgtatatatatatatatatatatttataaaacaagacttcaaataatatataattgttttctttcatcttccaccacccttctccttgccccaccacctgtgcttcctgatttcatgaaaagaaaatgctgaaccagatctggacgacaatgaggatgaggaggagcctgccgtagaaattgaacctgagccagagcctcagcctgtgaccccagccccaccacccgccaagaagcggagaggacgaccccctggcagaaccaaccagcccaaacagaaccagcgtaagttgttcatctctgctctggaggctggcgtcttctccgagcatgtgggggagccagatgggtccttgttctttggggatgtgggaactaagccatgagaacaagttaagggcatgtcgagaacaaactctcaggaaatggctttttaggagtttttactgaggaacatctgaggaagtctttagaggcctgttacatttcaagaagaagtccagagtagaagggtacttgtgttctgcaagatgggtactgttaatgtgggcgggttttgaaaaacaaccaaagtcacagtcagctggcagaatggatgcggtaatgaatataaaagagccaaatcgtaaaggttggagagggaaagcagtttctgcactgagattgccccttctaagaaactcagggtcaggcggtggctcatgcctgtgatcccagcactttggggggccaaggcgggaggatcacctgaggtcagtagttccataccagcctggtcaacatggtga

SEQ ID NO: 2132 - DNA, 1682 bp, Homo sapiens
gttattatttactttctcatctagtaatttatacatctgagttttctaatttcttgttttgttgggtttttttttttttgccttcctccccgtagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcggtgagttgatggaaatggctgctggtcatttttcatgtttatgggtcattggtggcatataactacattatcagtatataatggttatataatggtttgaccatttctcctcttcctatttttaaaaaaaattttaccaaataacttaatgtttattttcatttgcatcttaaaagtatttttagataggttaaatataattttaaaatatatagctaatgaattgttgataataataaattacatttaaaaatccttgctaggtttggaggcttatgctttgtattcccaacacttgggaggctgaggcaggaggattgcttgagcccaggagtttgagactagcctgggcaacatagcaagatcctgtctctacaaaaaaaaaaaaaaaaaaattaaccaggcatagtgatgtctgcctgtagtcctagctgcttgggaggctgaggtgg

SEQ ID NO: 2133 - DNA, 1215 bp, Homo sapiens
aggttaggagttggctctggaaatgagtgttccgtggagaaatggaggttgttcacaggaaagcctttcccttgaagaggggcaaaggttgcttcttctcaaggggcaggtggaatttaggttttaactttctttgcaagatccaccccaacattcagatttcaagtcaagccgggtatcccagtaggaaataactagggcttcctcccaagaattggggtttgtaagtcctgagggcatgagtcataggttaccagcctcctcttgcctgcaggctctagaacagcactggacatagagaagatgctcagtaatagctctgcctcaccctgtctttcccaggcacttcacagcctcttgagctgccagcagtaggctctgttaacagggactgtttcacattggctctgatgaggggtgatgcccagagtggggttccccagatgccgggacgtggactcctctcagattatttgatgatcgaggggcagttgccccagaaacaaataatttccttagataactgtcttagaagtgattactcttgggaacagaaggaggatactggtaacggaagagacttcttttctctctgcagatgcttgagagaactctggattctgagatgtgtaatcaactaccccattgaaagttttagcattaaaagtctcgcatcccaggaaacccctgagacccaggcaaagcaagaccattgggctaccctatgaggggttgcctgggtggttccagtgtagggacccagttgcccacgttgaggccgaaggagcaggggactagataatagggttggctgctattggctgggaggggttggtggcaacaactcaggggcgatcacgacagtggccaaaggcaagccatttctggggctctgattttgaaaagccctgacatctgccaacaagccctgtcaggactaatctctcggccccaagcagagagaatcctttctggaagccagaaaggggcctcaggggtggtggctagagaggctgaccatgctgacctgagcaacacctcagggtcacaggcagcggaggctgcttcgtggctggagaaatggcagatgtgtctgacactcaggtgaggcccccagaatgtcccagacactgctggggcgttcgcttgcatggggtgctaaacacagcctggtcctgatgggagttggtgtctctggaattgggcacagaggtt

SEQ ID NO: 2134 - DNA, 1154 bp, Homo sapiens
tgagggacgttttccagttagaagaggagctgctgtctacatttgccatctgctgttgcctcttgtcaatgggaacagccaggaccgggggcaggggtagggaggttgaggatgatgcagttcagctgttcccactcaccagggctgtaacttcctttgcagggctggaccccaatggagaacaggtggtgtggcaggcgagcgggtgggcagcccgcatcatccagcacgagatggaccacctgcagggctgcctgtttattgacaaaatggacagcaggacgttcacaaacgtctattggatgaaggtgaatgactaaagctttgctactggggctgaggattccggataccaagacgcaaacactttcactttgagctgggcaaatcttacttggcatcaacttggatggctcgcatatgacaggaaactggattgccaaggcatggcagactgagctggaggaagatgtcagaaatgtttgccctgaaatcagttacggacaaaatgttggctacaacttgaggagaaaaatcacccccaaaggagtggacatttcctaacaattctgtatggaggaaggtggggtaattgcattcgtctgcagtagacacgagttcctcggacctgtataatctcccaaagccaaggtttggtaataatgtagtccccaaatacctgaaagctgtctttaaaaatgcaggtaagcatgtgactggccatttgtgccgagttcttatttttacggagggcttgtggccttagacgccagtttgcttatggaaatgaaagagaatagtccctgttcaaggatgtgtttcatgacagcacgagtgtaaatgagtgcccacacattttaacagccttgggcaggattttgctgctgagatccctagagcagctggttcttggctcattcttggggtagaggccgtggatcagggctgggggcaggggtgacaattgagaagtgcactgagccctttcctgttaacaattgggcatagaaagcaggattagtacttcctggttatacacttattttgtaaaaatagaattaatatcacagcaaccaatgtgtaggtttaagaaagtggccaggtgcagtggttcacgcctgtaatcccagcactttgggagggcggggcgggtg

SEQ ID NO: 2135 - DNA, 1154 bp, Homo sapiens; identical to SEQ ID NO: 2134

SEQ ID NO: 2136 - DNA, 1240 bp, Homo sapiens
ttggctaataggagcaattcagctatttttctatacagtaattggtgtgtggtatagaagaaaaacgggttcaaaccccacttctgccacctaccagctatatggccttgaatgagtcattcagctttaataaggttcattttcttctgtttaaaaagacacaaaacttgaaaatcagctttggccatctacctgagaattagaaagtctgatttttggaattagaaatcatgattgtaggctgggcacagtggctcgcgcctgtaatcccagcactttgggaggccaaggcggacggatcacttgaggttaggagtttgagaccagcctggccaacatggtgaaaccccatctctactaaaaaaaaaaaaaaaattaggtgtggtgacacatggctgtggtcctagttacttgggaggctgaggcaggagaatggcttgaactggggaagcagagcttgcagtgagccaagatggtgccattgcactccagcctgggcgtgacagagtgagactccatctgattgtaaagcatctagtacagtgtacagtgccttggaaatgataggtatggaataaatggtaattatttttatattatatatattatgtattcctgttattaagtgtagagttttatgagtataatttgattttattaccttcttttttacaagctgttttctcagtatttttcttggatgggatgacgctaggctggaaagtttttttcatcactatgattttataaaacaattttttctatgaacctttacttacttgactggattggactaaaagcactgatcagaggccacgacataaaaattcagtccctttgtccttccccgtgcctcccaaagttactttaagatccttagaatatttctttaaatattttatagacaaaaaatttaaagactatctgtattgcaaaattaaactatttctttaatgaatatattgcttattttaagttccaaaggtgaagtctttaagaataaaacattaccaactcctgcttttatatgtaagcaaacttgattgtggcctttttcaactcatcttccttctaaggttttctgttagcctctaagtagactcagtgaaggctaagggactgctatatgatgaacagtattttgatgcatacatttaatacatacttcttcagaactttttcactgttatgattttattgccattttgcttttttagatgtgtgcagcagactaaaacat

SEQ ID NO: 2137 - DNA, 1099 bp, Homo sapiens
ttttctctcatgtcagtggaagagattctcaatttcttttctaaggtactttcaatttcctgacttgattctgtgacatactttttctattttccactctctcttttcattactccctttcatgtgtttgttttcctcacaccagtagtagtcaaactgctgttaactatgatttctgaaaaggtacttctgcatttgatataatttcaaaagggccatggtgcttaaaaagaaattagaaaactaaatgcttatggtagtataatcatgtaacagtgtactagaaaaactactttattggccggtcacggtggctcacgcctgtaatcccagcactttgggaggccaaagtgggcagatcacttcaggtcaggagttcgagaccaggctggccaagatggcaaaaccccggtctctaccaaaaatataaaaaattagccgggtgttgtggcgtgcctgtaatctcaactcctcgagagaggctgaggcaggagaatcccttgagtagttccccacatgcatacatacaatgatcactactcaactagatactctaaggagatcctctatagatctccagcgttctctctgagtgtgtctctcctttccagtactctgcattgagaaccccggccatctgggcttccccagactcctagctctaccacttcaacttaagaagcttaagaagactgctgggtggccaggcgcggtggctcacgcctgtaatcccagcactttgggaggccgaggcgggcggatcacgaggtcaggagatcgagtccatcctggctaacacggtgaaatcctgtctctactaaaaataagtatattgaaaattatctaccaccatgtgaaatagtagttgtcattttagtcaggctgtggtacagtgcaatggcacaatttctgctcactgcaagctctgcctcctgggttcacgccattctcctgcctcagcctcccaagtagctgggactacaggtgcctgccaccacgcccggctaattttttgttatgtaaatataattgttttttcctctaggttgaagaatttaggtaatctggccaggtgtggtggctcacgcctgtaattcca

SEQ ID NO: 2138 - DNA, 1159 bp, Homo sapiens
aatttgaaaataggaactccactaggaatgccggatagaagagtgcttcacatttgtagagggagacaagaactaaatatcacgacgtctttctgagccttttggtttgctaacgtgccccaaattcttattccaaacggtataagataattatgtgtaaatgaataccagctctacttagttttatttcatatttgtgtatctgaatatattaaaatatcttttttttttttttgatgcggagtcttgctctgttgtccagcctggagtgcagtggcatgatctcggctcactgcaacctctgcctcccaggttcaagcgattctcctgcctcagcctcctaagtagctggtattacaggagtgtgccattagcctggctaatttttgtatttttagtagagatggattttcattgtgttggccatgctggtcttgaactcctgacctcaagtgatcctcctgccttggcctcccaaagtactgtgattactatcatgagccaccacacctggcctaaaagatcattgatttagttttgagtaagattttaagtgattaaattatggtattgttgtgtctggaatatctgatattagggttttttttttttttttttacagtttttgatatgctttattttgggtatgtagtttacaaaatataaaggaaatataaggagtgttctcttttttttttaaataaaaagtgtatttttaactgggcatggtggctcactcctgtaaccccagcactgtgggaggctgaggctggtgaatcgcctgagtccaggagtttgagaccagcctgggcaacaaggtgaaaccctgtttctatcaaaaaaaaaaaaaaaaaaaaaaaaggaaaaaaaataagtcaggcatggtggtatgcacctgtagtcccagctacttgaaggctgaggcaggaggatcgcttgtgcctgggaggttgaagctacagtgagctatggtcaagctactgcactccattataggcaaccctatctcaaaaaagcaaagcaaaacaaaacatttttccccttgattatagaggtttgagaaaaatttgagggaagattcagaaaattacctgtaactgaacagaatgccaccagcttgggcttattctgcatgcataattatgaacattttcccagc

SEQ ID NO: 2139 - DNA, 1368 bp, Homo sapiens
gcaaaaagcgcgaggtttgcgcacgaagggaaaggcgaggcccgaggagagacctggcgccgcgcagaatgatgatgtcgcacgctgggtgggaactgacgtcacctgtgctcaccgccgcttccggtccgcgtgaggtgcattctcgcgccggtggcgaggttagggcccgcgttgcgacgtggtgcagcgcatattttcacaagtgggtctcccttgtccgggactatggccaccgactcgtgggccctggcggtggacgagcaggaagcggctgtcaagtcggtcagtagctcagctcctggcgaggaggacgtagcaggggcccaagcgaaacctcccaaaagcacagggagctccccgggttggggaggcccctgggcaacgcgctcctgcagtttgctagggcagtcacttgcccttgatttgctcttagagctaaagagaccaatgtcgagctttttatctccatctgggctggttaaggacttcatcctttggtaaatccgccccactatgcatgctgtcattcctctattgacctcctcggtgacgattataaggaaagccaagtttagattctgattctctttttcattacgcgactgttcttcgcatgtttctgtactactctgtatttaacatttcttagatccatgcttaacgtggttggtagtttgtagctctttgcagaataacagattgacttttggatttaatacctcaatctactgcagatgttggaaggaggcactacaaattgtttcattgatgtgtaaagtaacggtttcatgtacttgttctttcagtaatgaatattcattcaactggaatgtaattacagcatacactgtggctttctgttcttatatctaagacctaaactttaggtttgtttagtgataatggactgtctttttttttgttgtagttgtttctcttttgaggcagagttttgctcttgttgcccaggctggagtgcaatggcgccatctcggctcaccgcaacctccgcctcccgggttcaagcgattctcctgcctcagtctcccgagtagctgggattacaggcatgcgccaccacgcccggctaattttgtattttttgtagagacggggtttctccatgttggtcaggctggtctcgaactcccgacctcaagtgatccgcccacctcggcctcccaaagtgctgggattacagccgtgagtcaccgcgcccagccggtatggggatttttgagagggctattgacagaattagacaaggctggcaaggatttattgaactacagagaacagaatatgttagaagtgatggctaatagaaatatcagtgtagaagttattctgatagccccgagatag

SEQ ID NO: 2140 - DNA, 1159 bp, Homo sapiens
tctgaattaaaaggaacaaaaaactgtctagtccttcattgttctgaaatgggcatgatggaagaaggcgggtctggtaggatagctgtgactgataatggctgagaacgttgggggatatgggaggggcgagatgactcccagataccctcccccacctatacaggaggcacctcattcctggactctgcgctccaagacactgaaatctgagcgggtacaagcattttggttaaaaatcagctcgttgtcgcctcttgagtttcctccaggagaggagttcattggagaggattcctggtagcagctcctcgcagtggctgtcctgtaaccactttggcctctgtcaacatgatgtctccaggtatccatcaggctccgatacatttgggtggccacaggctgggctgtccccacctctcagggaagtgcatctaagtcaggttttcccctctggcacagccctgcctccacagcccaatttccaccatgccacaggcaacccgcatttttatttatttaatttatttatttattgagacagagtcttgttctgttacccaggctggagtgcaatggcccgatgtcggctcatcccaacctccacctcctgggttcaagcgattcttctgcctcaggagagtagggagtagctgggattacaggcatgcaccaccactcccggataattttatatttttagtagagacgggttttctccatgttggtcaggctagtcttgaactccagacctcaggtgatctgcccgcctcggcctcccaaagtgctgggattacaggcgtgagccagtgtgcctggccgattttttttttttgagactgattctcactctcgcccaggctggagtgcagtggtgggatctcggctcattgcaagctccgcctcccgggttcacgccattctcctgcctcagtctcccgagtagctgagactacaggtgaccgccacgatgcccggcagtttttttgtatttttagtagagacggggtttcactgttagccaggatggtctccatctcctgacctcgtgatctccccgcctcagcctcccaaagtgctgggattacaggcgtgagccaccgcgcctggcttttttttttttttttttttgagatggagtcttgctctgtcacccagg

SEQ ID NO: 2141 - DNA, 1186 bp, Homo sapiens
tcattacttgtaacatattaccatacctttcatttacaagggctttttcattctttcaacacatttttattgagcctttgcagtcagtatgtgctaagtcagtctgctggatcttgggacttcagtggtgaaaaattagacgtggtgccgcctttgtgcaagattgagtctggtggtgaatacagataaataaccaaaacaattaccagaaactgtgccaaatgccatgacagcacagagaagaggttccctaaacagggaaaggaaacgaatgtgttacagaaagcttgctggagtctctaagctgagatctgagggctagttagaagttagctaggtgcagttggagtgggagaggaagtttcagttgtaggcaaagggaacagcatttacaaaagcctaaatacaagaaataacatggtccattcaaataattaaaagctcattatgatttaattattaagggactggggtaggagtaggggtggggtgaaagctactgaaggattctaagtagggaaataatctgataggttgacaaccttagaaagattaattgcttacattttggctaatgaaatggaggatattaagactgtaagaggggagactgatgaggacattaagagatactggtagctgctaaggaggtagaatcaatagggctttgggaggagagagaattgaaggattatactcaggtgtctggtttggtctgttgatggtagtattctctaaggtggagaatctaggaggtggagcagggttgggaaggaacttgagtttgtttatgaacatgctgttactttattttatttttattttatttatttacgttcttgagacagaatctcgcactgttgcccaggctagagcacagtggcacgatcttggctcactacaacctccacctcctgggtttaagcagttctcctgcctcagcctcccgagtagctgggattacaggcgcccaccaccatgcctggctaatttttgtagttttagtagagacgggatttcaccgtgttggccaggctggtctcgaactcctgacctcaggtgatctgcctttggtctcccaaagtgctgggattacaggcatgagccaccatgcccagcctgaacacactgtattttaaaaataccggtggaaggtccatgtccagtaggtgatttgatgtattat

SEQ ID NO: 2142 - DNA, 1147 bp, Homo sapiens
tttctactaatatgtaaccagcaatgtctggatttccctttctgatcttctgtcttccctagtctgtacacctctccctttaatagtcatgtcgggaaatcctggctgggatggctgactttgctgctttatgtattgagaaccccctggagtgttcttgctacctatcctcttctcagccagcccctacctctgagcacgccaactcagttactcgtttttttgggtttaggaaatggtggaagcagcaggggaggatgagcgggagctggccgcagagatggcagcagcattcctcaatgaaaacctccctgaatccatctttggagctcccaaggctggcaatgggcagtgggcctctgtgatccgagtgatgaatcccattcaagggaacacactggaccttgtccagctggaacagaatgaggcagcttttaggtaagcagcccaggacagtccagggtttggcaggctggaacaggagctctctgagttttgactaaggccttactcttgcttcttattctgtgtgtagtgtggctgtgtgcaggttttccaacactggtgaagactggtatgtgctggtgggtgtggccaaggacctgatactaaacccccgatctgtggcagggggcttcgtctatacttacaagcttgtgaacaatggggaaaaactggagtttttgcacaaggtaggaatctgccagtggttctcctagattttaagtcccattgaattctctcacttttgcttatgttatggatcaggtcttttggggaccagctccttgattccaatctctctcttaccagcacatggaaaatgctggggccttctagctgcagtgatgttcttgtgcctgtgcattccacaggaaggctttgtgctaaccatccataatggggagatagatgcacattcaattggtctctttcttactgttttaataagcaggcaacaatttgtgaccaaaattcagcagtttaaataattaatattctggctgggcgcagtggctcatgcctgtaatcccagcactttgggaggccgaggcaggcagatcacctgaggtcaggagttcgagaccagcccggccaacatggtgaaagcctgtctctactaaaaatacaaaaatcagccaggcat

SEQ ID NO: 2143 - DNA, 1135 bp, Homo sapiens
cttgatggcacatgcctgtagtcccagctactcgggagtctgaggtgggaggatcacctgagcccaggaagtccaggctatagtgagccatgattgcgcctgccacagcccttcagcctgagcagtagtgagaccctgtctcaaaaaaaaaaaaaaaagtcacttttcactagcatttctttcctgtccctccacaaattacagtcacttggctactaaggcttcactgttgaaataacaccagttaaacagagcacaagctctggacagcagtcgtctggtaccagaacttcttgtcagttacagcattgatccctctactgagtgaatgcagcatgcggaacttgttcaccccaacacccagattcattagcaaaataagctcactggtgtgtttcttaatgataggctcctgtggaagtaggcatttctgggcagagaggtgaggcctgtgtctggctggcatttataatagctgtattacctgcttttcctctatagactcctgtggaagaggtccctgctgctattgccccattccaggggagggtgttgattggtgtggggaagctgttgcgtgtctatgacctgggaaagaagaagttactccgaaaatgtgagaataaggtaagtgtgctggcattggtgctgagatctagctcatgtgtcaagggtgggggcattggtggggtggtgggcattgagttttaaaatcttatctttattaggacttgttgtgttaccccaattccagcttcagaattatgcccttgtttttttgttttttggtttttgagacggagtctcgccctgttgcccaggctggagtgcagtggcgcaatctcggctcactgcaacctccgcctcctgggttcaagcgattctcctgcctcagcctcccaagtagctgggattacagatgcgcgccaccacgcctggcaaattttttgtatctttagtagagacagggttttaccatgttggccaggctagtctcttaactcctgatctcatgatctacccgccttagcctcccaaagtcctgggtttacaggcgtgagccaccgcaccggcccttgagttttgagaggagcaggagtagagggatctcatttcttgacttaccaaacaagaa

SEQ ID NO: 2144 - DNA, 1099 bp, Homo sapiens
gagcagggtcagccatggagcgggggcgcatgtgtgggttcctggggccggagtgctgtcagctcccgagagactccgagagaggcctagaagccacaccgggccttgctggcccagcctttgccttggcccttcaacgccccatagtgttagggtcaacctggcaggcacccaggaggggaaggtgcagccggaagcagggaggaggcaggaagggctgcttccctgtgacctccagtctccctgtgggaaccagcctgccttcctgggagtcctcctggccagggagccagcccagcctctcccgggtctccgagtgctgatctcctcgtcttgggaggggagcagaggctcagagcagtcagactcctcaaaccagggtagaacaagtttgcagagggaagctgggaaaatgaggctttcctcagaatctcccacggtcagtcagggaagtcttgagccaaggggttgaggcctctgggtagaagattctgagggtcagtggatgctttgcaggcctagagtaggatctggtgtgagctctgccatggatttgttgtgtgacctccagcaagcccagtgccctctctgggttcttggttacttggtcagtaaatgcacatttggactaaatgggtgtgtgagacaccccctagccttcaatgccctggacccccagccttactttgcaacgacctaggaagagataccatagataggggcacagaagcagtgggcatgccaggggacttcagaacagctgggggaggggtcagattgcagggtggggcccagaggacggctcacaccctgggaagggagctgaggacagtcccagccctgggaggggcagacagctggcagacagggtcgagttgcggggcaggccttggagctgggaacagctgggagagttttgtacactcctcgcccatccctggttctgtgtgctccaagtgccatcaaggccctggggacctcagctcccccaccccctggcttctgggccactccccagtgactgtctcctcagtaaggcaggagggaacctctaagaaaaagctggcaacaggtgcatgggtgggatggcaagagtgag

SEQ ID NO: 2145 - DNA, 1179 bp, Homo sapiens
caaagtggccaggcctgggctgtgttggggtcaccctacccacagcaatccaggatgctcacaggggttgtttgcattcttgctgtccagctgcaattggacacacacgtggttactgtaggagatgccacagagcgggacaaatgtcctcatgagaaacttattatgctctccaaaaggagctgtccattcagggaaaatcggtagcaggaggctgctcaacacaaggccaaccgcccttctagcgacgtgctgcctcttgctgccacagcaccacaccaacgcttcagcgctttggagtgcaagaagcaggcagatcgcttttagaaattagggaaaagagtatttgagagctactcacctgtttttaaagcctccccatgaagcttccacatctctgtctttctcctgcactgtaaggccctggtcctggcccagaaagtcagagtcacagcctagacacactgaggatggcatccagagtgtcctggcctgtcatcctgtccatggcagaatgagtagttagtacatagggcctgtgtgcccaccaggctaggatgtgatttgatggcgcactctccaatatggcagccagtaaccacagtggctgcttggatttaaattaattcaaattaaataaaatttaaaattccattcctcagtcacactagccacatttcaaatgctcaatagtcacccgtggctagggctacctcactggacagatagaacatcttcatcatcacagaaagttttgttgggtggtgctggtactccagtgccatcatttaaactggcatgagttctttgaagggcccccaaaatccacgtggaggaaaataaaaaatggtatatcaagtactagccagggagcacagctacctgtacatccttccctctgctcattcattcgttcaggaatgtcatcgtgtacctgaatacacaaggcacaccagggttgacatactcaggacctgccaaaatgatccagactgtgctcctgctcttaaaggactgcccatttggttcaggggataaatgtgcacaatggccaggtgtggtggctcacgcctgtaatcccagcactttgggaggccaacgcaggcagattgctcgagcccaggagttttgagaccagtctgggcaacatagtaaaaccctatctccacaaaaaactag

SEQ ID NO: 2146 - DNA, 1185 bp, Homo sapiens
cccgggaggcagaggttgccgtgagctgagattgtgccactgcactctagcctgggcaacagggcaagactccatctcgggaaaaaaaaaaagaaaaggaaatattaaagaggctatggctcctaacttttctaggtgttcttttcctaaagaaagaaaatacaaaacctgccagaaatctcagaatgtccgcaggaaagattgaaacacatcaggttgactgtgtttgtttgtttgcttgttttccagccagtagccctttgcaacacttgaaatgtcatcttctccttttggaccccagttgagggtggcggagggctggggggtgcctcagctgtggccgtgaccatgagcctggtgtctgactctctccttctctccttccctgcagtgggcggtgagatccccctagacatgcggctcgggggcgggcagctggtgtcagaggagctgatgaacctgggcgagagcttcatccagaccaacgacccgtcgctgaagctcttccagtgcgccgtctgcaacaagttcacgacggacaacctggacatgctgggcctgcacatgaacgtggagcgcagcctgtcggaggacgagtggaaggcggtgatgggggactcataccagtgcaagctctgccgctacaacacccagctcaaggccaacttccagctgcactgcaagacagacaagcacgtgcagaagtaccagctggtggcccacatcaaggagggcggcaaggccaacgagtggaggctcaagtgtgtggccatcggcaaccccgtgcacctcaagtgcaacgcctgtgactactacaccaacagcctggagaagctgcggctgcacacggtcaactccaggcacgaggccagcctgaagttgtacaaggtaaggcccagctccttatggctcaggcgctctttctgaaaggagggggttgcgcaccggggagttagggagcactggggaggagtcggacagtctctggcatggcctgcttggctgttggttgggaacctggagttgagaggagagtcggcggtgtccactttgtcaccaggtggaaacgtgacaggttcagtgagtagcttgactagctgaaggttctctttctgggtgcccaattttgggtcaggttttgttgacagcgcctctagggttggttcttttctttcttacatgggc

SEQ ID NO: 2147 - DNA, 1165 bp, Homo sapiens
ggcggccacatgaccatgatgcattctcgtaactcgtgtaagacactcaagtgccccaagtgcaactggcactataagtaccagcagaccctggaggcacacatgaaggagaagcacccggagccggggggctcctgtgtctactgcaaaagcgggcagccccacccccggctggcacgaggcgagagctacacgtgtggttacaagcctttccgctgcgaggtgtgtaactactccacaactaccaaaggcaacctcagtattcatatgcagtctgacaagcatctcaacaacatgcagaacctgcagaatggagggggggagcaggtcttcagccacactgccggggcggcggcggcggcggtggctgcggcggcggcggcagccaatatcagtagctcctgcggggccccctcgccgaccaaaccaaaaaccaaacccacctggcggtgcgaggtgtgtgattatgagaccaacgtggccaggaacctccgcattcacatgaccagtgagaagcacatgcataacatgatgttactgcaacagaacatgacccagatccaacacaaccgccacctgggcctcggcagcctgccctcacccgccgaggccgagctctaccaatactacctggcccagaacatgaacctgcccaacctgaagatggacagtgctgcctcggacgcccagttcatgatgagcggattccagctggatcccgccgggcccatggccgccatgacgcctgctctaggtgaggatgactacgtgtttgtctgttttcatgataggagtttaaccagggagaatggtgaatagggtgagatagtcctgtggattcagttgactctggtcttctcgagtggtttttgtgtaaactggagtgtcttacaatcaagtattctcaagaatcccttgaactgtgtgtgtacatatggaagagtttatgcattcaaaagagatatgcttgtactctggctacgtggggccaggattaaaatgtgagtgtttcctctagttttctgttcccattctctctttctctgtctcttctttcaatttgaaaaatcactataatcacctaaaactttggggtttcatcgaatatttactgaaacttacaggaaactgtagctgaggcaatcatttcaataagaggactagg

SEQ ID NO: 2148 - DNA, 1129 bp, Homo sapiens
atgaaagctccacgcaggccttaccatggaaggctgtgactcgcccgtcgtctcggggaaggacaatgggtgcggtatccctcagcaccagcaatggactgaactcaacagcacccacctccctgacaaacccagtagcatggagcagtccacaggcgagagccacgggcccttggacagcctgagggcccccttcaatgagcgcctcgcggagagcaccgcgtcggccgggcccccctccgagcccgccagcaaggaggtcacctgcaacgaatgttcggcctcctttgccagcctccagacctacatggagcaccactgccccagcgcgcgccccccgccacccctgagagaggagagcgccagcgacaccggtgaggagggggacgaggagagtgacgtggagaacctggccggggagatcgtctaccagccggacggctccgcgtacattgtggagagcctgagccagctgacccagggcgggggcgcctgtgggagtggcagtggcagtgggcctctcccctcgcttttcctgaactctctccctggcgcggggggcaagcaaggggacccttcgtgtgctgcacccgtgtacccgcagatcatcaacactttccacatagcctcatccttcgggaaatggtttgagggcccagaccaggctttcccgaatacctcagccctggcggggctcagccccgtcctgcacagcttccgcgtgtttgacgtgcgacacaaaagcaacaaggattacctgaacagcgacggttctgccaaaagctcctgcgtatccaaagatgttcccaacaatgtggacctgtccaaattcgatggctttgtgctctatggcaagaggaagcccatcctgatgtgtttcttgtgcaaactctcctttgggtacgtccgttcgtttgtgacccacgcggtgcatgaccatcgaatgaccctgagcgaagacgagcggaaaattcttagcaataagaacatctccgctatcatccaagggatcggcaaagacaaggaaccccttgtaagttttctggaaccaaaaaacaaaaactttcaacaccctttagtttccacagctaacctcataggccccggacacagtttttatggtaaattt

SEQ ID NO: 2149 - DNA, 1356 bp, Homo sapiens
gagaccaacctgggcaacacagcaaaaccctgtctctacaagaaatacaaaagctagctgtgcacggtggtaggcgtctgtagtcccagctactcaggaggctgaggtgggaggatcacttcagcccgggaggtagagggtacagtgagttgagattgcaccactgcactccagcttgagagacagagtgagaccctatctcaaaaaaaaaaaaaaaaaaaaaaaagacacagctcttgattacagcatctgaggcctttggtcctaatttttggtgatggagaaagagaggtttcagctggtccctagggtctggagaaggagggtagtgtgaaccccttggtagggtgaacccttcagggacacccctgcttctgtgtgtccagtggttctgtccccctttctccagatggctatactagtttcctcttgatgccgtaagaagttaccacataggccggacatggtggctcatgcctgtaatcccagcactttgggaggccgaggcaggtggatcatgaggtcaggagatcaagacatggtgaaaccccttctctactaaaaatacaaaaattagccgggcatggtggtgcctgcctgtaatcccagctactcaggaggctgaggcagagaatcgcttgaagcagggagtcggaggttgcagtgagttaagatcgcaccactgcactccagcctggtgacagagcgagactgtgtctcaaaaaaaaaaaaaaaaaaaaaaaaaaaagaagaagaaattaccacaaacttgttggtgtaaaacacaaacttaagtttgcattttgatgttttctgtaaggatgtagtatgtttaaactttattaactaatgttcaaaactgcgatgtgtgcatagaatattacgtatgcatgttcatgtctaaagaatggctgttgatgataaaataaaaatcagctttcatttttccaaaaaaaaaaaaaaatgcaaaaaaccgcaaactgattgccttgtagctggagcctagaagtctgaaatcagtttcagtaggctgaagtcagggtgttggcagggctgctttctcgtagcggtttcgaggaggaacccatttccttgcatggtctaggttctggaggcccccacatttctgggttgatggccccttcctcacatcactctgtgtcatgcttctgttacatctccttcttctgcctgactctgtcctctcctttgcccctgttgtaaggacccctgtgattgcatcaggccccctggataatccacgatcatctcctctatccaaagatccttcacttgatcgcatctgcaaagtttcctttgctgtagaaggtaacatatttgtaggttacggatatt

SEQ ID NO: 2150 - DNA, 1118 bp, Homo sapiens
caactctacctattctcacctgcagaatctatggattcttagtcccaagggtccccaaaggttagtcactcacaaaccatctgcagggttttaactatactactaccagtgttatttacttaacatttttcattacattgactcactttttaaaaatcggaataaaggcctggcccagtggctcacgcccataatcccagcactttgagaggccaaggcaggtggatcacttgaggtcaggagttggagactagcctggccaacgtggcgaaaccctgtttttactaaaaatacagaaattagcccagcatggtgccacaggcctgtaatctcagctactcaggaggcttgagggacaagaatcacttgaacccaggaggcggaggtttcaatgaactgatatcgtaccactgcactccaggctgggcgacaaagcaagactccatctcaaaaaataataataataattgaaataaagcttttaaaaaggacactttctcttactaccataaattgaaaaccagtgtcacttgccaaaaataggtaaccacaaatgaaaccaaaacaatgtaattaaattctggctggatgaggctgcctgccagaagctctgtgatccaacccacattctctttgtacaatggagatattggagatattggcagagttaaggatacccaacaccaaggctgggcgcagtagctcacgtctataatcccagcactttgggaggctgaggcggacagatcacaaggtaaagagatcaagagcatcctgcccaacacggtgaaacctcgtctctcctaaaaatacaaaaattagctgggcgtgatggcacgcacctatagtcccagctactcgtaaggctgaggcaggagaatcgcttgaacctgggaggcagaggttgcagtgagctgagattgtgccactgcactccagcctgggcgacagagcgagactccgtctcataaaaaaacaaaaaacaaaaaacaaaaacaaaaaaacaaaaaaaaaataccaaacgcagactttcttcttgatgtaatcagaaagactggagcaaactgaaaggagagtaattttccctttatataatcttgcataccaccttatcccac

SEQ ID NO: 2151 - DNA, 1156 bp, Homo sapiens
ccagccatggagcttcctctctgaggacgaggacagagcttgcccctttgcccctctttcccccttccagccaggactgagcccctctcttccccctcccccaggcagtgctgaggggctgcctctgccatagggcgcagattcaggaggaggacctggtggtcagcagcggggcagagtgcacatggcccctcctcactgcacacaggggtgccgctggtccaggaggacctgtctgggagggccctgtgctggtgcctgccccacctgccagccccaggaggctgggcaggaggggagagctgagagaggagggtgcagaagaggaaggggttgctggggtgggcggagagcctctgaacggcaccctggggctgccttgctggctcacaccggcctcgggcggctgtgagctgagcccctctctgaggcaggcacctacggcaggggcctctgctgcttgttaatttccagataatttggaaagttgtgctgcctcttccagtcctgtttctgacaggcctgaagtggaggcgtagggctggatttagtgggatgcaggccaggacttggagtgcagggaggccccacccccccccatccgtgctgtgtcccttacctggcagctctgcccacacaccttggatactgcccctgcccccgggtctctggggactggccttgggcatgccaaaggggatgaccactggagggatttggcttcaggctatagggcccgcccaccttcccacagtcagagccactactggtaatgacaaacactgccccgcagtggaggatgggaagccctttatggtaacagctccagcttgagtcctgagtgcatgctctgcggtctggggtcacctggggtgcttaccagtaggcacacgcctgggttatgaggtggaaggtgcgagctctgctggccatgggagctgcgtggggcattgcccctctctctgcctccaggtagccgtcgttccgtcctggtcccagggcagcagtgaggaatgactggtgttggggtgtgggctgtccgttctgtgtgtgacagtaggttcacctccgtgctatccacaaaggttccgtgccctcgcctgggttttgtttttgtttttttgagacgtagtttcgctctctcgcccaggctgga

SEQ ID NO: 2152 - DNA, 1090 bp, Homo sapiens
ctcatgacttttttgagtttagaacaaaacagtgcaaccgtagagccttcttcccatgaaattttgcatctgctccaaaactgctttgagttactcagaacttcaacctcccaatgcactgaaggcattccttgtcaaagataccagaatgggttacacatttaacctggcaaacattgaagaactcttaatgttttctttttaataagaatgacgccccactttggggactaaaattgtgctattgccgagaagcagtctaaaatttattttttaaaaagagaaactgccccattatttttggtttgttttatttttattttatattttttggcttttggtcattgtcaaatgtggaatgctctgggtttctagtatataatttaattctagtttttataatctgttagcccagttaaaatgtatgctacagataaaggaatgttatagataaatttgaaagagttaggtctgtttagctgtagattttttaaacgattgatgcactaaattgtttactattgtgatgttaaggggggtagagtttgcaaggggactgtttaaaaaaagtagcttatacagcatgtgcttgcaacttaaatataagttgggtatgtgtagtctttgctataccactgactgtattgaaaaccaaagtattaagaggggaaacgcccctgtttatatctgtaggggtattttacattcaaaaatgtatgtttttttttcttttcaaaattaaagtatttgggactgaattgcactaagatataacctgcaagcatataatacaaaaaaaaattgcaaaactgtttagaacgctaataaaatttatgcagttataaaaatggcattactgcacagttttaagatgatgcagatttttttacagttgtattgtggtgcagaactggattttctgtaacttaaaaaaaaatccacagttttaaaggcaataatcagtaaatgttattttcagggactgacatcctgtctttaaaaagaaatgaaaagtaaatcttaccacaataaatataaaaaaatcttgtcagttacttttcttttacatattttgctgtgcaaaattgtt

SEQ ID NO: 2153 - DNA, 1134 bp, Homo sapiens
actaatgaccctttaaccctcagaataatatacattttaaaataataagccaattctcttaattggtagaatttcatctgaacaaaatgagttgttaatttcgagaatgtggcgaaaatatttgaagtcaggcttattaatataagcaagctgtttctgctttagtgcttatttccgggattgggtctcttgaggcttcctgcttttctcctgaacctgtaggttctctaaatactactgataacttgctgaatatcttaaatcattgaattagaaagctttgtctcaagtttaataatttgcctgaggtcacacagctggttaatggttaacatacttctctgataaaggtcactagaggttcttatgaagatacttttaggtggcgtaacaaatgtgtttatgcatattcaagacactcttgtatccacaggttgcactgctgtgatccatcctcatctcctaaagatgcatcctgacttatctccacacttgcacactgaagaatgcaacgtcttgattaacttgcttaaggaatgtcacaaaaatgtaagagttcagaaaaacgactgtacagccaaaatgaaacttagttataacccactgatgtaaaatgttatctccgttgatagaaggaaacgataatgtcttagtaaggagtctgagtttagtcaagattagcagttgatatgtgcgatttttttcttttttttacacaaactacctccttttatgattagtaaaaatcagacatggtagtttgttagggaacgtctgaactggtatgtaacagttggaatccatgttcttacaataaaatgctttctctttcctaattatagggcactagaacagttatattcagcgctgacacttctgattataatggaattattctaaaagtatctgctctttgatggctaccattctgtgtttaatggtaatagaaacgtgttatataattagacattaactagatttatgattggcttaatctgatgtgtttagttgttagtggaatggaagtaaaattacatggttaaaaccaaaatagaaaaggagcccatccatatttggaatacattaaatcaagctgacatttttatagctgttgaatatttagcttttccttat

SEQ ID NO: 2154 - DNA, 1184 bp, Homo sapiens
ctgtccccaacggagactctgtcacccctgggctccccctgccatcgtgtgcttcacgtggccccatgcatgcccgcctctctgcatggtctcttgggaaaagagagatgtgtcgcctccgccagtccgactgccctccccaccccacccccgccaccccccacatgtgaccactgcaacgaagacactccttctgtccccacctgctccgaagacaaaccaacctccgtttcttttataaacagtcggctttttcttaataagccctcactgtacagaacagcccgttgatggtttatttggggtccccctctccccccagcccttttttctgttggtttagcacaaatacttccctcctccggcacctccaaacctaccccacagtcagtgtacttgttttatatatatttaatcttattcaatggaaaccatgcttttgtcgttttatactttgctaggtagactttattacccccccactatgccctcatttttttaaaaaaggaaaaaaaaaagaaactgggttccagtcttaattcattttccgtgccaggttttatttcgtgtgtgtgtgagtgtgttctgttttgtgttttgttttttgttgttgtttttagttgtttggttttcttttctttcccccctccggtcccatacttcacagcactctggtgcgggaagaagcagaagcaaaaaaaataaaaataaaaaaataaataaaaataaaaaaaataaaaaaggaaaaaaaaaaaagaagaaacaagacatgccacctttcccctcgcactgttgcttttcctgatggttaatactactgtcacgtagctgtgtacaaagagatgtgaaatactttcaggcaaaaataaactgtaagtgactcatcaatgtctggcctttgtgtggtttctcggcgcccagcgggagaaggtccaaggagggggcgaagcccaggcgggaaatctgaggctcaagacagtgccgggatgccctcgccaccttctgtgcgcacttcctgaggaccagggctcagcatcctggctgctgttggccactggggccggagctgtcttcgttgcaggggggctgttgtgttcattgccagacattgaacagcatccttggcttctacccagcagtagcaccccttccccatttatgacaaccagagtgtctccagatgt

SEQ ID NO: 2155 - DNA, 1317 bp, Homo sapiens
tgtgtttattgattcagctcaatccagaggaaaattttaaaggcttacagccttaggattataggatactatataatacttttggtacagagatagaattaaataacataaaaatcaaaaatttattaggctaaaattttgagggagaagtggtatgaaaatacaaattcaaggagtaaaaggaaaagtggggcattccttgctactaaaaattgccttgttccaggtaagactgatcataaaaaaatggccctgttcataaaatttttaaaaagatcatagtatctatcaaataacttatattaagaacctcctgggctaaatttaaaaagtaatacaacagttttatttaaacatgtagtgtctacggtatgccagcactttgcagctatttataatgagaaattttagatgtcaatatagcaatgtgcaagaagatagagattttcaaaattcacttaagagtatctgagcataaaatgttaagattgctgatcggatgtgagggcgatctggctgcgacatctgtcaccccattgatcgccagggttgattcggctgatctggctggctaggtgggtgtccccttcctacctcaccgctccatgtgcgtccctcccgaagctgcgcgctccgtcgaagaggacgaccaaccccgatagaggaggaccggtcttcggtcaagggtatacgagtagctgcgctcccctgctggaacctccaaacaagctctcaagattgctgatctagggccactaagtgatgaattgtatttggaagcaaaaaggatggctaaaaaggacctcaacccttttgactttaaaaggaaaatagcttaaccttcaacctgtgtgacatttaactttttgaacccaaccgtaaaagctatcttctaaccaacaaaaagttaataattagatttggaattatacagaattagaaaattggcatttaaaaatactcaataatttgtccctggtttttaattttcaaaatattttctttttgaagagccagattccagtgatcctgcctctcagaaatttccacatttcttatttttcattaggccttaagaagctgcatttgtaaacttgtgtttcattattaaagcttaatttattttttatataaatagtatgtgctttgtgtacatagagaattaagtgaatgagtcacacagatgttggctgttgttaatgtgaaaattaaacagctgtatcacattttgaaaaataaaagtttcatctgaatgaatatagcaatctgcccagaactttttttaaaaactgctattcaccttttatattcccaaat

SEQ ID NO: 2156 - DNA, 1175 bp, Homo sapiens
aatagctgctaccgaatctgcagataagttgtgtagagagagcaccttacaggagctgctacctccattcacgggtacggccagcccaaggtcatcctagcaagggagccaggtacctggcagcaaaggagcccttccgtgcattacgttcaagtcagcctcccaggccagagaaacaggtgaagacgggaagtaggtctggaggggtgaatggatgacatgtccttggtatacgtgttgtattgagttgttgtttttaacactctaaatagggagatcatggaatggattggttgattaagcacatgggctctgaagtcaggcagacctgggtttgatgcccagctccgccagttgtttacttgtcaccttgggtgagttacttaacctgttttgtgtcatttgtgtattgggtatgatgatagtacctgtccagtacattccgagaagtagatgaggtaatatatgtaaaacagtcaccataacaccaggcataaagcacagtgattgtcaccattgtgtgtatttccttatatctgaatatatgaagtacacccattcctttctactcacttatgtttgtgtatccttttttgctagtgttgtcttaactattctgtgaatttggagattgcatgtgtctgtgctctgaaagtctcgactttcccatttttaatgtcagccgtatcagtctgtaattcagtgaagataattagggctattcagtgttaacactgcctcacaggggacacttttagccagtggctagaccatgtaggggaatgatgatctagctgctgtgcctcaacttggaacaactgaagggcattcctgactccagagctctcatatgtggctgaggccttagtgtagccacattgcccattatcttctccctctgcccaatccttctttctctgttttcctagaagggcatctgctgaacaacactgcctgctaagttttctgcatatatgtctgtctcagagtctgtttccagggaacccgatatagtgtgaattcctaggagtgaaatttaccagatgaaagattttgctatctattgccttattgtttttttccccaaggatatggtccagaaagagtgtgcaagtataggcagtttaattcctcctttgccgtagcaagttgtttaagaagtatttttggctatt

SEQ ID NO: 2157 - DNA, 1099 bp, Homo sapiens
tcacatcccagctcttctctttaccggctctgtcttctggggcaaatggcagtgtgcctcagtttcttcagcagtaaaatgacaatgccagtcatcccagcttcgcaggattgttgtgaggattggatgagttgataagagatgaatgcctgtgcacagcctggcccagggagggcattcatcatgatactgtccttgcgattgtcctcccttcagaatggggcactgcatgtgaccaaggacctgctgtgggagccggcaacccctgggcctctccccatgctgcctcccctcatcggtaagggtctcattcccccgggctcactccacactgctccacctattcttcccactgctcccgctcctgagaccttcctctccctgctaagcctgtgcctgctcaggacccttggatacctccagtcgcccagggcatctggccgcactcctgtgccctccccagccctttccgtaacctccttctcagatccctgggaccctggcctgactgcccgggacctgcttttccgcggagggtgccggtatcggaagcggccccgagtcgtgctggatgtgactgagcaggtgagtgggcccacgggggacagtgctgcgtagcctggagactgtgcttagtgacctggcctcctcttctccccagatcagccggttcctcttggatcatggagacgtagcctttgcgcccctggggaagctgatgctggagaatttcaagctggagggagcgggggtgagtggcccgtgactccaggggtggggactccctgctgtccttcaggggtgaactcgagggtgtgtgagcctgacaaggcctttccatgcagagccgcactaagaagaagacagtggtcagtgtgaagaagctgctccaggacctcggtggacaccagccctgggggcaagtggctgatgagaaaggaggagatggataggcatagctggtggtggggatgtaggaggtgctaggacgcacgtacagctttccgtcatacccacttcccccctgctccatgcagtctgagctgtactttcttataccagacttccaactccaaatcatctcaggggaaagcagatt

SEQ ID NO: 2158 - DNA, 1201 bp, Homo sapiens
taaattagctgtagtttagtttgcatcagaatttccccctttaacgttttgttcccttattcatttacttttgtaagtagtgtaggtctttgcgccaaaaaagggatcagtagttgaataatttttacaaatgtatagcccaaagattttaagagatttggtgtatttagctttgtttagacctttctgttaaaaaaaaagatttgatatttgcttttttctcaacttaaatcctaattaactagcttattagaattggtatgaacaagtaaaaggctcattatgaattaatgtgtaatattccttgtgattttgacatgaagaaagcatctttaggcatagctcacttcctttatttaataagcatcaatcacaattcaaggttgattgaaatgttaattaatggggatggataatatgtaaacttaattgtaatttcgtttgcattcattgtcccagtatttacgttttatacaacagtctaaagcgttatacacatctttagaaaattggagtagcaaaagttggcggaacgtaaatgttagcaacactttgggtttattcttttaaagtatgatttaaatgcttttaagttttagcatggagaaagtagcaaaggaaatagtttgatttctcataattttcttcttctttttttttttttttttgagttggaatttggctcttgttgcccaggctggagtgctgtggttattaacctataaacttttttatttattttgagatggagtttcgctcttttttttttttttttttttttttttttgagacgggagtcttgctctgtcgcccaggctggagtgcagtggcatgatctcggcccactgcaacctctgcctcccgggttcaagcgattctcctgcctcagcctcccaagtagctgggattacaggcgcccaccaccatgcctggctaattttttgtatttttattaaagacgggtttcaccatgttgatcaggctggtctcaaactcctgagctcaggtgatccacccgcctcggcctctcaaagtgctgggattataggcgtgagccactactgcgcctggccgatttctcataattttcattttaaaagaatagtaatgcaaacaagtaatggaatcatgtatgacaggatttagttactggttcctgctccagtcattctgagcgttttaataaatttgttttacttgg

SEQ ID NO: 2159 - DNA, 1357 bp, Homo sapiens
cttagctagaaagataagtacaggcttctgcttttcatatccccaaattaaataataattttatagttgtttcattttccgcaaattgttcagcgtaagtaaaggacgtaatagatttgttgattaggaagagaacttaaggtttttattttcaaagagaaagtgagtaattactggtacttagagtttgtagaactgggttcttaactaatagttttctttctaaacaggacaagaatatcagagaattgagtttggtgtcgatgaagtcattgaacccagtgacactttgccgagaacccccagctacagtatttcaagcacactgaaccctcaggcccctgaatttattctcggttgtacagcttccaaaataacccctgatggtatcactaaagaagcaagctatggctccatcgactgccagtacccaggctctgccctcgctttggatggaagttctaatgtggaggcggaagttttggaaaatgatggtgtctcaggtggtcttggacaaagggagcgtaaaaagaagaaaaagcggccacctggatattacagctatttgaaagatggtggcgatgatagtatctccacagaagccctggtcaatggccatgccaattcagcagtcccgaacagtgtcagtgcagaggatgcagaatttatgggtgacatgcccccgtcagttacgcccaggacttgtaacagcccccagaactccacagactctgtcagtgacattgtgcctgacagtcctttccccggagcactcggcagtgacaccaggactgcagggcagccagaggggggccccggggctgattttggtcagtcctgcttccctgcagaggctggcagagacaccctgtcaaggacagctggggctcagccctgcgttggtaccgatactactgaaaaccttggagttgctaatggacaaatacttgaatcctcgggtgagggcacagctaccaacggggtggagttgcacaccacggaaagcatagacttggacccaaccaaacccgagagtgcatcacctcctgctgacggcacgggctctgcatcaggcacccttcctgtcagccagcccaagtcctgggccagcctctttcatgattctaagccctcttcctcctcgccggtggcctatgtggaaactaagtattcccctcccgccatatctcccctggtttctgaaaagcaggttgaagtcaaagaagggcttgttccggtttcagaggatcctgtagccataaagattgcaggtatagttgaaaagatacaaatctagagtgaagatgggagcagacctcatcaactgggcttatagactgtggtgttacccataaca

SEQ ID NO: 2160 - DNA, 1206 bp, Homo sapiens
ccttgctgggttgcaggttttgctgatactggctgtggggcccttgagtgctcaaggagcatttattgagtgcctcctgtttgcagacactgggctctgtgagccacaggcatgcttacccacaccctccattaggtttggatcccgacaccacccctctgggagttccttagggcctcacttctaggggggtacccagccccctggccaagctgccccttcccatgccagaaagcatgtggggtgccaggagagactggtctcagcttcaggcttgtggttttttttttttgttttttttttttaagggaatgtctttcttgctaagcactttattattgctgacaagccactggcatgcagggcggagtcccacatcttgactccagccaagcatcactgcagcctgggtggagtgtgagaactgcgttcctgtcccactctgccactgccgcgctgtgtcaccttagacaagtcactggcggcgagcctcgcttcagtcatccatacggcgaggcggcaccttcgcagcttctccgcagggctgagggtctggagggggccctggcgtgcaagccctttgcaggtggtgacttgtggcgggaaccacttggagctgtgtggttcccatctggcctggagagaccaggggtggagtgagatcctggggatgggaggtgtgggccagggtgccccatggagcctgacagggtactgggcacccgcgagagaggtatcagtgcctgcccagtgccactccgctgctgcctcttgcagctggaagctgacccgggctcttccccagacttggatgctgcctcttggggcagagcgatttccagcagggctctcttcctgaagtcacacacagctttgagcgcctggatttcaaggcaccagggggctgaaggcttctgtgtcacccccgtgctggcatcacttgaaccatcgcccatcaaatggtttctgactgggggaggactcctgttacaggctgagccatgtccctcaactttgtgtgttgcagccctgacccccagttcctcggaatgtgcctgtgtctgtagatagggtcttcagaaaggtattaataattgggctagaagccgggcgcggtggctcatgcctggaatcccagcattttgggaggccgagaccggcagaacacttgaggtcaggagatcgagaccagcctggccaacatgg

SEQ ID NO: 2161 - DNA, 1226 bp, Homo sapiens
gcgggcgctgtctcccgggcccagctgtgcactgccagctgggcggcggggcgggtgcagggggagggggcacgtccagacatgcagacgcacgagacagacacagacacagtacatacacgcaaacacacagacgaaagcaggcactcggagacacagctcacagacatggcataggcacgggtgcacgcgtaagtcagacacacacacacatacgcagacacatgggcagacccagcacacacacagatacacacacagaaacccgtgacacacacacacacacctgcatagatttttcccaagcacacgatatgcacgtggatacacagacttacaagcacagggccacgtgcagacagacacagaccctgtctgcaccacaaacataccacacacagccacacacacagaagccaaacatcctcgcataggtggatacaagcacagactcacatacacatatgcgatacacatatggatacatacacagagtacccccacaaacacacagacacacacgggcagagacagacagagacaggcacagaccccccccacacaaacacacagacacacacaggggcagagacacacatagacaggcacagaccccccacacacaaacacacagacgcacacggggcagagacacacatagacaggcacagaccccccacacacaaacatacagacgcacacaagggcagagacacacagagacaggcacagacccccccacacacaaacacacacacacacacacaggggcagagacacacagagacaggcacagacccccccacacacaaacacacagacacacacacacaggacacacattccaaatgcccatccccaccacagccccgtctccctctttccaggccacggcctcaggggcactgagccctctcagccctctctgccctctctgtctctctggccccctgccatggtggccccaccctggcactggctggggcaggagcctttaccagcagtgggggtggccagggcaggtggcgcgactgtaaccgcccagggccgtccgtttctgacccccacttccctggaaatgcctcgtacgtggggacagcagcttttgccagggaaaggaagcaggtacaggaggagcctgtgccgacctgggccctgggcagagtcccccagggaaacacgtggccgtcagctgccttggtctcccccagaggcgggggttgtgt

SEQ ID NO: 2162 - DNA, 1209 bp, Homo sapiens
cttttacactcaggcccccctggataatcctcactgttacactcagggccccctggataatcctcactgttacactcagggcccccctggataatgctcactgttacactcagggccccccggataatcctcactgttactcttaggccccccggataatcctcactgttgcactcagggtccctctgataatcctcgctgttacactcaggccccccggataatccttactgttacactcaggcccccggataatcctcactgttacactcagggccccccggataatcctcactgttactctcagaccccccggataatcctcactgttgcactcagggtccctctgataatcctcgctgttacactcaggccccccggataatccttactgttacactcaggcccccggataatcctcactgttacactcagggccccccggataatcctcactgttactctcaggccccccggataatcctcactgttgcactcagggtccctctgataatcctcgctgttacactcagggcccccctggataatcctcactgttacactcaggcccccggataatcctcactgttacactcagggccccccggataatcctcactgttacactcagagcccccctggataatcctcactgttactctcaggccacccggataatcctcaccgttgcactcagggtcccccggataatcctcactgttacactcaggccccccggataatcctcaccgttacactcagggcccccctggataatcctcactgttacactcaggccccccggataatcctcactgttacactcagggcccccggataatcctcactgttacactcaggcacaccggataatcctcactgttacactcagggcccccctggataatcctcactgttacactcaggccccccggataatcctcaccgttacactcagggcccccctggataatcctcactgttacactcaggcctcccggataatcctcaccgttacactcagggccccccggataatcctcaccgttacactcaggtcccccctggataatcctcaccgttacactcagggcccccctggataatcctcaccgttacactcaggccccccggataatcctcaccgttacactcagggcccccctggataatcctcactgttacactcagggcccccccggataattc

SEQ ID NO: 2163 - DNA, 1199 bp, Homo sapiens
gggggacgccctttatttgttcacaaacatttctttctgcggtaatgaaaaattaccaagaggggtgattagagaatccaggtccagattgtgtgtgcggggcctgaaagtgaaggcctgctgggcccagcctcacggggtgtaattaccccacggggggctgtcagggggaaggggcggattggtgcttgaaccgggacccagcagaaaattcacctcagctattagcttgtaattacagagcacagagggagcaggcctgaggtctggtgccggggaagagccgggatgaaaggaagcagtaattacgggatccgcgggaggccgggagggcggctggcacgctgattaataagcccctccagcctcgtggggagggggagcgaggaatgggacaccatatttaatggagtagagaggcctcccccctcgtttaaatcctgctgttggagcgtttggacagcaggcagaccggtttggggtctgttctgaagaactaagaacgagatgggttccggaaaatagcagctcgctgggccagccagccttgtccctctccactgggactttgcttccttttcttcttgccttttttttttttttttttttttttttttttttaaagcattgtgctgcttctgaccctattagaaacctagccagagaataggagaaagtattgattcaagaagcggtgctttgttacggggggcggggggtgggggcctcacccgggggcggtggtctttgcttccccagacctttcctgtctgtgaaatggtgggacctgagggttttgcggtgctgtgggctgctgcttcattctccgtttcctgccctctggcttctggcagaagcctctaggttctcagctctgccaggcagactgtctagaccaggtgggttctttctgaaagggtccagggagcagacagttgaggctcacatgaagaaggggtatgtcccctggcccctcagtttgagggtgcccagggccgaggggcctttaggtgtctggctgtggcagctttttttttcctgggggtgggggtcaaggtggcagctgacagtggcaggaagggttgtccagagcagcacgtgatgtaaataagagggtgggggcctcgcagacctggtccacctagacccctggctcgttttcgcctgctgagctgcacatgtcaagagagcttgtacag

SEQ ID NO: 2164 - DNA, 1131 bp, Homo sapiens
tccttgcaggtttctgaagtgctgccattagagaagccatctgaagacttctgtggaataggagatctagcccagctttagaacagccgagaatcatgttcttggtcttttgctttcagagccaagtgacaggcacccgtacggcggccacttgagtttgactagaggagcccttcagctctcacttgctgtgttaccttgtaaagcagaatagcatcctgtatttagagctggctgaaaaaattctagattccatcaatacacctaaagaattgcagttcagaatactcatgacgttctgtggcccaagtgcctgccctctcggcccccggaggcaggacccccaagttccaccaagcaccctgggtgcccaccctcactgaggagttcagtgaaacctctaaggtgggccaggattcagtagcctccaggttctcttctctgcattcccttcattactaagaatacagattcttcttcaaggctggactttctcaaaaagaatcttgttcttgcttccagcagtgcctgtttcccattctgtgtgtgtgtgtgtgtgtgtgtgtgtaagacagagtccctctctgtcacccaggctggagtgcagtggtgtgatctcggctcactgcaacctccgcctcccaggttcaagtgatcctcccacctcagcctcctgagtagctggaattagaggtgcccaccaccacgcctgcctaatttttgtatttttggtagagacagggtttcaccatgttagccaggctggtctcgaacacctgacctcaagtgagccgtccaccttggcctcccaaagtgctgggattccaggcatgagccaccgcacctggtccccattcttaagataacccggcagagctgcgacagcccctgcggtttccactagcagggggagctagtgtggttgggggttagggtgctgctcccaaagcctcctgggggcaaatcccagctctaccactttctagctctgtggccttgggcaagttacctcgtagtgataacacctgcttgcatgggtgttacggagaccacagcgcttttgctaatacttagaatattcgagccatgatgaaaaaagttcttaactggtttgttgttgttgttgttgtt

SEQ ID NO: 2165 - DNA, 1194 bp, Homo sapiens
tgttttggaacagagctctctgggcctgcagagacctcgttttagttcagtgtttcagcattgtgcagtcagtgggtgaatccctcacgggtgctgcgagtcagcgcccatcccccgagcagccccgagctctggcctctgcgtccatcatcaggtgggctcggcctgcgcccttagctaccccttcagagacaggctcagcccacacccccagctgcccctgcagagacaggctggctctgggagtcagcttctggctgatgaacagtggatgtggctcttgcggcacagagcggggtcgcagaatgctgtacgtggcgtgcatttgactcagccctcccccagctcacagtttccctcttgtttctgctcagtttttatggcacaggcctcatcgcgggccacggcttcaccagccctgaacgcacccccggggtcttcatcctcttcgatgaggaccgcttcgggttcgtctggctggagctgaaatccttcagcctgtacagccgggtccaggccaccttccggaacgcagatgcgccgtccccacaggccttcgatgagatgctcaagaacattcagtccctcacctcctgaccggccacatccttgccgccacatcccgggtggctctggggctctgaactctgacctgtgaatagaagcagcatgcactttggaaatccggccttttgaccagaacgcacacctcgtcggggggcccagtccagccaccccccagcactttatgtagagagtgtgacatagacctgcatatttgtcagtgccatgatggaagaagctgagcatgtcttaccaaaaacagagagaacgagcctgaatacagcagatgtaggggacagccgtgggaccgcgtgagaattgaagcggtggggttcccgcaccctgggctggctggtggttttctcgggaagcaggaccctcctgactggtgctcttcctgtgagcggatagagtgatagactgggtcgtgtgtgagacgcatgtgctccaccccactccttttgggggaagccaggcaacagtggcctctgggagggggtcaggaagaggcgaacagctcaggcagcgcaggtgtgatgggcacagtacgcagagcaagctcgggaagttggtaggatctcaggcttggggccgggactctggagtgaatccccatttctctaccggctt

SEQ ID NO: 2166 - DNA, 1105 bp, Homo sapiens
aaagtgtattttgctcagaacttttccagaaattgtttggaaatgcatgttaccatggcagcgctgaatatggtgggccgcatgggcagagatgttcacagcccgtgcagggctcctccagccatcccgggtatcttgctgagatggtgatgcctgggactccctgccgagctcccaaggaggccatgctgcaggtccctggaccacgcccagagcggcctggctctgctgaagtctcacctgagcatcacatgtcaaaacgtaccttgatggatttctgtattccttcctgttacaattagggcaatattaattgtttacaattgtgtgtagaatcgtttctttgctttcatgaggatctaggacgtgttagtaatatttgttttaaggagtgggattggtctgaggggttgagagccactgccttgccagggagctcgctgcccctgctcaggagccttttgaggctcccctctgcctgcagcagaagtcctgaccccttggcctggcccagaggctcattccgcctgcctctgtttacctccttctactcccagtttgaatctcgccttaaagcaaattggttttctctttctgtcatcactgcaaagacctttatatcctcacagaaaatgctgtaattattgggtggcctgcctgatatatatatatatatatatatatatatatttaagagacggggtctcgctctgtcactcaggctggattgcagtggtgttatcttggcccactgcaggctcgacctcctggactcagatgatcttcccacatcagcctcctgagtagtgtgccaccatgcctggctaattattgtattctttgtagagatgggctctcgccatgttgcccaggctggtctctaactcctgagctcaggtaatccgcctgccctggcctcccaaagtgctgggattacaggcatgagccaccagataaaatgttttgtaatctgcaaagtgaaactaaatgatggtatcagcggtgggatttcctcccggagttcactgtagctgataagtcatacctagtggttgtactgcattctggagggctgtggcctggggtgacgcgtccctcagtctga

SEQ ID NO: 2167 - DNA, 1177 bp, Homo sapiens
gcttacgctccacagaaggcagtggggctgaccagggagggaggggaaggcggccacactgggggcagactggaagtgggttgtaatgagtgtctgcgtgcagataggtattcgctttgagatggcaaaaccacattacagaaatgtggggaaaagctactcttcacttcgccaccgtacacagctgttcccatcactttcgatcgtttagttttagtgttttcatttccattttaaacaaaactgtcatcatgttatgcatagaatttgtaattttccagttaatatccgaggcttttttctttttttcttttaagttctggggtacgtgtgcaggatgtgcaggttgttacataggtaaatgtgtgccatgatgtgttgctgcacccatcagcccatcacttaggcgtaagcccggcatgtgtgagctatttatcctgctgctctatcagccttttttcttgttgtggtttttcgaatcacagcgtctaatggctgcagagttgagagcgtgctgaaatctttcctgaccttgactcaggctggtcacccagcccccgcactagcccggcccctcactccttgtgcctggtcttccctctctcccaggctcctcttctcagccttcagagcccgcggagcacatggggtccagggcaggagtagagggagcctcgctgcgtcgctcctgggcccggaggtgccctggcggggggccgccactgcccaggctagccattctgcagagggatgcgccaacatttggagcctagaattggaaatgcctcttttatttgaaaacagctgaataacattcatctgctttttcccattttcctgtccagatatgaaatatgactgagtcacttcctactctcagtccagatgggttttttttccttttacttttttcataaaccctaatattattcagtcctgggacatgaggtacacatggtgtttgtggccagggagaatgctgactacatgtttctgtattcattgacactatatgttgtttaaaaaagtaaaatacatggattagagtgatgtcattgtgggaagttttagaagtactgctttagaaaaacataaaagctatgtatttgctgacagtctgactgaggaagtcaggcaggaacagcgtgtagttccactaagtgaacatcagcagggc

SEQ ID NO: 2168 - DNA, 1196 bp, Homo sapiens
agcattttgcttttgttgctaaagatttggtttgaatgaaagatgctgatcagaaccaatggggatcagatagacaagctcccagcatggagtggctgtcacggccgtgatgaaaacagggccccttcagtgtggaaccgtgggagacgcggaacacaacacagggtggtggattcctgggcggagctctgcctgccccacgggcctgtggtctgctctgtctgccggggcccagtttaccgaactacttggtggccagatagccaccgtagggcgtgagcggccggcacgaaagcccagggcctctgtctcccgggagctgctggcgcggcgcggctgggacacgccgtactcggtgccacgttcttgcccagttcctcgctgtggtgagctgctggctgttaggaagcctttccctcggctgcggccctcccacacggcccccagacccctgactgcagggtgggcgggcgtaccaggggaggcactctggccggcccgcttggcagcagggccacagctcctcctcgcagggctttgtgggattttaaaggatgaatcgtcttgttctccatgctccccctgccgcccatgcgcgccatgctctgtgtgaggatgaattggagggactggccatgagcggtggcttttttcgtgtttggggtcgggagggtgttgggtggaatgaacatcaagggaaccacccattgagcttagaaattcttgccaggcagttggtttgtgtttgtgtttagatgagagcagtgttgattgcagtttgacatctgattttttttttaattgagttggtacaagcaggatgtcattggctaggtgacaaagtcactgggggaccaaataccaagatgcccgttggtgagagagaccctccccaggaccctccccaggcgcctccttctccgtgacgttcaggaccctccccaggcgcctccttccccgtgacgttcaggacccctccccagggccctccccaggcgcctccttccccgtgacgttcaggaccctccccaggcgcctccttccctgtcatgttcaggaccctccccaggcgcctccttccccgtgacgttcaggaccctccccaggcgcctccttccctgtcatgttcaggaccctccccaggcgcctccttccctgtgacattcaagaccctccccagggccctccccaggcgc

SEQ ID NO: 2169 - DNA, 1225 bp, Homo sapiens
ggaggagggtgggagcccaggagggcgggagggccaggtggttatccagggggatggtgaagccaggacatgaaggaagggaaggcggtggccgagcaggcccgagtaggcagaggaccagcgagttctgatccaattgttgaggtccctgatctcaccctctgggcattcaggaccttgggtgctgctgtgagctcagggcagagggaagttggggcgtggaaggtctgggaatcttgtgagagccccaagtgtgcacctggtgtgggccgaccgagtcagagggatcgagaagttaagtaaatggaaagagtgtgtcatgacaccttagtgagcatttatatctcgtggggagccccgcctgtgggccagctaagcaccttctgtgcagtgggcctttccagacccttgcaggaagacggggccggcctggcgggctggggtgcctgggtgaggcctcttcagcgggccccggccctgcagccaggcagctcctggtggctgtcccgaacaggcctcaccgcttctccttggatgtgtccttccaggtcaccttttctataaatttggcatcacagaatccgactggtaccgaatcaagcagagcatcgactccaagtgccgcacggcgtggcggcgcaagcagcggggccagagcctggcggtcaagagcttctcgcggagaacgcccaactcgtcctcctactgcccttcaggtaggcctcgtgctgcaggagaggccgccctcccccgctcggggcagctggcctggtggcaccctcaggggcagccagtgcgtggccagcggctccaccagtggccgggagccgaggccagaggcttgcgcggtgcgcacggagcagtggagccgcaggacctgtgcctggccccgtgcgcccttcacacggacagcctcgggcctgctccaggctcctccgtgagggacagagggcctgttgggcctcccggaagtcttctggatgggggcaaggaggccgaggcctttgcgtggggctgccggccgttgtattctcacgatttgccgggtgactccgggtgaagaagtggggtggattctgaattatgctttatttttgctttgagttcatggccttagttggatttatccacaagataatggaaacagttctctttgagttgcctctcaggcatcgctggggggattgttctccttggagaattttcactaggaatgacaatgtga

SEQ ID NO: 2170 - DNA, 1099 bp, Homo sapiens
tggcatcataacaagagacgaaccagggctgtgggagttaggggccaggaaccagggacaaaaccagtatctctcgtaaacaccacagctcttcagagggtttttcaggtggagtcacgggggagatggctggactcaggcactccaggaatggagagtgctgtggccacacgctcagtgacacgacgccccagccacacggcatccgacgaacaccagacatctctaatgcgtttcagtgtgccagaaggaaaacatgtttcctcctccctctgatttctttacagacaattgttttcttggggatttagattacatacagcataggaaatgtgttgttctaattggagtataatatgatattcttccaattaagaaccctcttcaggaaagagctggtgtgtgggcgtggccggctggtgagcttctcagtcacgttcacagggatgggaatccttgtcctccggtcttattcctgatgtgtcagtgaagattaacagggatagatccagctaaacatagccaagatgctatctagctagctagccagctaatcgatgagacacagtctcgccctgttgctcaggctggagtgcagtggtgtgatcttggcttactgcagcctctgcctcccgggctcaggcaatcctcccacctcagcctccccggtggctgggaccacagctcgggctaccacacccagttgatttttgtatttttttgtagagacaggattttgccatgttgccaggctggtcttgaactcccgggcttaaggagtccacctgcctcggcctcccagggtgctcgggttacaggcatgagccaccatgcccagccgacaagatggttttaaactaatagctgtgcctctttaagacacacacttgttaatggttgtgttgagcatcttgaactgccagcggcctaagtggcgttgcagcccacaggagtctcatccagacctggcggaattaggaccaggcacgagtgagcctgattgtgtaagagcatctgcactcagaaacccatcatttggataagtgtgaggggtgtgtattggctgttttttcattttaattttttgtttttagagaca

SEQ ID NO: 2171 - DNA, 1179 bp, Homo sapiens
ctcagcctcctgggctcaagtgatcctcctgctccagcctcctgagtagctgggaccacaggcatgcaccatcatccccggctaatttttgaatttttttgtagagatggggtctctgtgttgcctggtctggtctcgaactcctgggctcaagtgatccgcctgccttggcctcccaaagtgctgggattacaggcctcagccaccacacccggcctaaagtttgtcacgttagccgcattgaagggcacaggtcagcagcggtaagcatgttcgcattgttgtgcagccatcactgacacccatctctagaacttcttcgttttcccaaaggaaactgcacgcacggcaccacctccctggcctccccacagcctcagggtctggtgaccttcatccccaggacctacgcttctgactccaggagccctgcctggtgtccacaccacactaaggtgccctgccacgggcttcgaacccaaccctggtgcacttgttgagcattggacgttcctggcaggtcagaccgtgagctcctctgctctgacggatgcatggacggctgccacctggctggacaggtgcagaggggaggtgccaccttctctggggacaggactggggcagaactcacccggctgaaaagtgcagctgtggagaacttcagaacttcagaagcctttgctgtgaatgcattttcctcctgcctcttgggccagatcttagggattttttttttttttaatgaaaatgtataatcgtcaaaaaactttagatttaaaagcatggagccgatggctatgcttggtgcgttaatgggaggaagaggggatcttaacttcagggagggctcctgggggagctgggggaggctgctgtgtccagcagggcgggcggtgccccccggagcccggcactccgcgatgtgtgcgctaagccgaggccgccttgagcccgtagcagcgccgagcgcgattctttcgtgtctgcttccgggagggtggaagggtgaagctgttgagagtgggaagggaggggctgtgcttcttgagtttgccgtgtgcccctgaccctttcaggtgcaagcgtcagctccacggtgccaatggggagatgggtctggaggccccaccaggctgtgaaaggcccggcctcctgtgctgtccgtggaggtcgggg

SEQ ID NO: 2172 - DNA, 1155 bp, Homo sapiens
gggacgtaagcacaggcctacctcacatgcagtctgcccttgtctcagatgtgcccagggtcacccatctactccttctccccaggccttcctggcctccctgagccccgccatggtggtgccggaggaccagctgacccgctggcacccgcgcttcaacgtggatgaagtacccgacatcgagccggccgcgctgccccagccacccgccacggagaagctcaccactgctcaggaggtgctggcccgggcccgcaacctgatttcacccagggtgagactgcgaggcttgggcagcccatttctcccgggtgggtgggccagcctgaccccaggcttaagaggtggaagccttggtgatgagcttgacgcctcatctggcttcctccttggctggcggatccagagagttggtggcatttgccctctgtccccagctgcagcctctaagcctggctctgccactagccccatgtggggagttggcctgggcaggcgatgctgcacactgggacactgcattgaccggcacagaccacccagtgtgctgggtgaacttgtgccttgagagataccggggactcctgggcagacagccaggggcacgttgcatcttgtgacctctccagtccaacctgtccctcccgcagatggagaaggccttgagtcaattggccctgcgctctgctgcgcccagcagccccgggtctcccaggccagcactgccggctaccccaccagccaccccgcctgcagcctctcccagtgctctgaagggggtgtcccaggatctgctggagcgggtgagtcgtccccagtgatggcgggtgggcgcctggtgacctgctgcccactaaccaggtcccggtacctgctgcagatccgagccaaggaggcacagaagcagctggcacagatgacgcggtgcccggagcaggagcagcggctgcagcgcttagaacggctgcctgagctggcccgcgtgctgcggagcgtctttgtgtccgaacgcaagcctgcgctcagcatggaggtggcctgtgccaggatggtgggcagctgttgtactatcatgagccctggtacgtgcagggcggggtgaaggggcgtgcagggtggaattgcctggtgctgcagctgcctccccagctttct

SEQ ID NO: 2173 - DNA, 1206 bp, Homo sapiens
aggctagtggggaaaccagacacccaaatcaaacaagcaaaaaccaaggccagtagttgagggtctcaagcacaaaacatactttggctctgacaattttcattgtcatgaagtttgttttgttagacaactatgaagtgttgtgacggtttcaaactaagagcagaaaacaaaactgtttagtacaaaccacagacaataacacagtagctttcccctcacaagttaatgaaagagatgtgctggagagagagaacctgctgaacatgggcacagatcccacagagggggcgtggtgtgtgggaggagactcgacagggtcatggggtcactgctgcccgttgtcgggagataaggctcacagctttatttgataatgttgtctttagcttgtaaatgaacatgcttcccttcccccattgagtgttgagtgttgtgcctgtgggaagcgttatacacacagcctgggacctcagcacagatgcccgttgacaggtgtcccaccggccttccgggttccagcgccaggcctggtgcctgccccaggaggatgagcatttgcattgcctgcaccttatcgtgcccttccacctgctgaagcagctgtgcctgccgctcttgtgaactgcgaacttccccttacctcctctctctggctcgggagctgggtgagtttgaacttggcctcctttgcttttctgtgtgcgaacaagtggttgccttgtttgtttactgaacagagtgtggttgaggcaaaatgctgagatgaaacctaacctaatatgtgtgtattagacggtagcatcattgtcaaaataatacttgttcaaagtccctgaaaaccaaacggacaacttgactacgcttcggccacaggcctgggacgctgtcagaccgagggccgctgagtgcccagtggcagcagagcccagagggtgcttcccccaggaagggaggcagaccagcctattcttactgtgagtcgagcaaagctttgattataaagggccagggatgcaggagcctcgtggagagtgccaccccttcttctcgctctggaatgcgggggctgtgcccctggcctgtgtccgcatcctggggcggtgtcccgtgggcagtgtcctctggctgcagaatgcatgttgcagaattggaccagccctcacgcgtcaggagcgttgggcccacaggcggaggcaccctggc

SEQ ID NO: 2174 - DNA, 1205 bp, Homo sapiens
ggagtgggaggtgggtggtgcgtgtctgcggagtgggaggtggtgcgtgtctgcggagtgggaggtaagtggcgcatgtctgcggagtgggaggtggcgcgtgtctgcggagtgggaggtggcgcgtgtctgcggagtgggaggtaggtggcgcgtgtctgcggagtgggaggtggcgcgtgtctgcggagtgggaggtggcgcgtgtctgcggagtgggaggtagcgcgtgtctgcggagtgagaggtagcgcgtgtgtgtctcctctgctttctccacacacaccagcgatttcctgagcgtccctccggtgcgcaggatgagaaatgggccagagtcagggctgagccacagcccgaccccgggcttctgggtgaaggttctgcggtcggtgaccagcctcacacagccacgccctggggtgcagggagggtgttcattgcccaaataagagatgcgcttctcctggcatatgaaacaaaatcttgagagcttgagaatgtaatttggacatcacgactgaaagcatccctttcttttctaggataaagataaagtttctctaaccaagaccccaaaactggagcgtggcgatggcgggaaggaggtgagggagcgagccagcaagcggaagctgcccttcaccgcgggcgccaatggggagcagaaggactcggacacaggtaccagcccgcggcccctcctgcagtcagccctccacaggcagcccggagcagcccaggcagggcgtccctggcccccgcacctccggctttgcactgggacgcactctagcaccctgcacgccgtccaggcaagaggcagcaggggcggagcacaggcccccacatgccacctcctttgcacccgaggctcaggcccatggggccgattggagagcttcactcttgggtcccacacacgtggagatgcacccggtgcatgtccagccctgggcgaggtatggggctgctcacctgtgggtcttctgacagctggacacgggagggagacagtggttcccctcagggccacaaaggcacaggaagaaactccattgcttgtagtaaaaaccaaagggagccctaaaagtgagcaggaggcagggaggtcttcccaagcacaggcggggtctgaggctgcagagcaggaatgtgtgtgctgtgtgcctgtgccagagtgtgtgcccaagtgtgtatgcctg

SEQ ID NO: 2175 - DNA, 1146 bp, Homo sapiens
caggggatacaggaaggagtggggtgagggctctgtatgtgcacagcctgtgtgaggagagccgagtaaggtgggaacattgtctctgattgacagtgtctctagttggacattgttgcagtgggttcagtgggttcaactctgattggcagagctgggattcagcagcacgtcgttaaagccagaggcaggtgagagtgcccctgcagtggctgaagacaacattgagggaggaggtggaggaaggagatgtagcaagtgaaacaaaatggaaacaaagttcacaagagaaaccgggaatggtggggtggaagcctgggaagagagtggtttgtaggttcagtgctactgcgagaccatgctagatgagtgccagttatgttccatgtttctcacaagaaacacagaggtggcatctgttaagggctgtcgtgggggttgaatgaggcgatgcgtggagagcacagagtgggtgtgcctgggtgtgtgatcatcatggtgtggccagtggtggtgatgggaggggcagccactcaccagctcgctctctctccagcccgtgcagcctgccaggactcttccagacacgggatttgtcggtgaacaacgcagagctgatgcagacatgtgggtaaagatgttgtccatccagtcgcacgcaccggccagcttgctcttatttatcttctgtactttgcctttgctgcttgagagttctgtaaacaattcttaataaacaaagaggcaggttttatgtggaaactcctgggagaggagaggatttcactgaatgcaaacaggaggaaggagcagatgttaaccctaggcttctggaagcagggttgagtcagcagcgccttggtcttaggaagaggccgggatggataggttgagcctggagtggccgtttctgtttctccgcctgcgcacccacttcccaggctcacaggggtttcctttgtgatgcaggaggaagcacagtgggaagaggagagcacaggcagggctgacgaacatgatgattctcagacagaaactgcgtaaggtcatatgtgaggagcaaactcccttttgtcttaagaaagaaacaattcattttggtgatgtttcttttgttacagtggccggccatcaggttgcattaat

SEQ ID NO: 2176 - DNA, 7121 bp, Homo sapiens
agaagaaatccagctttcaggcagccgaagagcgtctcgagagcttgtagtgttagtattccacagccccacagttgattcggatttcaaggaatttttagactttgtggattttttcttcactataattgtatgtttggctcctaatttatttaaattacatacatagatatttttgttactttgagaatagtctatctgaaatttgaagttctttagagcttaatatattaaatatgctaacactcaaaacattttctttctttttttttttttttgagatggagtttccctcttgttgcccaggcatgatcttggctcaccgcaacctccgcctcccgggttcaggcgattctcctacctcatcttcccgagtagctgggattacaggcacgcgccaccactcctggctaattttgtatttttcgtagagacggggtttctccgtgttggtcaggctggtctcaaactcccgacctcaggtgatctgcctgccttggcctcccaaagggctgggattacaggcgtgagccaccatgcccggcctaaacattttctcacaggcatttttcccctgacacatgcgagaggtatctttgaattgtatcctttatcttttagtgtgaaactcagaaaagtgatgcacgcttgcacttacagttcaggtaaaatgttaagcatattcaatgagatttacattcatgcttgatttttctttggcaaagtctttagatctgattctgctaaacttgggttctcaccagatgactggcttttaaaagaagatgatgttgaaactgactcttgtaaaaaaggacatttagtagaagctaatggtacggtgaagttttagagagttgaggagaaaatctgtcttagaacttaatctgtgccttttccttaatagctttcttctaagcccataaatatattggttcagggggatgagtgaaggcaaatggagggtgtggaagggagacagagaacagctcttgggcgttggagaagtgctgggacttgtgtcagtgctgcccgtgttggttttccagcgctgctgtaactaaccaccataaccttagatttattgttttatagttctgttgattagaagcctaacatgatctgcctgggctaaaatctgggtaggtagggctggttccttctggaggctccaggggagaatctgtgttcttgtcttttccgtgttccagaggctgcctgcattcggcctgtagtgctttcctcagtcttcaaagccagcctcatggcatctctctgactcctgctgcccacccgcttttttggagagtctcggctctgttgcccaggctggagtgcagtggcacaatcaaggctcactgcagcgtcgacctcctgggctcaatcaatcctcccgcctcagccccccagcagtgctggaattacaggcatggagccactgtgcctggcccttgtttcacttttggatccttgtggttacaaattgggcccacccgagcactgcgaggtcatctccctctctgctgattagtaacctcagttcccttttccacgtaacctaaggcattcacaggttccaggggtgagcaagctggaggtttttccagtaatgttcccttgctgtcctcagatgccatccgggatcccacattgcatttagttgtcatgtctccttaatctcgtctgcaaccatttctcagcgtttccctgtttttcatgaccttggcagttttgatgagggcagtcatctttttttatgtctttgtgactgaccgttcacacattggcatgtttgtaaagcacggtgtggctgacgtgtggctcacctgactgcttttccaaatggggtgcagtgtgctctacagtgggagaacagctttgtgtcttcttttagctggaaggagctacatgttttatagaagggacttctgaaactagacaaactctgctttttctgatgtttcactgatttccttcacagatgttcattggctgctcactgggtgcagtgctgtggcctcctgttctgagatctgggagaaagatgcatttagttgactaaagcttgcattaaatattggttcttatgaaaagagagatcatagatcagaggagggaaaggctctgtgacctgggagatttaagggaagaagtgctattttttttttttttaactgtaagctatgtttctgttttaaaaaaagaatcagtagaatgtcactgcagaaatcagagtaagggcatcttcgacttcgggaaggctggggacaaaggctgggaaggccgcatgtaacgtgagaatgtcagccagacgtgtctgaacacgaaagcccatccaagaagatggaagatgacagcagattaacctggaagcatgactggagttgggttgtgtagggtttgcaatgatagacctgaatttcatttgcttacttgttttgaggcagaagatgatgtgtcagagtttgcaggcggtggatgcctagatgaaagcactggctttgcaacaccatggtgcctaaatggttctttttttgagacaaggtcttgctctgtcactcagggtggagtgcagtggcgtgaccatatctcactgcatccttgagcttctgggctcaagtgagcctcctgcgtcaacgtcatgagtggctagaactacagacgtgcgctaatttttaaaaattctttgtagaaatggggtttcgctatgtttcttaggctgatgttgaactcctggcctcaagtagtcctcctgcctcagcctcccaaagtgctgggatgacaggcacaagacatcacatgcagccttaagaagatccctacaagagaacctggagaaacttgaaatagggaaggggactcgaaagcacactgtgtaggtgaattgtgaagacttcatggtgttaactggtattcattaaaaagacttggaaaaagagaagatgaattgattcccagtggagggaatggggcaaacattagttaggagagtggctttgtgaaacgatagagcaaaggagacagaaaagaaagcaggaatggggaacggggtggtggggcagaagctgggtgctgtttattttgtgcctactgtgtgtcactctccattctctgccctggggacatttgacagatgtggacgtcactggtgtgatttgcccacattctggagggagaagtgggcatctcagttgaggaaaggaaatggctatctggggaattcttgaggggcacagcccaggacggagccttgtgttagatgggtacctgctggctctgctcagctcggcagatgtgttgcctaaatgactttaatggccaaggcagactggtatttgccctcagatattttgtcaggacagtgtaaaatgtgggccaagatagtggttttgggtccaaacagaagggggttagagattttggaggttgaagcctgctgctagaaggagtatagaaagaagaacggggattctgtttgcccaaatacatggttaggctcatcttggacttgtttttgttttatatcttctgttacttctatgcacatattaatagatacctaattaatatttggttggaaatcttaaaagttaggattttttttttctttttttttgagatggagtctcactctgtcgcccaggctggagtgcagtggtgtgatctcggctcactgcaacctccgcctcctgggttcacgcgattctcctgcctcagcctcccgagtagctgggactacaggcacccaccaccaggctcggctaatttttttgtatttttaatagagtcagggtttcgccatgttagccagaatggtctcaatctcctgaccttgtgatccacccgccttggcctctcaaagtgctgggattacaggcgtcagccatcacgcctggcctaaaagttaggatttttaaaaaggcttgtggtctgagaaggaaggcaataatacttggcaggaaagacttaattttttttttttgagactgagtcttgctctgttgcccaggctggagtgcaatgacacgatctcagctcactgcaacctctgcctctcgggttcaagcatttctcctgcctcagcctcccgagtagctgggattagaggtgtgtgccatcacgcccggctagtttttttttttttttttttgagatggagtctcgctctgtcacccaggctggagtgcagtggcacaatctcggctcactgcaagctccgactcccaggttcatgccattctcctgcctcagcctcccgagtggttgggactacaggcacctgccaccacccccggctaattttttgtatttttagtggagatggggtctcaccgtgttagccaggatggtctcaatctcctgaactcgtgatccgccccctcggcctcccaaagtgctgggattacaggtgtgagccactgcgtctggcctttttaaaatttaatttaattttttttgggggcggagtttcgctctgttgcccaggctggagtgcagtggtgtgatctcagctcactgcaacctccgcctcctgggttcaaatgattctcttgcctcagcctccagaatagctgggattacaggcatgtgctaccaagcccagctaatttttttgtatttttagtagacatggggtttctccgtgttggtcaggctggtctcaaactcccgacctcagatgatccgcctgcctcggcctccttaagtgctgggattgcaggtgtgagccactgcgccaggcctagatattttttatatcaggtcacatgtgttttatctaggaggcaaactttccttgtaattagtgttttttttttcctttttttgtttttgtttgagtggagtctcgccactgcgtctggccgtcattaatgtttttctagtgatgttgcactctcttgacgtcagttaactgtcacctgaatcttcagggactgggttgggttgtggggtaggtggtggcgtgacttgctgttgatgggactgctgtccacaggaacaggaggacccactagttacacagctgccaaaggtgtgggtcttgaggcccgaaggttgaggttgcagtgagctgagatcatgccactggtctctagccccggtgacagagtgagaacatctcaaaaaagaaaagaaaaagtgttgggtcattatttacacacccaacaagtgaaaggtctggagggcccaagtgaggacagctcagttcaggcatgtttaacctccagattacctcatccttgagaaatttaggaataatcccagtgtcagtctttggaggtgtggttctttgatgttagtcatgggaataaggaatttgcattaagcctcaagaattgtggaaagtcctaatgagaaatgtcacgggcagaaactgccacccgctttagtggtgcaggtgatggctgtgccggagagctgcgcgtagccggctgctggaggagaggacgtggcctgtacaggcagcttcgctctggggggtgactgttggagggcagcggggacgaaagggacacatttgtatgatgctcagttgtcagcaggatgtccaggttgcttttttggagggcagtgggtccttgagaccttgagacccattctctttggaaagtaatgagttaccgggtgggggctgtaggaggatgttcagttgtggtgtggaggcgtcgggttgcttaacctcagagggatcttttttcctatgagttgtgtagaagaggatgtcttccatagatttgaaggacgttaaaaaaaaaaccaaccccaatgtggctttccttctttctcactagggtgatagtccgacgtgcatgtctgtttcctggaccctggatgtgaaaatggggttcttgaaggcactgggagtgtttctctgctggccccagaggcctgtgtgtgctgctggcgaggcagctgggccactgtcactgtgccctgacaacaacgttgggaactgttcctgaaagtgttaaacaaaatttcagtttattaagcgctcctctcattaagccattgttttatttttcttttttgattttttgggcttcttttgaagccataataaattggaatagaaagaatacataccaagaaacaaatattaggtctgattttttaattttttgttattatttttgagatggagtcttgctctgtccccagactggagtgcagtggcgtgatcttggctcactgaaaccttcgcctcctgcgttcaagcagttctcctgcattcaagcagttctcctgcctgccaccacacctggctgatttttgaatttttagtagagttggggtttcaccatgttggccaggctggtcttgaactcctgacctcaggtgatgtacctgctcagcctcccaaagtgctgggattacaggcatgagccaccgcgcccggcctctccaatatttttattattaaaatgctaaatactgccgggcccagtggctcacacctgtaatcccagcactttgggaggctgaagcgggtggatcacctgaggtcaggagttcgcgaccagcctgggccacatggtgaaaccctgtctcttctaaaaatacaaaaaattagctgggcgtggtggcaggcgcctgtaatctcagctactcgggagggtgaggcaggagaatcggttgaacccaggaggtggaggttgcagtgagccagaatcgcaccactgcactccagcctgggtgacagagtgagacgccatctcagagagaaaaaaaagaaattacgcgtggtggcccatgcctgtcatcccagctactgaggaggctgaggcaggagaatcgcttgaacatgggaggtggaggttgcagtgagccgagatggcgccactgcactccagcttgggcaccagagtgagactctgtctccaaaaaaaaaaaaaaaggggaaatgacttaaaggtgatggcttttatacttctattgtgcctgttttctgagatataaatttaactagctaattctctcgtgttttaaatagtagacaaagaaagacaagaccaaaggagaacctttttctctgtttcttactccgtctgcttttattaatagatgctcacggtgtggtcttccactcacttcccctttcatctctgagcttaacgagc

SEQ ID NO: 2177 - DNA, 1116 bp, Homo sapiens
ccaagtagctgggattgcagacgcatgccaccatgtccagctaatttttgtatttttttagtagatatggggttttaccatgttggccaggctggtctcaaactcctgaccttgtgattcacccgccacggcctcccaaagtgctaggattacaggcgtgagccaccgcgcccggcctgagatttgctttttactcttaggctgatcttgcctgcctgattgaagctgatcgcttacatttgaaaacaaaatatactgaaaatagaaaaacctgaacgttgttattgtcacaaggctggctagatctccggcatctgcacactcagtctgaccatttgggaagctttcatgaaaaagcacagtcagcgagaatgagacgagagaacccatttccacaaccattttaatctgcgcatcggtcccagacgtagggattcctcgtctcatcttggaaacattgccagcagtggttctgatttggaagcctgcgtctgtcacgtgacaccgtctgagcctgtgcctgcctctctttcttccggcagtgccctgtactctgtggggatgacggcagtgggcctggccatcctgtggtatgttttccgtctggccgggatgactggaagggaaggtggattcagtgcttttgtaagttctgtaaatcagagctctctgaactctttctggtttgtgtttgctgaatacttttcccataagctatacgatgaatacacagggaaaacctgttgcagagagtagcctgaagccacaattagacagcagctcaccttcctttcccatggtccggctgtaaggcgtgtagtaaccaatgttgcctgagggcctctcacccctaactctggggtgcctgagccttgtgagattacagggcagttgaatctgcgtttttcttttctttttttttgagacggagtttcgcccttcttgcccaggctggagtgcagccgtgcgatctcagctcaccgcaacttgcacctcccgcattcaagcaattctcctgcctcagcttcccgagtagctgggattacaggcacgcgccaccacgtccagctaattttgtatttttggtagagacggggtttctccatgttgttcagg

SEQ ID NO: 2178 - DNA, 1244 bp, Homo sapiens
ggcccagtctggagggttcggggcggaggcccgggggggtgcgcgcgcccggggtccggcctctcactcgctcccctctcgtccgcagccgcagggccgtaggcagccatggcgcccagccggaatggcatggtcttgaagccccacttccacaaggactggcagcggcgcgtggccacgtggttcaaccagccggcccgtaagatccgcaggtgagccctgcgctcggggctgcccctggggctcgtgcccgcggctgcgccttggcttgcgggtggccgatgccagggcggggggcgctgtctgcaaccgtcgcggagcgctggcctggcggccttaggcaagggtgaccgccgctgcgcttctctccaccagacgtaaggcccggcaagccaaggcgcgccgcatcgccccgcgccccgcgtcgggtcccatccggcccatcgtgcgctgccccacggttcggtaccacacgaaggtgcgcgccggccgcggcttcagcctggaggagctcagggtgagtactggcagcgctgcggtgtcaggaaggccccgaagtcccctctgttggcctcagtcgcgtgatgacattctccggaatcgctgtacggccttgatgaaagcacatttgaacccttttccatctgattgctgaggcttttcatccaggcctcggggctggagaaagcccgggcctgtctccatctctctctggttctggggcaggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgtgagtacacggctctctggccgtcctggtgcgcggggacagtgaggcttggctcctttatcagtgacaccggtccctgggtcttgctggggtgagaagaaccaaaacattgtgggtgatgagctaagcgggactgctaaggttcacctgtgcgtttccgcagagataaccttaatggacatggcaaggctgtgtgacttggaggcagctttttccattgacgttgctctccctaaaatgcttcgtattccaaaatatttctagaaagaccttgtaggataaggttgataaagagtccattgtatacgtttccgggtagttaaattagggaacagttttctctg

SEQ ID NO: 2179 - DNA, 1244 bp, Homo sapiens; identical to SEQ ID NO: 2178

SEQ ID NO: 2180 - DNA, 1200 bp, Homo sapiens
tggtgctcacagctgtaatcccagcactttgaggttggctgggagttcaagaccagcctggccaacatgtcagaactactaaaaataaagaaatcagccatgcttggtgctgcacacttgtagttgcagctcctgggaggcagaggtgagggatcacttaacccaggaggcagaggctgcactgagccaggatcacgccactgcactctagcctgggcaacagtgagactgtctcaaaaaaaaaaaaagagacagggtcttcggcacccaggctggagtacagtgccacaatcatggctcactgcagtcttgaactcatggcctcaagcagtcctccctcagcctcccaagtagaggggtttataggcacgagaccctgcacccaacctagagttgccttttttaagcaaagcagtttctagttaatgtagcatcttggactttggggcgtcattcttaagcttgttgtgcccggtaaccatggtcctcttgctctgattaacccttccttcaatgggcttcttcacccagacaccaaggtatgagatggccctgccaagtgtcggcctctcctgttaaacaaaaacattctaaagccattgttcttgcttcatggacaagaggcagccagagagagtgccagggtgccctggtctgagctggcatccccatgtcttctgtgtccgagggcagcatggtttctcgtgcagtgctcagacacagcctgccctagtcctaccagctcacagcagcacctgctctccttggcagctatggccatgacaaccccagagaagcagcttcagggaccgagtcagattctgttttgtctacatgcctctgccgggtgccggtattgaggcacccagggagctgttactggcgtggaaataggtgatgctgctacctctgctgctgcactcacagccacacttgatacacgatgacaccttgcttgtttggaaacatctaaacatctagtagatgacttgcaggctgttggctaccagtttcctgtctgaggtgtatatgttaacttcgtgatcagtttgtatgtttgggactcttgtcctatgtaaagttaaggtgggccgggtgcagtggctcacgcctgtaatcctaacactgggaggccgaggcgggtggatcacctgatggtgaaacctcatctctactgaaaatacaaaaattagctgagtg

SEQ ID NO: 2181 - DNA, 1179 bp, Homo sapiens
tcacagcactctgggaggctgaggcgggcagatcacttgaggtcaggagttccagaccagcctagggaatatagtcagacctcatctctattagaaaaatatatatttttttgccgggtgcggtggctcacgcctgtaatcccagcactttgggaggccgaggccggcggaacatgaggtcaggagatcgagaccatcctggctaacacggtaaaagcccgtctctaccaaaaaatacaaaaaattagccaggcgtggtggcgggcgcctgtagtcccagctactcaggaggctgaggcaggagaatggcgtgaacccgggaggcagagcttgcagtgagccgagattgcgccactgcactccagcctgggcaacagtgcaagactccgtctcaaaaaaaaaaagaaaaaatattttttttaaaaagtaggattgatctcaattcattcaactgctaaatttggagagcgaccctgaccccagattcctgaaagggctttaccacactagccacaacgaggaaatggagcctgtaaaagaatgaggttactgagtgttcacaaatgcacaccaaggctccaagatgagatctcccggggttccagaaagctctgggcatcgttcaatctatcgcctgtcagtgcaggcgtggtcaaggccaagttcaacctgtcatctatcagttcaggtgtggtcacggccaaggttatctgtgactggaaaacagccagcctgacccagatggcacagtgcaggccaggcgggccgtcccacccaactcactgtgggatgctggccaaaccgccctcctcatctcagctttccctcacctcagctttccctcacctcagctttccctcacctcagctttccctcacctcagctctcctcacctcagctttcctcacctcagctttccctcacctcagctttcctcacctcagctttctcttccagccgtgtgtggcagcacaaaaacccagctaaggcaaaatctgactctgaggaaatctgacatgggcttgagagaagtcccctcaaaagagttgagtgagctgtggagtgaaaagccacaatttttcttttttttttttgagacggagtctcactctatcacccaggctagagtgcaacggcaccatcttggctcactgcaacctctgcctcccaggtttaagc

SEQ ID NO: 2182 - DNA, 1242 bp, Homo sapiens
acagggtctgtgcacactcagaaacgttgggtctaggacagcctccaggacacagcagggctgtgccacaaaatggtgagagacgggctcagtggcgtcaagggcctgcctagatcagacacacctcgccttgagagctggaaacaccgtggccgtgaaaccatctctggagggaaggctgcttcacggactgaaggacaggcagcttgcatgctttccctggttcttcctcctggatacttttaaccaaacagggtcatgcttagccagggctgaatatcagagttggtcagaatcaggtcaggaccccagtgtcgtgtactccccatctgagaacgggttggtagtggctggtgtggctgtgtgccgagggtccgtggtccctgcgactctcaggacaccgctgcacgtgacagctctcgcccccggcaaccattgctgtgtgtgccacctggatctgcagggcctggggcagagggtggtccgagttgggacaggtttccaggccaccacaggctctcggggaggctgtgtcctgtggaggcctgggctgggggagaggagccggctgtattgaggtgggtgcttctgtgtgtaggtaccgagcccctgaactgctgttgggaaccaccacgcagaccaccagcatcgacatgtggtgaggagatacggttaccgctcctggggcctcaggaagggctgggacaggagccgggtcacctggttcctgagctcagcctcaggggaggggcaggagtgcagtggggtctttgccagcctcccactcccagggaggtgggcctgagcctggaaacccaggaggaggtgtgagaacttagcttgctgttctcaggctgggagcacagaggtctggaggaggcacgcctgcccctgcacttgtcaccccgggaggcctgcggggcccaggaggggagccagtggtccctgcctgtccttcacagtgtccctgacccagcgtgcctcacactggcagggtcagcaaaggtctggctgcagtcaggtcctctgttcctcgcgctggcggggtcagcagacgtctggccgcagtgaggtccactgttctctgcagggctgtgggctgcatactggccgagctgctggcgcacaggcctcttctccccggcacttccgagatccaccagatcgacttgatcgtgcagctgctgggcacgcccagtgagaacatctggccggtgggcgtcctgggcagacccgcagccc

SEQ ID NO: 2183 - DNA, 1204 bp, Homo sapiens
gagaaggaccctgtgccccaaggcccgtggctcctggcctgctccctgcagtacggagtacggggctcaggacttgggggtcctccacgtgtcccagggattctccacacgagtgtcctcaagggcctgttggtgacaccgagctccccccaccccaagctctgctggagccaatctgcggggctctgccgggtgcacggctgacctggcttcggggacgccggccctccccttgggtgtcacagcagctgggcccacagacaggaaatgacctgacctcaaaccagatgtggaggtgcacgagaggcgcaggaacgggcagtggctgacagctgggaaggccctgagcgtcactgctgctgggcggaagggcctgtggacagcccgcccaggcggcggggtcttggtgggtccagtggtaatggtgcccctcccctccattccctgtgggtgcagcccacaggctggcgaggaggtgcctctgccctaccctcgggtctggcgagggagagggcagggtgcatccactgtgacagcccctctgggcccacaactccctgaccctggaagctgagcctgctttcctgaccctccgccccaccccctcctccccagaacactcagagggacggtcaacatcagagcacattaaacgctggtgaaaccatgtctgttaaaaaagcttttatccaacaagagcctatagcttcgctcagcatcagagccacggcctcctgttgggtcctccatgtggggagcagggatgcagctcagcctccagcccagggctctcctggtagtctcggggtatcctcaattgtggctcccaccccataccttgtccctcttgtcctcatctggagtcctgccaggcccacctggggtccccacagccaacccatgcacgggacagccccgggcgactgagaggggatacgaaggtcttctgggccctctcatcccaggccagcgtccaccacaactcaaagacagcggggggactgcacccaccactcctcccaagaagcagtggttgcacatttccaacatagcgaggaggaccacatgagacccctgcagccacggatggagccgccagacctgcccttccagggtgcacgggctgggagccccccggtgtcacccggcctttttctgggggcagcagtgggttcagggcagacagtgggaggaagtcagtgga

SEQ ID NO: 2184 - DNA, 1118 bp, Homo sapiens
gtctgctaaggctgtgggcccctcatcgaggcccgtcacagcctcgaccctaaacaggcctttagtgctcactcagcttcacttgcaactgcaggcctctgggaagtggccgttttacagagacaaggacgtgctgaggggatcgcctcacccatctcccaccggctgtgtccccaaagtcctgccttcccgtagcttggcatggagcacctctgcgcgaccatggacctgctcacacagcccttctgcgcgccgtgggagctgcctctctgtgactcgcccctggacccaccgccccagcgcctgacccacctccctgctgcccttcacagaaaacttctcatagactcccattttctcatcccgccccgatttagcccccgactccccccggaaactgcccttacccgtccccaccttgccagacacggtgggccactggagttcctctgtcttctgggactttgctctccccaggggatcctctgccactcctccacccaactcctcaatcttggagcgccagagctcagccgagctcaccggctccctagggagctggggcaactgttagctccccctgacctgtgtgatcctacgtccagtggctgccccgacctctgtgatcccacgtccaggggctcccccgacctctgtgatcccacgtccagtggctcccccgacctctgtgctcccacgtccagtggctcccccgacctctgtgctcccacgtccagtggctcccccgacctctgtgctcccacgtccagtgggtccccctgacctctgtgatcccacgtccagtggctccccctgacctctgtgctctatgtccagtggctccccctgacctctgtgatcctttgtgcagcggctgctggcctctcaaacttaatgtgttcattgcggaacttgctattcctctccttgccagtttgctcctgccccatctgcctcctgcaagtctgctctgttccaccttcaggacgcaccccgaggccgtttactgctcccatcctgggtggtctggccactgccatcctcagtcctcacctgaggctccactcccaggctgtcctctccctcaaagctcaaagtctcttcaagtttccctgcac

SEQ ID NO: 2185 - DNA, 1094 bp, Homo sapiens
acagagcgaaactccatctcaaaaaaaaaaaaagacaagaatctgtggttaaggaaatagctttctgaggtttctttaaaaaccatcctgaaatgcacacagctgatgaagccacgtgacagtgtataaagcagtttaaagatcttaataaacgaggccctcataggccccttgcttgggcccactgcatggtgaaccatgtgcagaaatgtcttcccagctgtgatggtttcacattgtcatcgtcgtccccccgggaggttggagcatcaggggcctggactcactggactctcccctctcagaggtgcggaactatatctgtgacgaatgtggacaaaccttcaagcagcggaagcaccttctcgtccaccaaatgcgacattcgggagccaagcctttgcagtaagtgtgagtcaggaccccctcccagggctgtggccctcgcaccttcttatctgcctctgtcccccaggtgtgaggtctgtgggttccagtgcaggcagcgggcatccctcaagtaccacatgaccaaacacaaggctgagactgagctggactttgcctgtgaccagtgtggccggcggtttgagaaggcccacaacctcaatgtacacatgtccatggtgcacccgctgacacagacccaggacaaggccctgcccctggaggcggaaccaccacctgggccaccgagcccctctgtgaccacagagggccaggcggtgaagcccgaacccacctgaggacggcagtgaggatgagcacctctagcagcctggactccgcagtggctgtgtcagcctcacccttcgtgtgcacccgcatgggagggtcggagggtgctgcccgcccttggtgctggaggcgggcttggtgtccggctcaagtagccttcctctgctctgggaccagtggtttattttcccgcaaacgctgagtgactcggggccggacagttcataaataattgattcctttccccactaaagcagtcgaggagatttgtaatccactttttagtgcaacaagagctccatgttatgcttgtaataaattatttacacgggagctgggctggtgtgcagtggcag

SEQ ID NO: 2186 - DNA, 1128 bp, Homo sapiens
gccatcagggaagaggccttcctgcatgttgctgtggacatgtacttgaagctggtccagctcttcgtggctggggatacaagcacagtttcacctccagctggcaggagcctggagctcaagggtcaggcaggtgcaagggccagtcccacctccaggggagctccccccagccggaggctccttctgccaaagaatgttccggcacagcatgcagactatgggggacacaccagccctgtttctgtatgtcttctaacctgtgagtttgcctgttttctctctagggcaaccccgtggaactgataacaaaagctcgtctttttctgctgcagttaatacctcggtgcccgaaaaagagcttctcacacgtggcagaggtaacgtcaagatgcccaccttgggccatgtgggggacatgagaattgacagctgcctgggccatgtgcctgcctggctggcaatacaactcgactatttctgccagagcccctcccctgtggtctgaggcctagtgggcggcatgggctgaggacctgctcctctctcacagctgctggctgatcgtggggactgcgacccagaggtgagcgccgccctccagagcagacagcaggctgcccctgacgctgacctgtcccaggagcctcatctcttctgacgggacctgccactgcacaccagcccagctcccgtgtaaataatttattacaagcataacatggagctcttgttgcactaaaaagtggattacaaatctcctcgactgctttagtggggaaaggaatcaattatttatgaactgtccggccccgagtcactcagcgtttgcgggaaaataaaccactggtcccagagcagaggaaggctacttgagccggacaccaagcccgcctccagcaccaagggcgggcagcaccctccgaccctcccatgcgggtgcacacgaagggtgaggctgacacagccactgcggagtccaggctgctagaggtgctcatcctcactgccgtcctcaggtgggttcgggcttcaccgcctggccctctgtggtcacagaggggctcggtggcccaggtggtggttccgcctccaggggcagggccttgtcctgggtctgtgtcagcg

SEQ ID NO: 2187 - DNA, 1120 bp, Homo sapiens
ggactgaggtcccctgaacgtggggttgtgtgttgtgccctcccaagggctggactgaggtcccctaaacgtggggttgtgtgttgtgccctcccaggggctggactgaggtcccctgaacgtggggtcgtgtattgcgccctcccaggggctggactgaggtcctctgaatgtggggttgtgtgtgtgggctgttgatggtctgtttccacctgagcatttgctcagccactcacagtgaaacttgcgcaatgaagaaacggccgggtcactctctgtttcagtttcagttcctcatgttcagattgttctcagaggcccgacagcctctttctgaggaggacgtagccagcctttcctggagacccttgcaccttccttctgcagactggcagagagctgccctctctctctggacacacagaaccttccgagaggtgttgaaagaggaagatgttcacgtaggtgaccgttccttctcctgcatcatgccacgtcctgagtctagggtttgtgtgtgctcctcgggcaagaacagcagcacgtaggtgaccgttccttcccctgcatcatgccacgtcccgagtctagggtgtgtgtgtgccgactgtctcctcgtctcgagtctagggtgcgtgtgccgactgtctcctcagaggcaagaacagcagcacttagatggtttgattggaatcttgactaaaatcgttgtggcctcatgtgcagctcttaagaaattatacagatactgggcacggtgctcacacctgtgatcccagcactgtgggaggccaaggcgggttgatcacctgaactcaggagttcaagaccagcccgggcaacatagtgaaaccccatctctacaaagaatgcaaaaattagctgggcacagttgtgtgcacctttggttccagctacttgggaggctgaggcaagagaaatcacttgagcccaggaggtggaggttgcagtgagccaagatcacgccactctattccagccaggatgacacagcaagaccctgtctcaaaaaaatatattaataaatacagagaaaccctgctatactttctcagtttctcccaacacgaacttctttttttatttttactgatatatt

SEQ ID NO: 2188 - DNA, 1639 bp, Homo sapiens
ctctttagaatatgcgacagaggctgtttctggccccaaaacctaaaatatttttctggccccttacacacaaggtttgccagtcccgcctgctgctgtagaattttgtgattggcgattacttgagggctgctattcccaagattggggaatgggggccctgggcaccagtttgcattgtaacatgccctccaaacaagcctgttttggaggtctttttgcaaagcagaattgcgatgtctgtggcgggagcgctggccggcttccttcctgctgctcccgtccccaggacaccacgctcatgagaactgtgtctctgcaggctgtggacctcctgctgacgtctttctgtcagaacctgatggctgcctccagtgtcgctcccccggagaggtgaaggcgcgggcagctccctgagtggtggggctcctctgggtgccacctcttgctgggccaagtctgcagaccagggactcatgagctcgtctccgcaggagcatgcggcgatgctgagtttcatcaaataggacgcagcagaagttgggaagcactgcagaagatgggttgtcttccagaaagaccactgttttggggaacagcttggctctttcttcggccgctggtggttggattagctgttggagggatgtgcaggactgaatggctagtactgatggtttcacggctgtctctgcaggcagggtccctgggctgccctcttcgtgaggaccatgtgtggacgtgtgctccctgcagtgctcacccggctctgccagctgctccgtcaccaggtgaggctctccttcatgggggccacccttgggggcccactctgagggccaggctgctacttctcaattcgtcttcagtgccctggaaaattccagcttggaagagggcagtctgctctgccaccctcattctcgttgcagggcccgagcctgagtgccccacatgtgctggggttggctgccctggccgtgcacctgggtgagtccaggtctgcgctcccagaggtggatgtgggtcctcctgcacctggtgctggccttcctgtccctgcgctctttgacagcctcctgacctgtaggacgagggattccttgttcttctgcctgaagtgagctcttcttccacagtcgcgtcttctctcctctctctcgaaaagtgacacatgctcgtttgataaaattagaagagacagacatgcagacataccacccaaagataaccactttttagcattttggtatatatccttccagaattttatctgtcatttgtttataatatgcgtgcgtttgtttctttgttcataaaaatgagatcatattatactaaactgctgaaattaatagtagatagtaactgtctatatcgttaagcattctttgatgtcctggtgagagctgctttgttttgtcttggtcccttgtctggcccttggttggaccagctccctctggtcaggttcttcggcaccccatggtgagtagcttcccagtgtgtacacctcgggctgtttctctagggctcagcagatggggccatgtgctgaggtgaggaaggaccctgtggttaagaatggtctgctcagtgcctcaagggctccctgcagctgccacgcacaggcagaagc

SEQ ID NO: 2189 - DNA, 1129 bp, Homo sapiens
ggcaggagctcgtctggttttgcaggtaagcggttcagtgttcacagaggcccacattctgtctgcaggttcactatgatgcgttcagggccatgcccatttaaaatctccttccttccctgactcactgcagcccccaggactttgctgcagcccccttcgttcctgggagggtttgctcatgttcctcgcttgctctgctagggtcttgcagcttcattgtctgaggggtggccctccttggcctgtgttccttacccacctctcttgcagtgatctgtccactggtggatgaggttagaagttaaagtgtgttcagaagtggcttcatcccacaaaatcaatttgtttgctgtgcacaaacacttcttagggcatttagcaaattgtacccctaaggatcccaaaaggatcccatagttagtgtttgttatagctaatgatttttaactgtttttcttcgaataacttttagatatctcttcagtcaaagcgcagtcgtgacatctgtaaatgtatgaaccacatgactttttggtgtttctcttttttcctttctgtttaggaggccgactacagcagccgcccggacactgcctaggtgggcttcacactcttctctccacacaggacactgcctaggtggtgcagctgcgcctggctgtcctgggcttcacgctcttctctccacacaggacactgcctaggtggtgcagccgcgcctggctgtcctgggcttcacgctcttctctccacacaggcctcctttgggagcacacgaggctaccatggctgcagcaagaaggccctggtcttcctgtttacgttcttgtcagaactcgtgccttttgagtctccccggtacctgcaggtgagaagctggctgccacatccatgatttctggtgcttcgctcacctgctgcatctgaggactgccttggcctccccaagagcctcctgcagatctgctctgagcctctcagccaggcccttccccttccccttccccttccccaagccgtttatggtgaaacaacacaaacattgcaactggaggtgtccacgtggacacacagtgagtgcgtgtgtgccagtcaaggcaactgctaagaaacccttttctcacct

SEQ ID NO: 2190 - DNA, 1195 bp, Homo sapiens
aggctgctgctttccattcctctttcttggggcttagtggggagttaggtggcccctggcctgggcatgtcaggttctgagttcttgctttaagtcatataattggttcagcttagcaataataactagcctattttgagttggggggacgttgtgagtgtcgacccggtaattcccccgtttttgtttttgtttttggagtcggaatctcactctgtcgcctaagctagagtgcattggcgcagtctcggcccgggttcaagcgattcgcctgcctcagccttccgagtaactggaattacaggcacacgccaccacacccggctaatttttgtatttttattagagaccaggttttgccacgttggccaggctggtcttgaactcctgatatcaagtgatcctcctgcctcagcctcccaaagtggtgggattacaggcgtgagccactgcgcccagcctccgctggttttaaatgtctgaaaaaaaggcatgcctgggagctggggccttgctgagtgcctttcctccagggctgtcctcccttctggtaggttctgctccagacgagcccttaccacgttgactcactcctgcagctcagcgatgcctgccgctttcaagaggatcaggagatggctcgagacctcgtaggtaaggcagagcccccaccccattcccctcagctgtgggagcacctcaagctatcaagacagatgcgatggtgtaagatgacaggggttgccaggatatccatgacagctttattgagatacaacctacgtagcacaaaacttacccatttaaagtttttgtttgttggtgtttaatatatgccacagcctcccgagtagctgggactacaggcgcccgccaccagacctggctaattttttgtatttttagtagagatggggtttcaccgtgttggccaggatggtctcgatctcctgaccttgtgatccacccacctcagcctcccaaagtgctgggattacaggcatgagccaccacgccccgccctctggcttttatttacaatgaagttttcaaggttcatcctcactgtagcgtcgatcagaacgtcgttcgtttttatggcttagtaatactccactgtgtggacggaccacatgttgtgtatccatcattagttgacggccgtgtgggctgttgtaaataatagtgcttacgt

SEQ ID NO: 2191 - DNA, 1206 bp, Homo sapiens
aaaatggggctgcagaagaatgttgatgatggtgtttaaggtcacaaaactgtgagtctgtgatcccattttgatagaaaaaaatgcagtgagtcacatgtctacaatatgtgacataggctgagaaaggcaagagaaactggcacggtggtagactgctcggaaactcgcgtggcgggctgctctcggaaactcgcgcggcagtgggctgctctcacagactcgcgcgggggtgggctgctctcgtctgtaaattttccacattgagagcaccaactgctcagcttcagagaggagcctgggcggcaggtgggaccctcactccccacggtgtcctcgctccggctcagtctacttctcaggccctcccacgtcctctgtatcttctgcatgcggaaagccccccaggtggacgttttaagttatctttatgctgagttaggaagaggcccttgcgttgcctgcagaatatacctgctcggggtagggctcactggtgatgtcagagcgtctgcaaactcacatattttgtctttatgacttaaggctccacgctctgtttcttcgtccctcgtaggctcatcggaacctgtcccagctccctaattttgccttctctgttccactggcgtatttcctgctgagccagcagacagacctccctgagtgtgagcagagctctgccaggcagaaggcctctctcctgatacagcaggcgctcaccatgttccctggaggtgagtgagcgctgtgtctcgcctggggtaggggtgtgtcctgtcagccgtgggggctgctcttcctggtggtggaggccaggtcccagtccttccccacacttgtagaaacatgcattctctggtagggcctgcaaacctgccctaccaaacctgaaagagggtcggctcatctcggaacccgctgcgtgccaagccaggcacgaggaggtggcaggcatcccgacccccgtggggcctgtgttctagagtgcagagacagaactggctgggaggtgcggggcattggattgtaccagtgctggggaggagagcaaagcaggggaaggtctcggcagcgccgaggtgtggccgagagggttgtgctctgcaccatgctgggatgcagaatggaggcctgtgccgcccagatggactcagcctgcacagccgtgacccctgactgcatctgggtagcttcgatccacgc

SEQ ID NO: 2192 - DNA, 1406 bp, Homo sapiens
cgcagctcccagctctctcctgcagctctgaggtcagggctttggggctcacagggactggctgcctctttcagacccagatgctgagagatggggctcagggctaagtgggtctttcccctcacaggaagggagaggaggagaggaacagtgttatttgggggtcacagctctgcgtttgcaggccacgttctttcccatctccaccgaatgtacaagcgcttgcgtgtcggcctctgtggcaggtgcgagtgacacagtggaagcaggtgtgcagtgaagtggggaaaacatattaattttagaatgtagaaataaacataaaatcaaaactgcaccagcctggccaacatggcaaaccccgtctcaactaaaaatacaaaacttagccagctgggtgcagtgactcacgcctgtaattccagcagtttgagaggccaaggtgggcaaatcacaaggtcaagagattgagaccagcctggccaacgtgctgaaaacccgtctctactaaaatacaaaaaaattagctgggcgtggtgccgcacacctgtagtcccagctacttgggaggctgaggcaggaaaattgtttgaacccgggaggcacaggttgcagtgagtggagatcgtgccactgcactccatcctggcgacagaggaagactccgtctcaaaaaaaaaaaaaaaaaaaaaaattgggcgtggtgggttgtgcctgtagtcccagctactcaggaggctgaggcaggagaatcccttgaacccggaaggagggggttgccgtgagctgagatcacgccactgcactccagcctgggtgacagagtgactccatctcaaaaaaaaaaaaaaaaaaaatcctccagtaaggtgtttggaggaaggatggtggctgtgctgagacggagaggatgaatgtgccctcaccaggctcaggggagagggtccttgtgttccccagcagagtcacgatgtgccgaggccctgtgccaggagcagagcacacggcacattgagagaacaaaagccccatggccagaccgggagagcagggctgcggcgcaagagggccaactgccaggcggccggtgtgtctggctttcagaatccgggtcattgaaaggctttttaccttttccttctgggctggaaagtacttgccttacccaggccccgtcacccgcacagcggtcgtcgtgattatccctgccggcagggtgttgcagcattgaggaatcgcggttctttgctgcctccctccgctgtggagcccaggctttcgccctccctagagctcctgaggcctggccgctcagcgtcctgtagagccgggccggtagcccttcgcaccgtgagggtctccgcttaacgcaggccctggaagcttctgcctttgcgtaaggagtg

SEQ ID NO: 2193 - DNA, 1419 bp, Homo sapiens
ctccctgggagactggggaggtgctggcatcgggtggccgcctctgactctgtgacccacccacagtcatcaggtaataagagaaggaggtgggactggggcccactcacgttccctgtgtcttccccgtgcctccctgttggggtccacgggcagcctgtccatgggtgctttgtcctttcaggctggcgtgcaggtgcccaacccacactcctgccccacaggcacaacaggcaggacaggccccataggtggtgtggagtcttgcccagttgcagggcagccatgtggggttggggtggcctccttatcccactgccagtgaggcaattagttcaaatcccagttcttccaggccacagtgtgaccctgagcagggccgtcccctctgggctcagctctctttcttttgggagaagagacagaggataaatcataggattgattattataattgtgaattatttcagactgtagcaggtgtagtgaaagcataactaacactgtagcaggtgtagtgaaagcataactaacactgttgcagttactgaacaactttaaaaagacatctccgactttctataacatcaacagaccttacagcgagcttactttgtgctcagtctctgttaactcatttcaccctcacaatggcccattacggatggggaaatggaggcagagaggctaaggaatgtggcccaggaagttaagtgggagggctggatgccaactgcctctactcccaccccaaccaaagtcccttcctccctgccaggagccatcagccctgtgtgttctgcagtgttctgagcctccgggtggggaaagagcaattcttgatcctgagcttctgccacgtggagaactaggcccttccggcctgtttcctgggttcctgaggcacagagccgtgggcctggttcaggtcgtgttgctcatcacaggatcagaacccaggccagagagcctggatgcatttgtagggggcttctctgtgtgctggcagggaatcctcccaagatcccctgctcctgggcatggggaaggtgggccctgctcactcacctgtggcagagcaggaatgggccctggaactgtccccaagtgtccaaccctaagtcctgagacaggggctgtggtttcagggtgctctgacaagaaagcacctttgcttggggcccaggaaggaggaacccatttctgagaggtgtgtctcacatagcaggtggatagcaagctagagcggggctgagtgagtatctggggctgaggcccagagaggatcccataggtagctctagggctggagctctgcaacattgggcaagaggaccctgtgctgggaggcagggagcttgggcccctcagatgggccacgtgccctcgtgggaccctcattgtcaccgtgagctcttt

SEQ ID NO: 2194 - DNA, 1205 bp, Homo sapiens
aagtcagccaccaagctgaatacgaactgaacatctgccctgagacagggctggacagccaggattaccgctgtgccgagtgccgggcgcccatctctctgcgtgagtggtggcagggagagaagagggtgagggagctgttcctggcggggagccgggtgcacaggtgtgtaagggcacgtaagtcagacagttgagtgaggccctggggcagtgcctgcttgatatctttaggaagtgacaagggtctgttgctgccattgtttcatttctcactgaagcagactgaggttccagccgttccgtgactcacccaggtcactgaggagcacctggagggctgggacctggcctccgcctccccgtgtgaaagcctcatagatgaggactagggagaagtcacacagcacagaaagcctcatagacggggtctagggagagtacacggttgtcgcccagttgtgcacatgtgcgcgtcagctcttctttctagagagttgctggtgttaattcatgaagtccctgcctcggtcctacagtgaggccctgtttatatcccattttactgataagagaacaggtcagtgagacgctgggaccacctgaggtcttccggctgaggataggacatgttcccatgtctccccgagggctgtggtccatgggaggacagaccatgaggctggaaagctgtgtggggtttttgtgaggcagggacactcagggcccctctgaccctgcagggggtgtgcccagtgaggccaggcagtgcgactacaccggccagtactactgcagccactgccactggaacgacctggctgtgatccctgcacgcgttgtacacaactgggactttgagcctcgaaaggtgggggttggaaggtgggggcatccccctggggagggagagcaggaagggggttggggtgtggagccggtgtacccctggttgggtgttgcccgctgcacgggccctgggtgggtgtgagaggtgtcacccggccgtgcctggcaggtttctcgctgcagcatgcgctacctggcgctgatggtgtctcggcccgtactcaggctccgggagatcaaccctctgctgttcagctacgtggaggagctggtggagattcgcgtgaggctggggccatggaagtggggggcgggggcgctgtgtcaggtgggccctagggccgggccagtaccct

SEQ ID NO: 2195 - DNA, 1165 bp, Homo sapiens
cctgacacacaccctgggggcagctctctgccagccccgagaccggccttgtctgctgggcacgggtcttcgcctcacttggagaccagccggctttcctgggggacacacggggcccccggatgcctctgggagccccagcacaagcacagcccagtggccttacgtccagctcgttcctgggccccgagtcaggaagacagcgtcacggagtcactgccaggaacgtgctgaggaatggagtggcccacggcggccttggggtgaaggggacccaggcctgtgacagccactccaggaactcctgggggtgctccaacctccgcgttttcctgtgctgccaagctcagaagccagaggcgggtttggtagtggctaatgggacaatgtgctgtccagcaaagcacacatggagaagcggccccaaaattcccaccttgatttccatcctgccccttcttctactccacggaggcgctgtctcactagggtcccctccccaaggctcagctctaagacctgcacctgcttctcttggcccctgcgtgacagacaagtccattccctccttagctcagaacaccaaatatcaccagactgcctaagagacttgatgacacctcccggaatgctctcggggtggggttcacctctccttgtcctgcacccactgctaggccacattctcgtttctgctcacatcccattgcccggctacaaggcctgcccacggcccttaaacttgctgggcaggtttggagcccatgggaccccgtgggtctctgtccaggagcagcagaggaggctgacaggccctgctccctctgctctgggggtgtctgggagccccagctcacaccctcccaatgcttatatgctgaagctcacagaatgggcttcttgcctgacagcaagtcaaagaatgagtttaatatcaaagtgtaagcttactttccatccccaagccagcctgccccctgccccatttcccatgagcacacttctggggaaggaaaacaggctcctggccttcactctcagcagagctttggagatgccccaggcatgccctgagctccttctgtgtacctgctcccacttctgagccacccgctgcccctccgcactgctggcaaacccagttcctgcctcagccaggtctcct

SEQ ID NO: 2196 - DNA, 1247 bp, Homo sapiens
gttcacaccattctcctgcctcagcctcccgagtagctgggactacaggcacctgccaccacgcctggctaattttttttttgtatttttagtagagacggggtttcaccgtgttagccaggatggtctcgatctcctgacctcgtgatccactcgcctcggcctcccaaagtgctgggattacaggcatgagccaccacgcctggccagtcattcattgtttttgataaaagtcccaacaaggagtaacagcatcagggctgcctttttcttgttgcttattttggggaggaggtgatgtttttatagtttctttgtaggagttagtttaagtctcttcttcatttggatgtagttaagggctacagaacataattacataattacaattttacctaaaaggctcctggagacggcagtgtgtggcaagcacggtgcaccctctggcctctgccctcatggacgactgcctgtgagcacctgacatgggacatgagggctgtgtcaactctgtgttattgttaataaatcttaccttcttttgatagttgtaagataaaaaatcaatacgaaggagactgaaagagtctcatgacctgaagttggagctaggcagaggtccttgaacaatggtaaagaatggctttattttacatgcaggcaaaccattggcagtttaagccagtggctaagcagagaggtgatggggtcaggtttgtgttctggaaagatgtctggagctgctggatggagaatggattgaacactgcgttgtcccagcatgtgagctgctgcccgtctccctgtccgcttcccattcctgtggagacaggccttgtggggcagtggccatggagcctacggggcagcctacggggcaggctacggggcagcttacggggcaggctatggggcagcctacggggcaggctacggggcaggcccttgcactgcacatcgcacgttgagccacagactcagaaggcttcttcagggtccaggcaggtggggagggatgggggtgacctggagactcctgccccgcagcagaggacagtttcatctgttcactggggagtgccttgtgggcctaggagttcagtgctgtttttttctgattttccaagagaagctggaaatctggatatttataagaaatctgaatattgagtgatggcaaaatctcaacaccatgtgagccaaacagaccagtcaggagccctggttcaggctctgcccaggagcct

SEQ ID NO: 2197 - DNA, 1176 bp, Homo sapiens
aacatacagatgtctacaaaaataaaaatttgcaaggtgtggtggcatgcacctgtagtcccaactgctagggaggctgaggtgggcagattgcttgagctcaggagtttgagaccagtctgggcaacctggcaaaaccaaaaatacaaaaaattggctgggtgtggtggctcatgcctgtaatcacagcactttgggaggctgaggcaggtggatcacctgaggtcaggaattcgagaccagcctgcccaacatggcgaaaccctgtctcaactaaaaataaaaaaaattagccgggtgtcatggcgagtgcctgtaatcccagctactggggaggctgaggcaggagaatcacttaaacccgggaggtggaggctgcagtgagccaagatttcaccactgcactccagcctgggtgacagagcaagaccccttctcaaaaagttttcaggatagaggaaatttccttaaaatccataaaacttgtaacagccgtacagtaggaataaggtttggaaatctgcctggaaacctgatttcctcatccccaccttgtttcccaacataaccactgctctgtgcccctgccctctctgccaggctttctccccgatgccgtccagctctgatcctgagtgtcatttcttcatcggcttccaggctgtccttgctagctggtttgactctcacgcatcaagcgtctcaaatttgagaatgcggaggagaaaagaagtgttgcgagaaggagatgcggccttcagttgaggtctattaggaaaagattccaaataagacaagggcggggggcggcagtcgggagagcccccaggaagccctgtagatgcccccaccccagcccatggagttgctatggttaagcagcctgagccgtacagttgaaaaggggcggtggggcccatctccaaatagcacagccagttcagccgtctgtcctcaacccaggagagctgggaaagccagtggactcctgcacctggttcttgtcactcctggcgtttgtgtacagatcaccacttctctttttggttcattgttgaggagtcgttttccggacggctccatcacagcattgagctatcaagctgctgttttccacagttggtggtcacagccagggaagttgctgtcttgatttgttacattgtcagtaatccc

SEQ ID NO: 2198 - DNA, 1164 bp, Homo sapiens
ctttcccttcctttaccttttcttcccctctcttttcctcccacgctactacccaggggatggtgagtcccttgaggaaacggttcatcctcagcctggagtaactatgctgtctccagagcctctgctgaccccatatccagatactgcgctgtcccccgtgggccattctggcccagacttcgtgacggttctgtttctctctcaacctcaggggctgaagaggagtgagcagagcagcatgctggaactcctgcgccagcggctccccgcaccgccctcgggggcagaaagctccggctcactgtccctgacggcgccaacaccagagcaagagtcgtcacgcatccgcaagctcgagaaactcattaaaaagagactgtagcagcagcaaggggccctttgctcctggctggagaccctcagcgcccgttccccagaagcccccaacctctcctgtgctccccggcactctcacatcgtcggtcttcaaacttcctgggacatgtgggttgttactgagtctctcccatgccctgtcttacttcctgccctaatcggagacgctgagtaagggctgggctctaagagggcgatttaggtgatctctggttcgtgaagcagaggcagcagtggaggataggtccctgagctgcccttgactcatgtagcctccccatggcagtcacaccctcttgacacgtgggccccacccgtcctttttttttttttttttttttttttttgagacagagtctcgctctgtcacccaggctggagtgcagtggcgtgatctcggctcactgcaacctccgcctcccaggttcaagcaattctcctgcctcagcctcctgagtatcggattacaggcgtgagccaccgagcccagccccttcctccatttctttactcccaccctgctcctggtttctagggaagggaaaccaggaagttcacttggaagacgtttcctaggttttctcatcagatgaagccatgggaacgcccaggaagtccatactctcaaacccctttctgcccactcaccttcaggtccacagcactttccagcgtcatctgaaatagcaaaggtgatgtgcagcatcccagtgatgtgttcctgtgttatgagaaggagtctggggttctggatgcctcaggaac

SEQ ID NO: 2199 - DNA, 1147 bp, Homo sapiens
agaccaggcacagtgttttcacgcctataatgtcaggactttgggaggccaaggcgggaggatcacctgaggtcaggagttcaagaccagcctggccaacatggtgaaaccccatctctactaaaaatacaaaaattagcctggcgtggtggcgggcacctgtaatcccagctactagggaggctgaggcaggagaatcacttgaactcgggaggcggagcttgcagtgagctgagatcactccagtgcactccagcttgagtgaccgagtgagactctgtttaaaaaaaaaaaaaaaataggtattgagacatcacttctcctcacaatcctaaaatattgcaagaagcaatcacctaaattcacaggtaattcgctaacccttctgaagagccagaggctgcaggaaagggaacaagataggttgggtcgggcaaggagggatgtttttctccatctttgtttacgagtctaattaattctcttggagataaccctcccccgcccccccaaaaaaagattacttggaaattgggctgagatttttcttgtaaagtgggtttacagcttctgacatggtaactgtactaggggactgttgatgtgtgtttctcgctgtttttgtgcctctgggaaggaaggacaggtgtgtgcaaaatgtttatagaccaaagaaaagatgctgctgctgtttgaggatgatctagtctcttaaagtaactggaatagcaataactggcatttgcataggactatacagaacacttcccagccgggcacggtggctcacgcctgtaatcccagcctgactttgggaggctgaggtgggcggatcacctgaggtcaggagttcgagaccagactggccaacataatgaaacccgatttccactaaaaaaaaaaaaaagttgtccgggtgtggtggtgggtgcctgtagtcccagctactcgggaggctgaggcaggagaatcacttgaacccgggaggtggaggttgcagggagccgagattgcagtgctgcactccagcctgggtgacagagtgagactgtctcaaaaaaaaaaaaaacccagaaaccaaaaaaaccccaaaacacttccttctgcattataatacatgagcctcgagacagccttgtgaggaagt

SEQ ID NO: 2200 - DNA, 1195 bp, Homo sapiens
gggcaatttttttgacaccttcatcaaatccccttgtatgcttgtaaaagtcattggtttgaaaagtttaaaaatatacctcatgccgggcgcggtggctcatgcctgtaatcccagcactttgggaggctgagctgggcggatcacgaggtcgggagatcgagaccatcctggctaacacagtgaaaccccgtctctactaaaaatacaaaaaaaattagccaggcgtggtggtgggcgcctgtagtcccagctactcaggaggctgaggcaggagcatggcgtgaacccgggaggcggagcttgcagtgagccgagatcgcaccactgcactccagcctgggtgacagagcgagactccatctcaaaaaagtatatagatatatatatatagatatatggatatacctcataaccgttttacagttcagtaatgtgatagattcccaaggctcaagctatgaaatgaatgactaaacttaatgatcatttatctaaacacaataatagcatttattgagcactcaccacatgccaggcacgtgtatattatctcgcgtagcctttacacaataaggcaggtgctgttatcacaaatggaaaaggaacgtgtggtacagagatgtacagcgccttgcacaaggacacacagctaataaacggcagagcgggggcgtgaactcaagcagaaggacaaaagactctatatttttagccatgtattagactgccttattatgcagagaaaaaacaaagagattaaaaaatatattacaaatgatggaacaagaaaaagcctctcaaggaacattgctcttattactttatttttatttatttatttatttatttatttatttaatacagggtcttgctgtgttgtcctggctggagtgtagtgacacaaacatggctcactgcagcctccacctcctgggtttaagcaatcctcctgcctcagcctcccgagtagctgggaccacaggtacccaccactgtgaccagctaattgttattttttgcaaagacaatgtttcaccatgttgcccaggctggtctcaaactcctaggctcaagtgatccccccaccttggcctcccaaagtgctgaattacaggtgtgagccatcacacccggcctgctcctaactggactgttgtcctttattactaaaagactggcccaagtcctagaa

SEQ ID NO: 2201 - DNA, 1197 bp, Homo sapiens
ccctcacaacagccttggaaaagatgagcgccagggctgtcagtacccatcggttcagtaagcgaggcattgtccacgctgcctattcactcgagagatgaatagtttcctgttttcgatggctggggagccagtatgagctcataaaccaaacagcaattttcagagacatctgttcctgatcttcagaataaactcagtgtccagttgcttcggctggtgggagccaatattcacgccactgactctctcaaagggagggtgggccctcggagacccagcttctctgacaagcagattagaccaaaaggctgcctcaaagatatgccactttgaaggaaagcgtagagaagcgtttacataaaagaagacgcttcctgttcagtggacaacttcatgccactttcaaggcacaccgatggccaggtgggacatttgtactgtagcagcacatggcaaaggtgagccagaagcagcctggatgctggctgatccggaggcctttgtgaagagcaaggagagggctccagcccacctccccgcagctctgccccagcccccgtgggccacagggaggctcaaggggagtgaactaggtaaacagattcctggaaactcacatctggatgcagctggaagagttaaatatttacattggtggcttccctggaccaccgcgaacacaaacatccacaccacagggctgagttttgtgcaaatgatggggctttgcattttttattaacattttcctctcacgtggtttacatcaatttataataatctacataagttgaaacagaacatagacaaaaaaatatatccttaccaacttattaaagtcagatattcatgaagggtcccatcctacctgtgtatcagcagaaactggcagccatcagccattgcccagcaagaacaggcagacctggcgtttcttagcctgactcctgctgggcacagcccaccctgctgggcacagtgactggaggttccaggctgcacagtccctggctcctgactcctgccgggcgcagtgactggaggtttcgggctgcatggtccccggctcacaggagaccctgctgggtgtttccttggtgcagtttagtccaggtctggcacctgaccctccccactctgggggtgggatttataaatatgagcctttgcatttctcagcctttgcagccttcc

SEQ ID NO: 2202 - DNA, 1177 bp, Homo sapiens
tagttgtgtctgatgctccgtgctgttcgggaattgttttatgtacacttgtcaggcagaaaaggtagtgaccggcccggcgtgggcacacagacagcccgctttgttctttcatttcctccagcactttctttccgcctgagtccagcccaaggccttttattttgcgctgtgtaactgctgccagcttctctcttggccctgctcccagatggcggtctcctggcagcctcccctcagtcttcctccacccgctcttccttcccagcctgcctgcatgcatgtgcacccttggtcttcgctccatcgccttgaaagctctgaagaggccctgggttgccgcggcagcagtggtctgtttgatgctgccgtttgccgctgccggcccctcctcagactccgcctttgggagcacacctgctttgccttgctgcctgtgcaaatgttggacaagcagacacactcacactcgtccccagcttagcacagagctggagcgcccatttctggaattttccgtttgggaatctccacttctggggtttacctgttcggcctcctgtctatcagtgaggcatctctgactgtttcttctactgcttttcagttcccttccctgctgttctatttcctttgagtgtaaagactcacaggtgacctgctatcgagatagccagagggtcaggagagaatgggggaggaggcggtcaggctgctgaggaaacaccacaggctgaacgggggaggaatgcacatgccacgctgggtgtcccgggtcgcggggaggcagctcagctcttaggagcaagttgtgggggcttttcaagaggggccaggcttcctggagggtgactgatgtggccgaagcaggtgtccaggcaggtaggctgcagccaggagctccctggcaccgcaggacctcgtggtactcttgccttagattttacacacactccacagccaagcactgccacggtcctccaggacctgggaagcaaaggcacaggcccacggtggccagccattgtggtgccgccccagcttctggatacagccttttgggtaaacactgggaactccagaagttgtggggagagtggggaatcagacagccgcctctaggggctgggttctgctggggcctccttgttggtgctgtaggcacccgccagggagc

SEQ ID NO: 2203 - DNA, 1202 bp, Homo sapiens
atgactgtggccaggagaagagggggcagccagggccctctcccctgctgtgctggctctgattttttttttttttttttttttttgaggcggagtctcactctgtcacccaggctggagtgcagtggtgcgatctcggctcactgcaacctctgcctcctgggttcaagcaattctcctgcctcagcctcccgagtagctgggactacaggcgcccgccaccacgcccagctaatttttatatttttactagagatggggtttcaccacgttgcccaggctggtctcgaacttctgacctcaagagatcccccgcctcggcctcccaaagtgctgggatttcaggcatgagccgccgtgcccggcctgactctgatttgtagttcagattttgcgggaattaggcaggtccctgagtgcccaccctttggatggggactgagcactccccggtggccacacatcaggccccagagccgctcccctcaactcaccgcctcacccttcccaggacctgctgaagcacacacctgtggaccaccccgactacccgctgctgcaggatgccctccgcatctcccagaacttcctgtccagcatcaacgaggacatcgacccccgccggactgcagtgacaacgcccaagggggaggtgagctcagagcccggcacggcccctcacccaggctgagaagtatcaggtccctcgtccccttctctcacacacgggcggcaggtccctcgtccccttctctcacacacgggcggcaggtccctcgtccccttctctcacacacgggcggcaggtccctcgtccccttctctcacacacgggcggcaggtccctcgtccccttctctcacacacgggcggcaggtccctcgtccccttctctcacacacgggcggcaccgggtgcctcctgcctctccaatcctgatcccccattcccagccaaggagaggttttcagcccttggtcaccctgatgacctgcagctttccaggccctaggctgagaagtttaagtccagtgtctcattaatcctcataataatctagggaggccgggcacggtggctcacacctgtaatcccagcactttgggaggctgaggcaggtggatcacttgagttagaagtttgagaccagcctggccaacatggtgaagccccgtctttactaaaaatacaaaaattagctg

SEQ ID NO: 2204 - DNA, 1747 bp, Homo sapiens
cagcagaaccccacaataaaatacgatagaacttcttggcaacagtttattgctcagttaactattttgaagcatttctgataattagcttgtgggtaaattagattttgcaaaaagtttgcaaaatactcttgattcttgaagaggtgaggttattgagaaagagtattttgacccaagatttatgtgaaagcttgaatgtcattttagtaagatggtttccttggctgtctacgtcaagagcttatttagcgtaaaaacattgagttgtactgcgcatcagtttttttcattctgttgaccaataaatactttcaggaccataatcccttcttggcttaggcatctcaggtgtcaaggatgatagaagtcctttgcctgcgtttaataccaattgtagcaagtagaagagtctttatgcttggaatgacacctttgtttgtggctgccatagcctaatgtagtcaatacgaaataattgactttttttcttttttaacaggtgaagagcagaataaagaagcgctgcaggacgtggaagacgaaaatcagtgagacataagccaacaagagaaaccatctctgaccaccccctcctccccatcccaccctttggaaactccccattgtcactgagaaccaccaaatctgacttttacatttggtctcagaatttaggttcctgccctgttggttttttttttttttttttaaacagttttcaaaagttcttaaaggcaagagtgaatttctgtggattttactggtcccagcttttaggttctttaagacactaacaggactacatagaggctttttcagcattactgtgtcgtctccgtgccagatgtggcaagatcaccattagcaaatggaaattacatttgaaagccattagacttataggtgatgcaagcatctaagagagaggttaatcacactatagaggcataagtggtatcagttttcatttttctaattgtttaaactgtgttttataccagtgtttgcaagtaattgggtgttagcttgagatggttaaaggtggtttggggagggacttcgttgtaatggttttgctgtaaaaaatgtttccaactccgctgaaatgttgctgaaaagcatggtgctggtaacagttcaacaatccgtggctgctcattcttgcctactttactctcccactgaagcaggttagcgttgaaggtggtatggaaaagcctgcatgcctgttcaattcttttgtttcttctccttccccctccccctacctccttcccctcactcctcccctccttcgctcgctcaacctcttttgttcagtatgtgtaacttgaagctaatttgtactactggatatctgactggagccacagatacagaatctgtattgttcttactgaaacacagcatggaattaacattaaacttaaataaaacaaacctaaattaaaaatgccaaatatcgcgcctccatcctttatacttctaaaataaaatctctagtccaaacacactgacagtattatgtttgcctgaatgtgaaacattcctccttttttcttccataaataatttgtttgcttcccaaagatgtatgttttggaaaaaaattgcctgtagtctggttgtgaagaacactgagtcagttgatggtgtgtcttgtcctccagaccaggcagcaacatggtatttattttaatcattaaagtacaacatgagtagtacaaggtgtaattatggatca

SEQ ID NO: 2205 - DNA, 1178 bp, Homo sapiens
gctgggggtggtggcgggggcctgaaatcccagctactcgagaggctgaggcagcagaatcacttgaacccgggaaggcggacgttgtggtaacccgagatcgcaccactgcactccagcctggggaacaagagggaaactccgtctcaaaaagaaaaaagaaaaaagaaaaaagaaaagaaaaccagggcgcggtagtgacagcctcagatttcgggaaagaagacctgccatgacagaaaccgttacagcctccgtcgttcttttccgcaggtcgggcctcgggccccggtctgacccaggtctctcgctggcttttttcaggagcagtcccggccggccccgcctcagcccttctcgttccccgggggccgctccctttcggcagtcgcagttcccgcctctgggctccggcgcccgctgagccgacagaggagaggcgtctcgtgcgctcgttccagccgcttcgggcgccgagttccaggacccgccccccgcgccagttgccagggagcggttgccatagagctgagcagttgtccgcgtgcgcaggcggaagtcccggattgaggcgccgccatttttgctgcccggacgcggagcgagaggctgagagagtcggagacactatccgcttccatccgtcgcgcagaccctgccggagccgctgccgctatggatgatcgagaggatctggtgtaccaggcgaagctggccgagcaggctgagcgatacgacggtgagttgggggggcaacggggggctggaattctcggaccctctgccgccgcccacagaggccgggaacaggagacaaaatggcggcatcgtctgcgagcctggcccgggggcttgggttcgggaagcaggaaatggcctgggagctcccggggcgatgggaggctctatgccctggaatgtgaccccttcgccgtccttaactgcaaacaactcgcgggccgggaggccggggcgacggggtggaggagttggttgtaaaatggcggctggggggagggcgagtcccggggcgggggagggggaggagatggcgggtgctgtctccgaacgagccaccctcatgggagcttctgggacggccttgggatgtggagaacaattgggtggggtgacgggggaagcagcacccgccacatgggagagagcgaagaccggga

SEQ ID NO: 2206 - DNA, 1338 bp, Homo sapiens
ggaaaaaacaaggacgaaaagaaaagtctgagtaccggggcccccgtctgctcccctcaccacttggccgtctctctccgcccccacaggtcgccccacggctgaattctcggtgataaaggcgcccactggaccctcccaacgcccaatgctttgcttttctcctcctccccttcccagttaccaaagactcgaacttccagacagggacccagggacaccccgaagcccacctgcaatctcccacctcctgcccatccctctcttgagggagcagcaggggccaggagctaccccaggagtgggccaggccgggccacagcaataggaaagccagggccagagcgagccatgccagccctactgccgatgccaaatatttgagagaagggaacttttgctgaggttttctctgaggtttttttgatgctttataggaaactattttttaaaaaaagccatttcccacccaaggacacagtggatgtgttttccctgactccagcagggcaaggaatgtagccgagaggttgtgtgggctgggctctggtgccctcttccctggccaggacacctctcctcctgattcccttggcaccttgtctttctgtctgtttacctgtctccctgcctgcccatctgcatcttttgcagcccactctgacttccatctgggggctgagaccacccttgcctgcccccttctttctgccttaagaatgtccttttaggctgggcatggtggctcacgcctgtaaccccagcactttgggaggcggagacgggcagataacctgaggtcaggatttcgagaccaacctgacctacatggagaaactccgcctctagtaaaaatacaaaattagccgggcatggtggtgcacgcctctaatcccagctactcgggaggctgaggcaggagaatcacttgaacccgggaagtggaggttgcagtgagccaagagtacaccactgcactccagcctgggcaacagagcgagactccgtcttaaaaaaaaaaaaaaagaacgcccttttactgtcctcatcatcccagtttgaggcagtgctggagtggggaaggccgtcttagaccatagaggttggaagacgctgagagatcatccagcccagccccttgatgttacagagcagaagacagatgcccaaacaggagaaggcacttgcccacggtcatacggcaggttgccacaaaaccaagatggcagcccttcctcagcgtgcctcactgccactcccagagccagggagccccataaaacccacatcatgtcttaagagtatatctggctccttgaccagcaatcggccctggga

SEQ ID NO: 2207 - DNA, 1160 bp, Homo sapiens
gtgctgagatcaggggaatctggagccaccagtatatgcacaggtcacggtggctcccacgggctgtgggtaaaatgagaagaggtgcccatgccaggggctgagaaggaacgtccaggaaagttggagtggtcccgggtgggcgttgtgtcaaggaaaccgagagggggagatttcaaggggactttgacctcagggcagttgaggcaagacagagactggaggccgggcccgatggctcacgcctgtaatcccagcactttgggaggctgaggcgagtggatcacctgaggtcaggagttcgagaccagcctggccaacatggtgaaaccccgtctctactaaaaattacaaaaattatccatgcgtggtggcaggtgcctgtactcccggctacttgggaagctgaggcaggagaatcgcttaaacctgggaggaggaggttgcagtgagctgagatggcgccattgcactccagcctgggtgacagtgagactctgttttaaaaaaaaaaagaaagagagagactggaaagtgttgggcttgggcaacagcaggagtctgcatggctgtctgggaggaggggtagaattccaggtgtagggctcgaagagggagaggccagggaggaggcggcctttggagaagtttgcctgtgaagggcaggagagtgaggcagtggctgcagggagatttgggttgggcgggttttgtggttcaaggggagaggcttgatctgagtctacagacagacggcgaggcgtggtgggtagcgggggcggggagctgaggatgctgagggggccatctagaccaggaaggcagctgtcagaagccttggcctccggcggaatccatgctgcaggtggagctgtgttggcccacacagtgttttgtttgttttgtttgttttgtcgaatttgctgccaaccaattgcatgcaaaaatcctgattcccagcctctggcaaaatccaaagaattgataacccagggccccctcttccttctggggaggagcggcgggagcctggggcctgcagaggggcctggctcctgggttgccacctgtaccacctccctgcccactttagcctcttctgtttcctgcgtggcctctgaaatcatttgaattgagacctcggggtcaggagcagtgag

SEQ ID NO: 2208 - DNA, 1226 bp, Homo sapiens
aggcaactggaaagcccaccaggctggggactcctcctgcttacctttggcggactccttaagtaagcaggtgcagcggcggaccagtagagaaaacatggccaagcccagagctgcggcttgttcctggatcacagagcggcactcctccgagaagcagtctgcggacaggcaaatgaaactctcagcgccccaggcggacaagatgcacatcactggccacgttaccgagcttccttttcctcactgaagactagggctagtgatattccctctctcagagtggtcataaggccaagtagaaaatgcatgtgaagcacttaccatgaggtctggcatatggatatgtgtttgataagatgataagggtcacctctgtcaattctacatcactttcccaggaacggttacctcaggaagggcagtctgagctggagctgcatggtctctgcctttagctgcctactgataatgtaaagccatcgtaacaagaactcagatttaattaactcagtctctctagtgtataactaacaggagcacagtcatcagttaagattggaaaaatacacatttaaaaatgatcttctgtctactgccataccaccctgaacgcgcccgatctcgtctaaaaatgatcttcttgaatcaccaacctttagtcccatccttacttcctccatgtccctcctcctaagaaaacacacatgacacaaataacctactttcatggaatgagttaattttatgcagaacagtgcttggcacataataagcacttaatcagtgttggcttttgttttcacaaattccttcccctagcgctaaaaaataaacctggctcccaatcccagtaccctcttcccgtcactttttcagcctggctaactaacttccttctggctccaggtcaccgaaaggagccatctttttggtgggcagaattattctttggtgggagctatgtggcatactcccaaaagcctgcctgtacctactcttcatcactggccttccctgaaagccacgtcatctgaactcgagaggagctggtgacacacagaaggcagcagtccaccacacagcctccgaggaggagacaccacatacccacaggagacagaatcaggggccaggctcactagctctggcagcagctaatctgtgaattccctctctaatacaggagaactctcagaatctccaagtgttaaaaggataatcag

SEQ ID NO: 2209 - DNA, 1099 bp, Homo sapiens
aagagcagaatggtcctatagacccagaaaataatcggggacaagaatcctttcctaggactgctggacaagaggatcgtagtctaaaaattatcaaaagaacaaagaaacccgacctgcagatctatcagcctggacgacgtttgcagactgttagcaaagaatccgccagtcgggtggaggaggaagaagtcctcaaccaggtagaacaactgagagtagaggaagatgagtgtaggggaaatgttgcgaaggaggaagttgcgaataaaccagacagggctgagatagaaaagagcccaggtggtgggagagtaggggctgcaaaaggagaaaaaggaaagaggatgggaaaaggggagggggtgagggaaacccacgacgacccagcccgcgggaggccgggctccgcaaagcgctactcccgctcagacaaacgaaggaatcgctaccgcacgcgcagcaccagctcagctggcagcaacaacagcgctgagggagctggcctgacggataatggatgtcgccgccgccgacaggataggaccaaggagaggccacgactgaagaagcaagtgtctgtgtcctcaaccgattccttagacgaggacagaattgatgagcctgatggattaggacccaggagaagttcagaaaggaagagacatttagaaagaaactggtctggccgtggggagggtgagcagaaaaacagtgctaaagaatatcgaggcactcttcgtgtcactttcgatgcagaagccatgaacaaagagtctcccatggtgaggtcagccagggatgatatggatagaggaaagcctgacaaaggcttgagcagtgggggcaaaggctctgagaagcaggagtccaaaaacccgaaacaagaacttcggggtcgtggtcgtggcattctgattttgcctgcccataccaccctatctgtcaattcagcaggttctccagagtccgcgcctttgggacctcggcttttgtttggatctggtagtaagggatctcggagttggggccgtggaggcaccacacgccgattgtgggacccaaacaatcctgatcagaaacctgctctaaagactca

SEQ ID NO: 2210 - DNA, 1179 bp, Homo sapiens
tgccttgaaggccactgatttttgtgtggcagatgttgagctcttttctgttaggtgcaggaaggtaggttagcattgaagggtgcatgaaagctctgatcagcctgtgtttggcttaaatgccagtcattggtggaggtaaaggatgaacccgtgtttcagcatctacactccaccattaattagcattgtcagttcttagaatgagtctgaatctgctagtttggtttgccttctttcagtttaggcaattgtattcctagactatgaagatttttgtttttcttacttggtccccagatgtcagtattgaatatggtggtgaggcgtgaccctggcaacactgaacctgtgaaagccaaggaagagctcatatttcactgtggattcaggcgcttccgagcctcacctttattctctcagcacactgcaggttagcaatggggaagctgggttcttgtccatcttgtcttttgggaaagtgacttgtggtggaggggtgccaaaatatatggtttcaaaatcttacatctctgggttagaggtattttcagtactctggcttaagagccaatgatgtttttattcaaaatgtctgaacctgtctgaagcatcccagtgatgcaacttctgtgtgatactgaggcttttttgccatgagtatttgttccatagcaggttttgaatagaagttggcagctttataaaaagggtattagggtgggtgcagtggtgcagtggttcacacctgtaatcccaacacttgtggcattagaacggggaattgaagaccaaaaaaggtaagatttaatcttgtttttgtttctgttttttttttttttttttttttttttttgagacggagtctcactctgtcgcccaggctggagtgcagtggcgcgatctaggctcactgcaagctccgcctctcaggtttacttacaccattttcctgcctcagcctcccaagtagctgggactacaggcgcccgccaccatgcccagctaattttttgtatttttagtagagacggggtttcaccgtgttagccaggatggtctctatctcctgacctcgtgagccgcccgcctcagcctcccaaagtgctgggattacaggtgtgagccaccgcgccccctcttgttttttttgtttttttttgtttgtttgtttgtttg

SEQ ID NO: 2211 - DNA, 1179 bp, Homo sapiens; identical to SEQ ID NO: 2210

SEQ ID NO: 2212 - DNA, 1207 bp, Homo sapiens
gggcacatcactgtgcaccctgccaccctcaaccatgtggcccacctgggctcccagctgcccttgtacccgcagcccgtggcagtgagccacatcgcccacaccctctcgcaccagcaagtcaacggcacggccggcctggggcccccggctactgtcatggcaaagccggccgtgggggctcaggtggtgcaccacccccagctggtgggccagaccgtgctcaaccctgtgaccatggtcaccatgccctccttcccagtcagcacactcaagctggcttgaggacgaggccactcagaggcccccagtggggacagggagggggacctgtcccccactctctcacccaccagctccacacattccagccaggcccaggccagcccccccacccacccccaggcctcctaggggaagggggtgcaaagactctgagccaagggagggaagggccaccctgctgcactaggacttggtaagatgactctgagaaaatgcgagactctgatggaatgtgccacctgtccggcccagtgccagctccagtgccgctcctgcttcccctccctaccctcggaaatcagtgcgatgtggacgtcacgctccctgacttctcccccgccctgccccgccttcgtgtgctgctgctgctattgctgtctggtgaggtggcccaggcccccggctttcctccggagcctcatgttctcttcccaggcctttggaggggaaatggggaaagcagaactgaagccacttggcccagaaagctgcggattggggtgataaggggccttgctctgagcacaggtgacagatcataggaagtggctggtctggagtcccacccggacaggtggggcctcagcctggggctctctgacccggttgcagtcactgtgattcgttaccgtagatactacttaaaatgattctctaccaacaataaaccaaacccagccactgccaagcttcctgtgccctcaccccaatccctgccactgggctctggacctcaggagggcaggctgaggtggggaaggagggacttggctgtccttccccttccccgtcccctgcagcctgggtctggatgggaggagagccactgggcccctgtccccagtccccagtccccagccctgggcttggctcttggcttccagaaggcagcaaagaggggcgctgtcctgcgttcagcccc

SEQ ID NO: 2213 - DNA, 1223 bp, Homo sapiens
aatggggggaggggagtgcggaagctgactgcccacagagatgttgccgggatcaggatttggggtagcttccagtgaccctgctggatcctagtttccagaggagttttggaatggttaataccgcaccctataagacacgggcagtggaaccagagacacctgggggtgaccagcagcccctggatatgcccacaggtatgaacgtacctggggtggtggtaggcagggaatacgggggactttgagaagctggcatggattgcccttgtggtgggttgtcccccattcctctcgtccccccttcctataatgtgtgtaacaagatgttgcccgctgcacagaatgaatttcccgtgaaaatgacataaggtggttcagcatgaaataacattgagtcacctagtgagaaagttcttcccttttcagttctctgcgaatccttgtgatttctttgaggggaagtttcaggtggatgctagtctgcctttaacacattttaaacacttgctaatcttccttttgtaattaagagagagcagacctccggctcccggtcctctgagtggggaacagttgcctggctagaacttaggttgtttttgtttttgtttcatttatttttaggattctctcctggttaatggccagtggtactgatgtttttccatttgtggtagtgatataaaacatctctttaaacatatgaagtcacaagaattaatctattttatttatttatttatttatttttgaggaggagtctcactctgttagcccaagctggagtacagtggcgccatctcggcccactgcaacctccacctcctgggctcaaacaattctcgggcctcagcctccggagtagctgggactacaagtacccaccaccacgcccagctaattttttgtattttagtagagacgggggtttcaccatgttgcccagggtggtctcaaactcctgagctcaggcgatccacctgcctcggcctctcaaagtgctgggattacaggcatgagccaccgtgcccggctgaagtgaatctatttaatagaaatagtagtaataataatacaagtgttaacaaatatagtggaaatcctgcaagtggtctaggaatggctgatgccagcgacatgtgtgtctagcagaagaagctgccatgggaactctggagtgcaatgttccagggcctgagtccatcttcccctggacttgg

SEQ ID NO: 2214 - DNA, 1176 bp, Homo sapiens
acactgatgcacagatatctcatactgtgtcaggtggcaatgagtgttgtgaaaagagtaggggatagagaatgatggagactgttcttttagacaaggtgggcaggggaaatctctgagttagaaattctacagcggaactagtgctataatgcttgtaagtattaaaggtagaatgcttttcttaatggtagctttactactgaagaaatatcaaaaggactttaatttttatattaaaaatactcttctttcttaagttggatacgttgtctcaggtagaagaggagtctttgttaagaaacgatcttcgtccagctaacaaacttgctaaaggaaataggttattcatgagatttgctacaaaaggtaaatgtaatatttggtattgttttatattttcaatcaaaatgatttattatggagtgacatccttcttttttgaatagaagttagatcaagtaatctcaaagttcccttcaaactataatattctgcgcttatgaaataattgcttgccacctgagttggaatttctgactttaaaagtgaatattaactatttgtatatttctgtgacttctggctaaagttattttctgttgaaactggtttgcctcatatattttcagccagttaccatctgaattatgaaaactttcaaatgaaactttatttattacagcaacgtcctcctgaacattgccagtgtaccattcggttctaattcccttctcataagattgtttacacatggtgacttttggtgggcatttaaaaatgtgtgtgtatgtgtatatatgtatgtgtatgtatgtgtatatatgtatatgtatgtatgtatcgcgtgtatgtgtgtatgtatgcatgtgtatgtatgtatatgtatgtatgtgtatgtgtatatatgtatgtgtgtgtatgtatatgtgtgtgtatgtgtatgtgtgtgtgtatgtgtgtgtgtatgtatgtatgtatgtatatgtattatacacatatacacatattggtttttttaatcatttgagagttagttgaagataaaaacccatcacccctaaatgtattccaaagaataagaacattgttttatacatagcacacttaacaaaatcaagaaatttaacattaatacagtactgttacctaatccgtagtcgattttcaaatttt

SEQ ID NO: 2215 - DNA, 1335 bp, Homo sapiens
gccacaggtggcggtaatggtggtgggtgcacccagcctggcctggcctggccgcgggtggcagtaacggcggtggatgcacccagcctcattgttccctcagcaactcattcattcagtcaacatttgttgaacatttacagtgtgagttgaggtccttctcatgtaatgggagcccagacctgccccctacccctgcccccaccaagggaggggggttgatcccctggcacaggtcgaggccctggacccacatcctttgtctgcctctccaccccacagtgcccattcatcgacgatttcatcctggccctccacaggaagatcaagaatgagcccgtggtgtttcctgaggagtgagttgtccacccaggggaacaagggggctaccacccgctcctggtgtctgagttttagcagagcttttgccctctgaggaccccaccccagcctgcagatatgaaggtggcggtgctgttccctgggagggacccctgaatagatggacgggagggactctggagccaagggtctccgcaacgtcactgtgtggatgggaaccctgagatccagggttggccagggatgaccacaggcatcattcacaccactccttcaccgcaggcctgcctggggtcagtggcgccagccccacccagcccctggactcaaggggaacttctccttcccccactcagggtcagggaacttcaagatgccagtgcgtgctccccatttcacagatggaaaagaggatgctctggaggagagcggtcagggggctgggactcaagccactcttcctccccactcttcccattgtgaccgaggtctctgagcgtagcagggacgtcggggaggcctcttgctcatgcatggttcgcctcatgacggccaccgtggcagccacagcctgagctcccaggctcctcttttcagcagtggatttcaggagtgaaatggaggccgggtgcggtggctcacgcctgtaatcccagcactttgggaggctgaggtgggcagatcacctgaggttaggagttagagaccagcctggccaacatggtgaaaccccatctctactaaaaatacaaaaattagccaggcgtggtggcgcacatctgtagtcccagctactcgggaggctgaagcacgagaattgcttgaacccaggaggcagaggttgcagtgagcctgggcgacagagcaagactctgtctcaaaaaaaaaaaacagaagaaagaaactgaataaggccgggtgcggcggctcacacctgtaattccagcactttgggaggccaaggagggcggatcacgaggtcaggagatcgag

SEQ ID NO: 2216 - DNA, 1139 bp, Homo sapiens
agaccagcctggccaatatggtgaaaccccgtctctactaaaaatacaaaaattagctgggtgtggtggtgggcacctgtaatctcagctacttgggaggctgaggcggaagaattgcttgaacctgggaggctgagatgcagtgagctgagatcacaccactgcactccagcctgggagacagagtgagactcggtctcaacaacaacaacaaaaagaaatgaacttccttccccacagtgggcagagtcagatgggatctgtttccagacatttagtacagtgttctttctggtccacccttcttcctctcagtttgcatcagttggcattattttcatcgagcctgatgcctagaggaaagtcctttgtagacagctatatggctttggagagtaaatgcaacttgcccttttgctctctgatgttttttgtctttctgtagcccgagggaagaatgcgtctctgcccaaaccctgcttctgcagctactccagagctgcttctctgtgctgcagggagatgtactggctgcttctgaggaggaaaaggctccaatccaaagccctaaaggagtagaggctgccaaggagctgtacacacacttgtgtgatggtagggatttgggttttctctttaatacaaccctgtgtaggtagcgtgaagggcctcttgctatagagaagagggctgtcctacgatgatgcgagccagaaagggattgccgctgtgggaatcccccagaaagggattgccgctgtgggaatcccccagaaagggattgccgctgtgggaatcccccagaaagggattgccgctgtgggaaacgagtgtttcccctgatgctcttttgagctactagtttgagttcaggatttattccttcctcagctgacttctcttcctcctggtttcagatctatagctgtgttatgttgagagtcattactatcatactgttgagccttaacttcaactaagtcactcagatgaggctgatagattgagggggagtgaaacacgtgggcttctgaagttttatttaaggctttgccaagttgtgtctcaaaaggacagggaagtaatgacataaaaactgatacatacggtctttgttttagttaaatgaaagcaaataa

SEQ ID NO: 2217 - DNA, 1164 bp, Homo sapiens
gactaacttgatgggcgcttggttcctcttccagccagctgaggtgggtgtcctggttggcaaagaccggtcaagtttttacgtgaatgggctgacacttgggggccagaaatgttcggtgatccgggactcactgctgcaggatggggaatttagcatggatcttcgtaccaagagcaccggtggggcccccaccttcaatgtcactgtcaccaagactgacaagagtgagttcctgagtcttacccttcctttagctccaagatctctaatgtaccgccttctggtaatcttgagggtgcttttttgtgtgattccccaacatgaagggagtcagaccagtattgtgttccttgtctgctggatgctggaacacgggatagtccctccattctgtctcagttcctcatcttgtaattcgaagttgctgaactgcattacctcttaaattacttactgccttgagctcggattagaaactgttttctaggagtataggtagattgttggggtcttgaatcatcgagttcatcgtttgagttcttttgttagaacctggaggtggcatgcacatccacagccctttctagcctgaacacatgaatcaacagtctatgagcctttgacccctaagtttttagtctgttcctctccagcgtttaagcttgattttcctcttttgaaaagccttattgtttcagggtgactgacagcctgcctgtgtgtggtgggggggcgggttgggagagatgaggttgggttacagcccccagggctggacagctgctgaacagctggcagggggtggaattgtgacacctggatcctagcctcctttctctttcctcctcctccagcgctagtcctgctgatgggcaaagaaggtgtccacggtggtttgatcaacaagaaatgttatgaaatggcctcccaccttcggcgttcccagtactgacctcgtctgtcccttccccttcaccgctccccacagctttgcacccctttcctccccatacacacacaaaccattttattttttgggccattaccccataccccttattgctgccaaaaccacatgggctgggggccagggctggatggacagacacctccccctacccatatccctcccgtgtgtggttggaaaacttttgttttttg

SEQ ID NO: 2218 - DNA, 1113 bp, Homo sapiens
cccgcaggaactccctggatggagggggccgatcccggggagcgggttctgcacagcctgaaccccagcacttccagcccaaaaagcacaactcttatccccagccaccccaaccctacccagcccagcggcccccagggccccgctaccccccatacactactcccccacgaatgagacggcagcgttctgcccctgacctcaaggagagtggggcagctgtgtgagtcccacatcctgggcagagggcctggtggggccccttgctaggagaagggaagacgcccgagacgctgcttccccagaagtgctggggcagggaggcccaggagatgagagagaaggtccgagtaggtgatagaagacaagggggagaccgagccggaggctgaggaaaggaagagggcacggagttgccaggagcaaaccaaagtgaagagagagataggaagctgcctcggggccaccccttgcaaagggggtgtgtcccacaaacgctgctatgggtggggtggggggctggggtgctgcgtagccagtgtttgactttcttttcaagtgggggaaagtgggagaggactgagagtgaggcaagttctccccagcccctgtccgtctgtctgtctgtctgtggtggtttctgtttcttgggaggcatggtaggatcataagtcattcccctccccttccaggcctcctgctatatttgggggacctgactggtttggctggagtcccatgaggatgtgggccctttaataaaggatagcaaacagggagcttgtggcctgtttgttttgggttttcatggaggtgtaggttatataaggcaatggcacaggtcttaagcatacttatcagtgaagtattgtatgtgtgctctgtgcaggcaccacccagatctggatataagaatgtttccatcttgtcttcctgaacttcaccctcctgtctcttccttcagggtgcgcagcccgatcttttccccgctttttttttttgggagacagggtcttgctttgttgcccaggctggaggtacagtcttggctcactgcagcctccgcctcctgagtagctgggattacaggcatgtgccaccacgcccggctca

SEQ ID NO: 2219 - DNA, 1357 bp, Homo sapiens
ggaggctgaggtaggagaatcgctagaaccccgggggtggaggttgcagtgagctgagatcatgtcactgcactccagcctgggtaacagagaaagactctgtcttaaaaaaaaaaaagaggaatgatttcttcttatgttacagggggcccttgcaagattccagctggtatgagccttctgcagagctagtgcagactaggatggctgtatcactaacagcagctgaaactctggcccttcagggtacacagggacaagagaagatgatgatgatgggaccaaaggaagaggaacagtcttgtgagtatgagaccaggctacctgggaaccactctaccagtcaagagatcttccgccaacgcttcaggcatctccgctaccaggagactcctggtccccgggaggccttgagccaactacgagtactctgctgtgagtggctgaggccagagaaacacacgaaggagcagatcctggagttcctggtgctggaacaattcttgaccatcctgcctgaggagctccaatcctgggtgcggggacatcaccctaagagtggagaggaggctgtgactgtgctggaggatttagagaaaggacttgaaccagagccgcaggtgggaagggggatttggtctgttatgggagccagattgatgaccttcaggctggaccgaggggcagctgtagggggaggtgccaagttcaaacctctcttgggccaggtagagcagttagtatgtgtttctgtgtctgtcttttctgccctcgagccctgaatgagaaagagactctagctcctcttcttcccttgtgctgactctgaggaggctctctaaagtctccttggaagctttggtccaaggagggtcacatctgcaagtgtccaggcaggggacagaaaccacactagtaatttgaagaaaatttaaactgagtggtgcctgatcacctccaggtcccaggccctgcacatggacctgcacaggaagagccatgggagaagaaggaatctctgggagcagcccaggaagcactgagcatccagctccagcctaaggagacccagcctttcccaaagagtggtgaggagcaggattctgtggggagggagaggagaaagagggactataaagggcacagtacctagtacctgtaaagggtaaatagtagtaggtgcttaaatgtttggtatcatcacagccttactattcttatctcttaggtgagagactttgcctgtttcatcactcataaaattaggagtaagaataaactacctcataagatagctctgaggattaagctcaacttgggtcttatctggatataaagcctggccagcatctcttaa

SEQ ID NO: 2220 - DNA, 1171 bp, Homo sapiens
cagcccctcaagtagctgggattacaggcgtgcaccactacacctggctcatttttttgtatatttagtagagacagggtttcaccatgttggccgggctggtcttgatctcctgttctcaatttatccaccctccttggcctcccaaagtgctgggattataggagtgagccactgtgcctggttgaagtgtggctttttaatttgcacttccaggataggaattatattaattatggcctctttgtttattggctggctggcttgcttccttcctttcatccatttttttctttctttcatttttttctttttttgcttgccctcccttcctccctccctttcttcttcttcttcctcttccttttctcttctactatgagttgctgtttcacatctttcttttgtggcttgtctgtttatatctgtttcccatttttccattgggttgtccttttctcagtaatttggaggagctctttgtaaattatattagccctttggtatgtgttgcaaattttggtctcacagtttgtcatttacctcgttttaaaaattttttgttatgcagaaagctttaatttttatgtagatctgaccttttttttttttttttaaatttatggtttctgggtttcttattttgctgaggaagacctccccaactctcatgtttatttaaagagaaaaaaccttatcattttcaacacttgtggttttttatattttgtagtccaatccatttgcaatttatttatttttaaattagagaagtttaatataaagaattattaactaaactggagatcacccactaagacaaaagaaaaccctaaagaatacaagactagtagacataaggaacagtctcgcttccagggctgaggcagagcaccctttatttttttttctgaatagatagatagttgtcttaacgtttattcaatagttcatgtttttgtttgtaaattataacttggtaaatctcccaacctttgaactagcagagatacttaatctgaaaaacaaaagccctgcacttatccactgtctttgtcactctgatatcccaacacacagtagcctggaattaggtaatggcctttaattttcatgtcttacctggctttctgtggagagaattgcttttgaatcttaagggctctaattt

SEQ ID NO: 2221 - DNA, 1187 bp, Homo sapiens
tggatgaagagtgattcgagttgtgctttaggtagattagcttggcagcagcaggtgggtgaatcggagtgaggagatggtgagatggtcaaagcgagagggaagggcctttcctttccgggccgtcctgatggaatttaggtgaggggtgggtcacccaacctgcctgtggtctggtggctaatgtgagcacctccctcccagccctaccttcacaggcggtagtttccctgtttctggtccgtgctcctccagctgggccttcttcccctgaccttgctgatccttggtgaccacctccgaatgtcagaatccacatcgttaggctcacaatgtgggctgcttttgccccagtgggtccagttgccccaacacgctgtgtagtgctgaccagtgtttacgtgtggggtcggctccattcctcgctttctcccgaaacagatgtcaatgccaatcgcatcatcccgaggagacgtggagagtgtccgccgctgcctggctcacagcctcttcatgagcaccgccgagcttcagccagatggcacctatgccaccacggacacccaccagccagtggccatccacccgtcgtctgtcctcttccactgcaagccggcctgcgtcgtgtacactgagctgctctacaccaacaagtgctacatgcgggacctctgcgtcatagatgcacagtggctgtacgaggctgcccctgagtactttaggaggaagctgagaaccgccagaaactgagccgccccaggatgccgccagaatcactggtccctgggagcttggactacagttgtccttacagcaggcttccaggttggcgcttagagaagccttggaatcagctgaaggtgcctgacttccaggagcgtgaaagcatctttgctcaactcctgggactgaaccatatagacatggacatatcatttgtacctggaaacctcaaaattatgcttttggttcttactgggtgactttgacttaatttaacacctgagcctcagttttctcatctgccaaatgggagtaataataataatccttataaaattgggttcataaagtttagagaaaaggaatggaaagtacccagaactatgcctggagcacgcacgacacacgtacagtgagttgggagccgttaggctgaatgttactgcttgccatatgatgtgaag

SEQ ID NO: 2222 - DNA, 1409 bp, Homo sapiens
ttcctctccattcggtgtcttggggccctagcctcttgaagcagtgatttcttcctctcttcccttgctttccagacctagtcaacctgtctctcaatgacaacgatggctccagtggggcttcagaccaggataccctggctcctctgcctggggccaccccctggcccctgctgcccactttctcctaccaataccctgccccacacccctacagcccgcagcctccaccctaccatgagctttcatcttacacctatggtgggggcagtgccagcagccagcatagtgagggtaagtcatccccacatacctgtacggccaggatctgagggtggatgagaggggagccagggaggagcctgggtgaggactcagttgcccctcccctccctccacaggcagccggagcagtgggtcgacacggagtgatgggggggcagggcgcacggggaggcccgaggagcgggcccccgagtccaagtccggcagtggcagtgagtctgagccctccagccgagggggcagccttcggcggggtggggaagcaagtgggactagcgatgggggccctcctccatccagaggctcaactgggggtgcccctaatctccgagcccacccagggctccatccctatggaccgccccctggcatggccctcccctacaaccccatgatggtggtcatgatgcccccacctccacctccagtccctccagcagtgcagcctccgggggcccctccagtcagagacctgggctctgtgcccccagaactgacagccagccgccaaagcttccacatggccatgggcaatcccagcgagttctttgtggatgttatgtagcccactgtggggccaggctgggccgggcgctcctggtgtgtgactgggtgtcctggccgtcatgtgcttgctcttacagtgcctgggctcagcctaccagctgctgccatacaggagattgtggccactgtgactctcaccagcagtgcctggttcctcccccttccctcaggggtagacaagggacctttgattatttttagctttgtttttttataagcctttttgggggttaaaatagagtttcttacatttttgggacttttttaataggcatttcctcttttatatgaagaattcccatccattgggccccttctaaccccagaatgtgacctcctcctccagttacccacagccctgccctttgcagggttgggggtggtcagcggtaccccggggttaggcatcctagacagcagcctgaggaagctgggagatttgggccatgtagctgcctttgttactctatttattttagtcacttgtataaaacaccaaataaagcaatagaggcaaactccccacgcctctggctcctttctttgggagggaggca

SEQ ID NO: 2223 - DNA, 1232 bp, Homo sapiens
tggcttgccttaaagtttcataatagccgtgggttgggggtttggacagaacagtaggagtagagagaaggaaagagaacagtgagctagagaaactatctgttcgggactcttcccagtccccctccccattccaaagcagcagaaaacagtttgaggcctttttgcccaggactgcagagattatactgctcgtgtggtaggccttggagtcagtgaaggagtcaggcaatggtttgtggttctagaagaacgtgtctgggtcgtggttggtttaagttactggagcccagttgctgaacagttttctgctttcatcccaggaacaccatgaagaagacttctttctctacattgcctacagtgacgaaagtgtctacggtctgtgaagctgctgcccctgagctggaggggggtctcattctacaaagagagaggtggcccccctttcttgacctcctcctccttcaagctcaaacaccacctcccttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaaggggctcagaaccccagcaatcccttcctttcactaccttcttttttgggggtagttggaagggactgaaattgtggggggaaggtaggaggcacatcaataaagaggaaaccaccaagctgaactgaattttgccttgtgttgctcccctcgtcccgctgattttaagtctttccaaggtgtcagtgggtttcagtggtggggaaagaagagtactgggtacaagctggagggatagaagtatattttggtttattctgttcatgttgggcttttccctgtctgcaaaaagagggtgcttttgttgtgatggaatggaatactgaggattatttcttgaaactttagttttataacacgcatgtgaaactaaatgttaaaaatgctcatgtaaaaaaaaatttttttttactgtgggttcctgtggagaaagttccgaagtacctgctttaggtgaacatccacatttgctagaacattctaactaagatattttcatgtgtgcaagctagtaaaacggctgttctcagtt

SEQ ID NO: 2224 - DNA, 1099 bp, Homo sapiens
agcagaagtacgactgtggagaagagatcctggtatggtgcctccctccctgcttctgtgctcagctttgttctgtacgtttcttcctgagctcagacatctcttggctatccctcttgcttctccagatcacggtgctgtctgccatgacagaggaggcagctgttgcaatcaaggccatggcaaaataactggctcccaggtgagtgtgacaaatccctcactgtccccttcacattttgttgtcctcagcagagctgctgtagtcttaattgtttcaggcttactttctgcccctagcctggctctgtcctccctatccttcctgttgaaggtattatcctgtcttactaatttctctctcctacctagggtggcggtggtggcagcagtgatcctctgaacctgcagaggccccctccccgagcctggcctggctctggcccggtcctaagctggactcctcctacacaatttatttgacgttttattttggttttccccaccccctcaatctgtcggggagcccctgcccttcacctagctcccttggccaggagcgagcgaagctgtggccttggtgaagctgccctcctcttctcccctcacactacagccctggtgggggagaagggggtgggtgctgcttgtggtttagtcttttttttttttttttttttaattcaatctggaatcagaaagcggtggattctggcaaatggtccttgtgccctccccactcatccctggtctggtcccctgttgcctatagccctttaccctgagcaccaccccaacagactggggaccagccccctcgcctgcctgtgtctctccccaaacccctttagatggggagggaagaggaggagaggggaggggacctgccccctcctcaggcatctgggagggccctgcccccatgggctttacccttccctgcgggctctctccccgacacatttgttaaaatcaaacctgaataaaactacaagtttaatatgaagcccccaactcagctgcttatttgaattaaatgggtgtatttggaagccacaaaaagactgaactctgccactgagttcactggaacccgctg

SEQ ID NO: 2225 - DNA, 1110 bp, Homo sapiens
tagcgaatggtgtgttgaagtggggataaggtgctaggtttgtgcagtcccaagaaaggcctgagtctggcctggggtgggggttcagcgccatgaaattacagctcaggagtaattaacacatataaacaaacctgcctcttccagctaattaatgacttggtatttttgttttctcttccttgtctacctcattccctcccagggaggtgggagctgggactcctgagtccctgaggagaacctgcctgggagggatacatcagctggaagggagcatgctgggtctggagagctgacccgcctctcctctggctgggtcctggacttgaaccacatctgggccccacccccaacctaggcgtctgctgaggggagaagggctgctgggtgggagtggggaggtgtcagggggcctgtgggtgggagaagggggcaacttggtctgaattccaggtcactaaccacttgtctcttctgtttccccattcctttctgtctgccccatccaatttcccttgccctcttccacctctgtatttttctgtctgtccgtctgtctgtatcctgcctccctgcccctctcgctccaccccccgcaggtcgggcctgccttcaccttctcccatttccttccccttccccaccccgtgccccctccatggagaggaacagaccccttctctgtccagtctaacccaggtccctccccaaccccctcctccctcctttccccccgcccctcctccctcctggggcgaggggggcctccctccctctcccccccttctctctctctccgaggggggggggtcccagggagggagggggggtcccccgatcagcatgtggctcctggcgctgtgtctggtggggctggcgggggctcaacgcgggggagggggtcccggcggcggcgccccgggcggccccggcctgggcctcggcagcctcggcgaggagcgcttcccggtggtgaacacggcctacgggcgagtgcgcggtgtgcggcgcgagctcaacaacgagatcctgggccccgtcgtgcagttcttgggcgtgccctacgccacgccgcccctgggcgcccgccgcttccagccgcctgag

SEQ ID NO: 2226 - DNA, 1125 bp, Homo sapiens
acagatccagagacaatggccccgatgggatggagcccgaaggcgtcatcgaggtgagactggagaaatggaattctgtcctcccccattacaactttcagccgtatagagttagagtggcctcttgattgatttcccagatcatctagaagcagctggtttccctaaagggaggagggttgtaagctctgaggcttttgttagtaggcaccagattctgtttgctcggagactacagctcagctccaccttttccatgactcaagctttaatttctttgcatcccctagagtaactggaatgagattgttgacagctttgatgacatgaacctctcggagtcccttctccgtggcatctacgcgtatggttttgagaagccctctgccatccagcagcgagccattctaccttgtatcaagggtgagacctctcagtcccagaagacattgtggactgtccctgacctgggtagagtggcatctggttggtgatgcccatctcatatcagccagggacaaagcaactccttgttcatcccagcttggcttttgatccgtgcccatgcctggttcatgccttggacacataggtttcctttaaagaggtggtattgtagccagcttatatttgcatctacagccatgtttctagtccagcttggtgtgcaatactagatgagttaataactggtccttgtttctgatctggttcccattgtgtaactgtgttgattgggaaggtagtttgtgagccatgaaatgcttggttcattggttgcttattgacctcattaacctaggacttgaatatcccaaagggtatgctctttaccacattcaactcctaatttatttgtttaggttatgatgtgattgctcaagcccaatctgggactgggaaaacggccacatttgccatatcgattctgcagcagattgaattagatctaaaagccacccaggccttggtcctagcacccactcgagaattggctcagcaggtaagagtggcttctattccctccttcagggctgatttagggatgatgagtataatccaaggaccagagaagtcttctctgatcaccaccttgggaggaagacatgggtgccctaacactct

SEQ ID NO: 2227 - DNA, 1125 bp, Homo sapiens; identical to SEQ ID NO: 2226

SEQ ID NO: 2228 - DNA, 1125 bp, Homo sapiens; identical to SEQ ID NO: 2226

SEQ ID NO: 2229 - DNA, 2331 bp, Homo sapiens
agtaaagaaactgaattaattatctgagcggcctcattgtgaatcactgtacactcaggaaccagactgagttgaaatcctgtctttgccacctattgacagcacgatcttaagtggattttagcctctgcctgtttctcagctgaatgtgagtttaataatagtgcatgccccaaagttgttggttaggaatcaatacatgaaaaacatttaagaatggtgccgggcacagtggtaactgacatatgagcacctgcctctctctgctcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtgtgagtaattcggttctccaatcccctgggtcactttgctcttgtgcacgctttccagtctttcagcgtaagccagagtcattcccaaggatgctggtttctctctgggggaagagctgctctgtgatggagcccatgcgtgtcatctgagcctctggcttccctgccagtgcagccctggcagtgtcctacttcccagggctgttgtctgcctggcgggaaggtcctgggcaaaggatcagtctttgtactctgagagcagactacttggctcctctctgttttttatcagcgaagttggatatatctctcccacatttccctaatcatatgctatatattggctttttttttcttctctagcccccaaatacatcaagatgtttgtactggatgaagctgacgaaatgttaagccgtggattcaaggaccagatctatgacatattccaaaagctcaacagcaacacccaggtgagggcagtcttgcttgaatagctaatgattcttgaaaaatagtaagtgccaggggaaccatatactggattcttgagcctttttatgcatctgcttcagttttaggtgtggctagggaagggagcaggcctcaggaaggaaccagcactctaagactggcctttttttccactaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggtggggcccagtgcaggaggcgggcctggtagtgagttgttgggtatagcccctgactgatttttgtcccccaacctccaggagtggaagctggacacactatgtgacttgtatgaaaccctgaccatcacccaggcagtcatcttcatcaacacccggaggaaggtggactggctcaccgagaagatgcatgctcgagatttcactgtatccgccatggtgtgtttgcccgctgccagcctgttgtgggtctgcccgtcagaagtgtcctacttgaagccagggttcctggaacccaggtgcctacctggtctgctgcatatttgttttctcttccagcatggagatatggaccaaaaggaacgagacgtgattatgagggagtttcgttctggctctagcagagttttgattaccactgacctgctggtgagtagagggaactgatagcaaaggcagaagggaggatccaaggtgattccctctccaaggggacatcagtgcctctcaggaaagtagcagcttggaatagaatctggcatgcctaaggcctttggggaactgggatgcttatttcctctgccttccttggctgcccacatggatgcctaagtgtcttccctccgggatagagtgtcctccgtgcacatgctgaagagttgtctttcttgacgtaggccagaggcattgatgtgcagcaggtttctttagtcatcaactatgaccttcccaccaacagggaaaactatatccacaggtaagcgtagatctggaacactcccctaccccttcacacctggccctccctgggcttaaagctcctgatattcctcatccccttccttgttttccagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatct

SEQ ID NO: 2230 - DNA, 2331 bp, Homo sapiens; identical to SEQ ID NO: 2229

SEQ ID NO: 2231 - DNA, 2331 bp, Homo sapiens; identical to SEQ ID NO: 2229

SEQ ID NO: 2232 - DNA, 2331 bp, Homo sapiens; identical to SEQ ID NO: 2229

SEQ ID NO: 2233 - DNA, 1178 bp, Homo sapiens
cccgccataaaaaactcatgttcaagacagaagggcctgactcagactgacattctccacttcttgttccccactgacagcctcccacccccatctctccctcccctgccattttgggttttgggtctttgaacccttgcttgcaataggtgtgcgtcagaagcacccaggacttccatttgctttgtcccggggctccactgaacaagttggcctgcactggtgttttgttgtggggaggaggatggggagtaggacataccagcttagattttaaggtttttactgtgagggatgtttgggagatgtaagaaatgttcttgcagttaagggttagtttacaatcagccacattctaggtaggggcccacttcaccgtactaaccagggaagctgtccctcactgttgaattttctctaacttcaaggcccatatctgtgaaatgctggcatttgcacctacctcacagagtgcattgtgagggttaatgaaataatgtacatctggccttgaaaccaccttttattacatggggtctagaacttgacccccttgagggtgcttgttccctctccctgttggtcggtgggttggtagtttctacagttgggcagctggttaggtagagggagttgtcaagtctctgctggcccagccaaaccctgtctgacaacctcttggtgaaccttagtacctaaaaggaaatctcaccccatcccacaccctggaggatttcatctcttgtatatgatgatctggatccaccaagacttgttttatgctcagggtcaatttcttttttcttttttttttttttttttctttttctttgagactgggtctcgctttgttgcccaggctggagtggagtggcgtgatcttggcttactgcagcctttgcctccccggctcgagcagtcctgcctcagcctccggagtagctgggaccacaggttcatgccaccatggccagccaacttttgcatgttttgtagagatggggtctcacagtgttgcccaggctggtctcaaactcctgggctcaggcgatccacctgtctcagcctcccagagtgctgggattacaattgtgagccaccacgtccagctggaagggtcaacatcttttacattctgcaagcacatctgcattttcaccccacccttcccctccttc

SEQ ID NO: 2234 - DNA, 1193 bp, Homo sapiens
ggcctgggctacatgggatatttaggacagactatctctctgagacagaaaaacaagggaggaggcagtatgaaagaatgtattctcgctaaattccagtttctaaaggatgtgtaagaaaccagaggtaaaggtctcgcgatatcttaagacatccggcgtagtacgcttcagtgagccacagcgctagagaagtaggagaagctcgcgagatctgtgccgttgccgaggagactaggagggggaggagaggggatctcgcgaaaggaaagaggtcgggagcgctcgcgagatctcggaccacccaacctgaaaggtgcttaggaagttgaaaggcccagaggaggcctccgggcaaatggccggagctggaccgaccatgctgctacgagaagagaatggctgttgcagtcggcgtcagagcagctccagtgctggggttagcacgggctctggttctgggactgaggggcagtcaagcagcaagatggagggggtggggaactgcagctcccggcagcctctgggctttgtgtgagtgccccgcgggctgccgggagctgtggttccgcgggcgggcagcctgggctgcgcggtctgagcgcttgttacaccccgcgcaggattcggacggagagcgcgaggactcggcggctgagcgcgcccgacagcagctagaggcgctgctcaacaagactatgcgcattcgcatgacagatggacggacactggtcggctgcttcctctgcactgaccgtgactgcaatgtcatcctgggctcggcgcaggagttcctcaagccgtcgggtcagtgcccggggaatgcacacccgcctggtaatgtggcggaaccttacgcaaggcatttccccttaagggcctggctgcaacccttgttttctggggctcgttttcgtggctcagaggggcgggactgattctggcctactttcctgatgctctgatccttctttccagattccttctctgccggggagccccgtgtgctgggcctggccatggtacccggacaccacatcgtttccattgaggtgcagagggagagtctgaccgggcctccgtatctctgaccacgatggcgcttacctttcagacttcattaaacttatgaccgaatgggcctgtgtctgtgtgtagctgggatgccggtgcaggatagcacaccccatccc

SEQ ID NO: 2235 - DNA, 1119 bp, Homo sapiens
tgcctggatcactgaaggtagaaaggacaagacctaagaaccctagacatttgtcgccattgcctccttgctcccaccctcaggtgctgggcttcaacacccgtcagcggaaggctttcctcaatgctgtgatgcgctgggggatgccaccacaggatgccttcaccacacagtggctggtgcgggacctgaggggcaagactgagaaggagtttaagtgagtgtgggtgatacagggctgagttggacgcaaggggaagagctttgggtgttcctttcttccttggggccgccatatgatgtgaccttactcaactgattatcaccctccctgtcatacaatacttcctggctcgatttcctggggggtggtctcagcccactccacctcccctcagccgagcctagagtagaggggccaggcatcctccccaggggaggggcgttgaagcaaggagcctctcctgggctgtcctagcctcacatttacttgaccacaataacctggcaggaggagctggtggaaaggatgaagagctgactgatggggcccaggaattaagtaccaaggccaaagggaaagacccaggggtggggcgcagggggacagttaggacttggagggctggtaatggtgagagtgagaggcccaggggaggagccctggagcacctggggatttgggggtttgggggtcctcagtcatcctcgcgcctccctcactgccctataccccttctgtggctcccctaaccctcctcccactcccatgctccttagggcctatgtgtctttgttcatgcgccatctgtgtgagcctggggcagacggctctgaaacctttgccgatggggtccctcgggagggactgagtcgccagcaggtgttgacccgcattggagtcatgtctctcgtcaaaaagaaggtatcagtcttcctgtcacccaaagaatcaagctggctgcctagtctctgtccttcctctgcctctgtccctgagttgtaagcttgcgctggtgtgagacggaggagactggagcttcctgtctgtaagcgcctggagctgacacctaaccctcccaccctgccaccccaggtgcaggagtttgagcacatcaa

SEQ ID NO: 2236 - DNA, 1119 bp, Homo sapiens; identical to SEQ ID NO: 2235

SEQ ID NO: 2237 - DNA, 1192 bp, Homo sapiens
tcagctatatgggaggctaaagcagaaggatcacttgagctcaggagttcaagactagcctaggcaacatagtgagacctcatctcaaaaaaagaaaaagaagaaaaaattaggatattttaattttaattttatttatttatatacttatcatttatttatttgagacaaggtctcactctgttgcccagagcgctcaagcaatcttccttcctcagcttcctgagtagctgggactacacacacgtgccattgcccccagctaatttttaaattttttgtagagatggcatctctctatgttgccaagcctggttcaaactgccagcctcaaacggtcctcccaaagtgttgggattacaggtgtgagccactgcatccggaaatttataatcttattaaagtgtttgtaccatgtcttatctctttaaacctactgtgctttgacccttctttctgcctctctcctggtcaggctcctcctgctggaccctccagccccgggcctcaggagcccgagaaggaggagaggagggtctggactatgcctcccatggccgtggccctgaagcctgtattgcagcagagccgggaagcaagggacgagctacctggagcgcctcctgttctttgcagttcctcctcagatcttagcctcctgttgggcccctcttttcagagccagcattctttccagcccctggagcccaaaccagacctcacttcatccacaggtaactgggggcagaagtcactggggttccccttctgtgcatgaattggctccctctttcgtaccctgctttctgtctgatacttgagcatttagtttcccagatgcctttagtgatcgcaagttgcaaggagcagaaatctgctcacattggtccaaataaagggattgagatctcatggaaatatgacatcgctggacttaatgagaactggagttgggaacggggtactatcaggaactgaggcagctagctggcccttttctgtgggcctgcatagcctcctgggtccacctctcctgcacatctgctcttttttcttgctagaccagcattcaaggttctcacccttcataacttcagtttacacatgggtttgaccagctgtgatactgactctagctgagcctctagacatttatagagacatcggtgtctcagtttttttaggtccagtt

SEQ ID NO: 2238 - DNA, 1210 bp, Homo sapiens
tccaatgcgctatccattgcgccacagagccacccgacgaacggcggcgtcttgtagcttacgggtactagagtgggaatggggcagggttggggagcggggctaagggacttgggcgggacatgccaggagggcgcggtttggatctcagaggccaagccaggtagaggtagcgggcgcaaagcatgttagccaggtgagagagagggcgcacatgggtcgaaaaaacagggagggagagcaaccgaaaatggctgagcgagcgagtgcagagctccggctgcccgcttggggggtgtttccggctcaggcgctccccactcccagatatagtcccacccaaataaactagttttgttgtaaatttctgtgtgtttttgtctcttctcgtttatctgttctgccatctgctgctatgcggtccacagtctcgatggttcttcatttccagtctaaaagatgtggaaaaggagacgaatcaatttggcactcttaagatttgccccattccttacttctagtctcttaggaggacaacggggacagtaagttttcgtgcaggtagcgtggccgagcggtctaaggcgctggatttaggctccagtctcttcggaggcgtgggttcgaatcccaccgctgccaggctggagtttttctggtggattacgcacctgctacagttctgttaacagttctgtgaggttacacctatttacatgcagaaagtaattttacgaattcccctggtaatggtttcaccatcatcttccgtgtttggtcttccagagagatcataggcctgcatccatcccagaagctaagacctgatggtaactgctgaagcaatatttcgtttcttcataacatctctattatttcgtttcttcataacatctctattttaacatgttttcaaatgttagctcaacttccaacatatttaaataatttattgtacgttctcttaacactgtgttataggactcaattatccggtaggaaaagcacaaataattggtagtgtcctagtttactttttttttttgtcgtattatcttgggtcataggagtatcccctctgtgaaaatcaattaacaatattcaacatgctgatattaaaagaaaagcttcaaggttccaccgagatttgaactcggatcgctggattcagagtccagagtgctaaccattacaccatggaacctccctc

SEQ ID NO: 2239 - DNA, 1211 bp, Homo sapiens
cagcgccttagaccgctcggccacgctacctgcacgaaaacttactgtccccgttgtcctcctaagagactagaagtaaggaatggggcaaatcttaagagtgccaaattgattcgtctccttttccacatcttttagactggaaatgaagaaccatcgagactgtggaccgcatagcagcagatggcagaacagataaacgagaagagacaaaaacacacagaaatttacaacaaaactagtttatttgggtgggactatatctgggagtggggagcgcctgagccggaaacaccccccaagcgggcagccggagctctgcactcgctcgctcagccattttcggttgctctccctccctgttttttcgacccatgtgcgccctctctctcacctggctaacatgctttgcgcccgctacctctacctggcttggcctctgagatccaaaccgcgccctcctggcatgtcccgcccaagtcccttagccccgctccccaaccctgccccattcccactctagtacccgtaagctacaagacgccgccgttcgtcgggtggctctgtggcgcaatggatagcgcattggacttctagtgacgaatagagcaattcaaaggttgtgggttcgaatcccaccagagtcgattttatttcaatttttcctttttatccgtttttttcttaaaggcccccatcccttctccccctaccctatctctctctttccacctggtttcaatttcgatctcagttcccgctctgctctcttctttacttacctgtctgccccggggcttgggccatggagagcaggactgagggtgggagacagaagggaagggaaagtgggcgtggacgtcgagataaaggcaggcccctggctcggggacacacggggatttaataaccactttattccatgcactagggactcgggaagggactgggactgggctgaggggcagagagagtacaatcctagacgcaagggagaagttggggcagggaaaagggacaggaaccagggaaatatatatttatatagatactctaatatagaccacatctcacccgcgcgctgagcccgcgcgccccactgccctccccaacacctgctcgcccggacgcccgggtccctctgctgccctcgggctggagtctctaccccacccctagaccccgcccccaccaccccccaaggctcaggg

SEQ ID NO: 2240 - DNA, 1274 bp, Homo sapiens
ttcgtattcctggaagaaggaaggcataggcttcggttttcccctcggaaactgcttctgctggaggatatgtgttggaataattacgtcttgagtctgggattatccgcattgtatttagtgctttgtaataaaatatgttttgtagtaacattaagacttatatacagttttaggggacaattgagatggctgaactactgaataaaaaaaaaacaacgctgttttctagtcctgcagaccgtaagatacttggtatcgcttctattttggttactacggtaggtgcctggcggaagggagtgggcggagatatgtaaatagaaagtgcgtacagttagaacgtccggcacgtaactgatcggagcattctgggaagaagtaatttattccttttcggcagccgaatgaaaaaaaaatttaaaaaaatgtgcgagctaatatggcaaaacaactggaaggacgctaaataataggattgctcataccagcgcgttatgaactcaccctagcttgtaacggaatctttttcactgagtgcagaatgtcggctgtttgtctgtatcgtcaggtgggataatccttacctgttcctcctccggagggcagattagaacatgatgattggagatgcatgaaacgtgattaacgtctctgcgtaatcaggacttgcaacaccctgattgctcctgtctgattctttctgacgatcacttacatttgtgttatgctgattagcagatatccacaaacatagctatgaagttctgactgggataaccttgctgtttgtctattttgcagtcttgctattgctgtttgtctattttgcagtcttgctaaatttgtttgttcttgaaaattgtgatttggtttttgttgctttctggaatttaggcagtgaaataatacaaatgggctctttgttttttgtcgtttgataactttaatcctcacttctcaggaaacattgcacatcagtaaatatctgcagtcttgtgcacatggtggttgccctcaggatggtattcaataggaactgtatttctttttccttgaggtagggtcttggtctgtcgccaaggcaggagtgcacggcgcagatgtatatacatggatacatttgtttttggagagttggttgttaaaaatctaccagtacacccccaagaaactcatcatcaccaatgacttcttcccaaatccagagtcacttttcagacttgagattgacctctcttcagcatatggtatgttgaccacccccctctttt

SEQ ID NO: 2241 - DNA, 1177 bp, Homo sapiens
gtagcgcgtctgactccagatcagaaggttgcgtgttcaaatcacgtcggggtcagcggctatttttcttcggtttttattaaccccctttattttaaactacggtcgagcttcagcgttcaggtcattgaagaagcaatatctccttggggcctgaaggagaggggtttctggaagttccaaggccgccccgtctggacagcccaaccatcgcgcggggatttttgcgatggatccgggtaccgtaattctgggcggataacgcgggtcctaagacaggagcagttctagacctctcagcagagggacgagggtcgggccatcacgcatggaagaagtcggtctctgatctacgagttctctttccagtgccgagcggattccttccaaatgtgcagccttcacgacgtaggcgagccccacctgcaggaagttcaggttccagagaagtgagatgcggagggcagtctgaacagcgagggctgtctgcagacgaggtggccgagtggttaaggcgatggactgctaatccattgtgctctgcacgcgtgggttcgaatcccatcctcgtcggctaaggaagtcctgtgctcagttttgtagcatcaaaactaggatttctcttgttacccccagtcactccattcagttttcgtgtctttcccagctgcatccatcctttcctcattttcgtatgcagccgactttttgtgacatctttgtattcattctctgcaattcagctgacctggccaaggaaacaagatcctaagcgtctttccggcggcgccgtggcttagttggttaaagcgcctgtctagtaaacaggagatcctgggttcgaatcccagcggtgcctccgtgtttcccccacgcttttgccaacattaaacattgtgaggacagttgcagaaactcataacttccatcctacatggtttactcacgtacccatctatcctctcccggtgcatctgccacacgctgttgggtttttgctcttcgtgcacatggtacttgcgcctcgacctgcagttacaccagtcgcatcatctgtacttgccagtactgtctgttactcgtctaggtgctcagttagtcagtgtttgtgttctgttttcatttctcataaagcagtcccacaactgaaggtttttcccgagagaactgaacagta

SEQ ID NO: 2242 - DNA, 1177 bp, Homo sapiens; identical to SEQ ID NO: 2241

SEQ ID NO: 2243 - DNA, 1141 bp, Homo sapiens
accccagtcagagtaaagttgcaggaagccagaggaggcaatacagtgggacagttaggaatgcacccggggcctcctgcagatttcggaaattggcaagctacgggattccttcctgaaagatcaactgtgtcttaaggctctccagcctatgcatactgtatcctgcttcagacttaggtacaattgctcccctttttatatatagacacacacaggacacatatattaaacagattgtttcatcattgcatctattttccatatagtcatcaagagaccattttataaaacatggtaagaccctttttaaaacaaactccaggcccttggttgcgggtcgctgggttattggggcagcgccgtggtcgtcactcagtcgctctgcatgctctctgtcatacagacaggtaacctagttctgtgttcacgtggcccccgactcctcagccacatcaagtctcctagaccactgtggactctaaactgcacttgtctctctcatttccttcaaataatgatcaatgctatttcagtgagcaaactgtgaaaggggctttggaaagagtaggaggggtgggctggatcggaagcaacacccatttggggttaccatgtccatcccccaaggggggccctgcccctcgagtcgatggtgtcccgcatctactcatgtgaactggccttggcgagggctggtctgtgcatagaagggatagtggccacactgcagctgaggccccaggtggcagccatggatcatgtagacttccagatggtctcccgaaccgcctggctctgccggcgccctcctcacgtcaggagcaagcagccgtggacccctaagccgagctggtggaaggcccctccccatcgccagccgggccctcatgctgaccttgcaaattcagccgctgctttgagcccaaaatgggaatattggttttgtgtccgaggcttgttccaagtttgtcaatgaggtttatggagcctccagaacagatgccatcttcctgaatgttgacatgccagtgggtgtgactccttcatttttccttctcccttccctttggacagtgttacagtgaacacttagcatcctgtttttggttggtagttaagcaaactgacattacggaaa

SEQ ID NO: 2244 - DNA, 1260 bp, Homo sapiens
ttgagacaatcattggtggggaactggatttttggatagcgtacaacacaacacagtcacaagggggaaaatgtgcatggggatcacacttgcattgcattactcaagtccccaagtccagtggttggtgggacgaatggtgggacaaccagaaaacatgtgtcttctgatgtaaataaacatgaagaccacatcacttctgtgaattatcatattacatgtcaagatatttgactcgaatacatcaagctttagacctaactctagtttactggatatatatgagctatagaaacaagttaagtgatacaatgagaaagtgacaaatgacagaaggaaaaacactctggaggatcattggcctgatctcctaaacttaactagtgctatttcaaagagacataaggaatacaacaagcagacacaatgcatagtcctgggttgcatataatatggggtggggggagaacaaaaaaaaaaaaaccccaaagcacagctaaaaagacttctggggacaattaggagattttgaatattgtctaaccattagatgagattaaaaaattattgaaaagattcttccacaggaggcctacacgccgccgcttgtgctgctgccatgtctctagtgatccctgaaaagttccagcatattttgcgagtactcaacaccaacatcgatgggcggtggaaaatagcctttgccatcactgccattaagggtgtgggccgaagatatgctcatgtggtattgaggaaagcagacattgacctcaccaagagggcgggagagctcattgaggatgaggtggaacgtgtggtcaccattatgcagaatccacgccagtacaagatccccgactggtttttgaacagacagaaggatgtaaaggatggaaaatataaccaggtcctggccaacggtctggacaacgagctccgtgaagacctggagcgactgaagaatattcgggcccatagagggctgagtcacttctggggccttcgtgtccgaggccagcacaccaagaccactggccgctgtggccgcaccgtaggtgtgtccaagaagaaataagtctgtaggccttgtttgttaataaatagtttatataccaaaaaaaaattattgaaaagatgaataatattaacagcaaagttacaaagcagtatgttcaatataaactcatttcactgcaacattataaaagatctcacaaggtataaattagtgttaaagaggtatcctgtgagtagtga

SEQ ID NO: 2245 - DNA, 1127 bp, Homo sapiens
tccttccagagagttatactactgtctcccttccccaccctttataaaattagttcattggctgtaccttcagaacatcaagcaatagtagtaataggaaacttagtcttatatccaatttggtaccaagatatatgaatagatttattactattatatatctagagcggaccaggcttgcttgtaggttaattgcttagtacctgtgtagtgctggataatatttaatgctgatatgtaacttgcgtttcttatgagatccacagtaaatttcttattgtattgtttgtactattatgtttgtattatttgttatcgcaggattgttattaatgtgataaaatgaattgggatgctttctgtattttctattctgaaataagtgtgggatattgcattggaatggtctgttccttgaaagttgcagagtctgtgatgccagatggaccagaactcctgagttaattctccggcagctttttttttccttcttgattactcatgtatttcttccattttcttaatttcaatataggacagtgctaaaaacataaacattaataaatatctattgaataaatgaacgtatgggtgaacaaattttataactattaatttcctagaagaaactttaaggaattatatttttaaagcatattttacactactcttacgtatctgagatcctcttccttttctagatcctaattttatggatttccttttaaattagtaaaaagatgtttcccattgattccttcctcctcctttccttgaaagtttttattttcatatattaaataaaacatttctagaaagttatttttgatgacataatatttggttccatgagtgcttaaagtctggagcctgagttcagattctggttctgccacttactagcagtggacaagttatttaacttctctgttctcagcttccttatcaataaaatgaaaataataatagaacttacctcatagagttacaagaattaaatactccaggactatgaccagtactcattaggcactattatataagagtttgtggaatgtgatatatttactaatcttatttattatatgatttggcacctatattttactattatcaatttatgaagg

SEQ ID NO: 2246 - DNA, 1195 bp, Homo sapiens
taagtggaatcatacaataattgttattttatgcctggcttatgctaattagcatactgttttcaaagttcatccatattgtggcatgtatcagaacttcatttctggttgagctcagtggctcacacctgtaatcccagcactttgggaggctgaagtggaaggatcccttgagaccaggagttcaagaccagtctggacaacatagtgagatttcgtctttacaaaaaataaaaataaaaaaattagccagtctgggtggcgagtgcctatagtcccagctacttgggaggctgaagtgggagaatcccttgaatccaggaggtcaaggctgcagtaagctctgatcagtctgctgcattccggcctgggtgacagagcaagtccctgtctcaaaaaaaaacttcatttctttttatggctttattaatattccattgtgtatatatacatacatatatatatgtatgtatatataccacattttgtttatcattcatctaatgataggcacttgggttatttccaatttggggctattatgaataatgcttctatgaacattggtgtacaagtatttatttgagtaccggttttccttttttttttttttttttttgagtataattgctgagacatatggtaattctgtatttaaattttttgagaattgacaaactgttttctgcagcaactgtacagttttacgttgccaccagcaatgaactatggttccagtttctccacatctttgtcagcatttgtaattttccattttttggactatagccatcctagtaagtgtgcagtgatgatgtcacattgtggttttgattttcatttccctgatgactaaggatgatgagcatcttgcatcttttcacatgcttattggccatctatatatcttctttagagaatacctattcaagtcctttgcccattttctgattctagtttcattttaaagtcatgattttttttttttttttttttttgagacggagtctcgctctgtcaccaggctggagtgcagtggcacgatctcagctcactgcaacctccacctcctaggttcaagagattctcctgccttaacctcccgagtagctgggactacaggcgtgtgcccaccatgcccagctaattattgtatttttagtagagatggggtttcactatgttggccaggatg

SEQ ID NO: 2247 - DNA, 1217 bp, Homo sapiens
aaccccatctctaccaaaaatacaaaaattagccgggtgtggtggcgtgtacttgtaatcccagctactttgggggctgagccaggagaatcgcttgaacccgggaggcggaggttgtagtgagtcgaaatcgtgccactgcactccagcctgggcaacagcgagactccatctcaaaaaaaaaaaaaaaattacaacctactgagaagctaattaagatttgtagtcctcaataatttacaaaaacttagaaaaattacctctaattaggtcttaaggggcttttgttaggatggacttaaatttgtaaagtcattaattgactgtcatcagaaatgcctgtcctgctctgcatctgcagtctctaaggtgtatgcgccttctccattcccccaggttttgagaacagagtgctgttttagagctggcagcagcatctcagcccaagagaaggtaagccttgagctggccaatgatcccttcaaccccatagtggaatgaataaacagctgatcttgttaaaactcgcttcaaaaaaaaaagatatcaaatgatgaaatcacccaaaatagctggaattaccggcagattgtgtagtggtgaacctatggttttctgaagatatctcttaccctgtgattgactgtcagttggtgcagaaagtgagattgaaatgtagtttctttgcaggttatattcccagaggatgtcagtcccaaggaccagtagctgccatcagtttggattctgaaaactaactggcatcaacactgggtgtagaaacatgcttgccttatgtatcagaggacatgctcagcagatccaagagatatatttggcaactttttctagaaaaggcacattgggtatcattcattacattcttgagtttttttgggtttttttttttttttttgagacagtcttgctgtattgcccaggctggagtgtggtggcacaatcacagctcattgcatcctcaatcacccaggcctaagcaatcctcccaccttgtagctgggactacagctcacagcacacctggctaaaattttttttttgttgagacggattctctatgttgcccaggctggtctcaggctcctgggctcagatggtcctcctgcctcagcttccaaaggcacaggccaagttgtagctttgtcccttgccatcatgcccaacaagaggttctataccttttaatgaattgactt

SEQ ID NO: 2248 - DNA, 1217 bp, Homo sapiens; identical to SEQ ID NO: 2247

SEQ ID NO: 2249 - DNA, 1166 bp, Homo sapiens
tttaccttttggaaaagaaaccgtcacattgctttggaaaaggttgagaggagacccctgttaagtcaagaagaaagtacagaggatgtcagaatctgatgagaacagcacattagtgtttattgagactccgatcttaactctcatttaattaatctgagctctgaaaacctatcttgcagcatttatctttaaaagagcctggttaaagtaaacctatactaacaattttgctttttctaacagtttgaggaagacctttttaaccaccacaaaacattctatggcaattcttgaaaatctcttaaattggagtctattatggccccatgaaaaccattaatcccattaagatagggagtataaacccctggctggtggaacaggttctgctactttaggagcaaggtggggtgtgagtagatggttttcatgccaagaacatgctttcactttgtattcatgcttgtgttggtgtgatggtctctgtgggtgggtggatgctttgggcgttgaaatctagaaatcctgttgctcagtttctagatgaagtcatgagcaaggccatcagtggagctctggccccgcccccaatgtgcagaagggccgggagcaaggcctggagttttcatgtgttttcagacccaggtttaggtgctctcttctcactgaaataactaagtgctctccactggcatcgagccctttccacaagtttttaaggctcttaacccacactttcactcctctgctactagtcttcagtgttgttaacagcaagagaaaattgggtttgtttaaaaatctacttctctgaggtggcacagttgcgtagctgtagtcccagctactcaggaggctgaggtagtaggattgcttgagcccgggaggtcgaggctgcaatcagtcatgatcgtgtcactgcactccagcctgggtgacaaagcaaggccccatatcagatatagatatacttatcagaccccccctgaccatttagattggcagtgctttgagaaatgcactatgacctttctgtgtcaatgggaatatacagaaggaacattcgggaccccgctgtcccccacagcctcattgttgtctccaggacactgctgggtcacacgaatgctccaggacagacagggacctggagtgcatcagga

SEQ ID NO: 2250 - DNA, 1409 bp, Homo sapiens
tggccttcctggtgaccccatggaccatgggagggaggtgaggtgaggtatggatgctgcccgggctcctgatgcccttagcatgggaggtaaggcagggtcccgagaactgggcatcgaggtgttcccctgccacttgcaaagccctctagcctggctgcatgtgggattcagccaggaggagtgctggaacccggtccccagaagggaccgtgcagggtcaacctcagaggactgccctgctggaggaaggtgccccaggaggtccgggatgaaggagaaggaagctcagtaaagagcccaggtagccccaagaagatgaccaggtgtgggagggaggcttggcttggcaggggagcgactgtgaaagtttagtgacgctggttttatcttgctctagtttctctaagacacccacgggcgttgcaaaaccatcttccactcaatcatccatgtcttcagctacaaccccaagagtgctcgaaagcaacccacggtgtggcagttcctcaagaggttacaggcctttccgctcggctgttttcctgctcaggagccgcagggccgtaggcagccatgacgcccagccggaatggcatggtcttgaagccccacttccacaaggactggcagcggcgcgtggccacgtggttcaaccagccggcccggaagatccgcagacgtaaggcccggcaagccaaggcgcgccgcatcgccccgcgccccgcgtcggggcccatccggcccatcgtgtgctgccccacggttcggtaccacacgaaggtgcgcgccggccgcggcttcaatctggaggagctcagggtggccggcattcacaagaaggtggcccggaccatcggcatttctgtggatccgaggaggcggaacaagtccacggagtccctgcaggcgaacgtgcagcggctgaaggagtaccgctccaaactcatcctcttccccaggaagccctcggcccccaagaagggagacagttctgctgaagaactgaaactggccacccagctgaccggaccggtcatgcccatccggaatgtctataagaaggagaaagctcgagtgatcactgaggaagagaagaatttcaaagccttcgctagtctccgtatggcccgtgccaacgcccggctcttcggcatacgggcaaaaagagccaaggaagccgcagaacaggatgttgaaaagaaaaaataaagccctcctggggacttggaataaaaaaaaaaaaaaaaaaaaaaaaaaaaggaggttacatacagctttccatctggcccaacaaccctacttctgggtacatgcccagaagaattaaagacaggtattcaaaccaaaacttgcacacagatgtccatagcagcattaatcacattcactaaaaggtggaaataacc

SEQ ID NO: 2251 - DNA, 1149 bp, Homo sapiens
caggtggggcctcagtttcctccctgagaactcctgagtcctctggggtgtgggctggatgagagcagcctccctcctcctggagctgctgtgcaggcctagaatgctggtctagagggaagcagggacctgaccatctccccaacctcttgcctaagcccagagcagctcggcctagccctgcatcccctgtgagctgagcactgggagggactgttcagtctcggctgagaagtaggtgatggtcctgggggactgataattaaagctcagcagattataattccctgaaagaaagctcagcacagagagggaggaacagtgcccagagccttggcacaggctggaggaggattgctgggggaggtggtggtggggggaataagaatgatacctggaaccatcgtgttcagagcttcctctcggtgaggcctcctaggtgcccagccctgggcactttgctgtttccagtcttcagaccctccttgccaatgaaaggttcctgccatccccattttacagatgaagaaactgaggcttggaaaggtctggcaactgtggttcaaggcccatggctggtaagaagtgagcctgcggctaaaccctgggctgtgttgggagcgttggcctccttactgagaagaaggcactgcttaactcagagagaggctgtctgatggcagagtcctgggcaggccacaggcctgaagcaggaacaggttggagcagggaagacccctcaggacattccccatgtttgtggccttctgtctgggagagggggatgggatcaggggtcacactgtggtgactggatctgccattcacttagtcacctgttgtgtgatgccaggcaggtgacgtccttccttgggcatctcctctataaagggcttgtgttctcctggggtttgcaggcttctttaagaatctcttcctccctcattaatcctacaggtcccaactgagcctgttctcatgccaggagctcctggcacactcctttcatcacctgccggagctgggctctattatcatccctatttgacagaagagcacaccaaggcccagaggctactgctgcctggcggtcagccttctcctcaccagttaaacctgcttcgtgcagtcctgctgcccagcttgttg

SEQ ID NO: 2252 - DNA, 1150 bp, Homo sapiens
taccatgttcttttgctgctcaaatctttttagctttggagctattttagttggcttctttgatgtacttccaccattgtgtttttccagcacttcctcactttctgacactgcaagatgcctcaggctcattttgtatattccctgccctggcctagaatctgccatttctctaaggagccctggttcctttgattggagaatagcattagaaactaccatctgggcgctgacttacttttttacagaatcactctggctgttgtgtagatagcaggttatagcagggcaaagtgaagtgggacagtggagaggttgctagaatataggccaagtgagcaacaaccaaagctctggacaggtgctggggagcagcttctaactcagttcagctgaacaatttgagcccacacccagtttccattgctctgggccaggcacaggggatggtggttaacagctaccttttcttgagtgcttgctgcaggctgggcagtgtttagttttatttgttgtactgtctgcctatatgattggtatatgtatcagagagagagagattgatagagaagccgctctagttaccaagagccgtgacccttgaagtctgggcccatggcagatcccacctgccttattgggagtataggctctcccaccgtgggagggcccaggtcttacaggggccagacagaatcagggagtggccccgaggttggttgctggctgtctcaacagccattgctcttggggccaccgtgtctatccctatacctgtccactccaccaggtttttctcatttcttgagtttccaggagatccccaaggctgagggtttctggatttgggaactcgatgtatttccatcacatgccacattctggacttgagaggtctaagggtgccttggggagggtgcccccagtcttcctgccagtcagccaggaggcagggtctggatagctggccctgcaactcagagtctcaggcttctcgttcctggggccctgctgattaggatggggcaggaggcatggggctgggtttcttccctccctgggtctgcccactgcttggctggcctcagccacagcatctatcactgatgttacagtgtttggagtgaggcacatcccgggccttatcttt

SEQ ID NO: 2253 - DNA, 1192 bp, Homo sapiens
cttggtattcctcctggatggaaaggctgttggcatcaataggggacagaggctgatgctggagtggccagtagaggtggtggagcagagcagccatcttttaagtggggctgtatcaggctgggtttatttaaaagcaacaaaatgttttggttaagaaaattattttgctttcagtgtaaatcttcgcagtgttctaaacaaagttcagtcttctgctcgcccctttccctcactgatgtctgcacttggttgaggtctcctggagcctcacaggctctgctgttctccacttctcacctgccatccacgccctgcaagctcatgcaaacaccctttcttcctcctgcggcagagttgttcaggttgcctgggcaggggcttaaacagtgccagcccctgccatcccaaagctattgttaagccccccaggcgtcctccacccacgcccactagcctgccatgtccacagttccttgggctgctgaggggctagtgcagtggtcctgacctctcttatcaagagcacacttctttgctggttgctccttttgagcatatgcgtgtgattatttggaacagttagacttgccacgttgggtcagttttagaaattgtttctagctagagggactggtgtccttccaagtctagcatttggggtatggaaaattgttgtggtgtgtggtagggtttttgttttcttttttgagttttttttccccctttagtctcctggctttttcctttcccttcccttctccactggccagcttgggcctcatcctcatgtcatccttctaggaaggcgcctgccccatcttgtctgccggcagcatgcatccaaggccagagctcaggcctgcagactgggctggtgcctcctccgcttcagggtatgggagttggtgaaggggctttcaaaaaataataaggaaaaaaaggtaaagtctttggtagcttctatccactcagatcctggaaggcagcaaggttttgtggatctagattcattaggaatgtcttcttgtcagccaggccaggacccgggcttgccaagagcagaggccctcccagcaaccaggataccaccactttgggggctttgtgtacagaggtccgggtctgagacctcataggctgcagaaatctggggcagccaccatcaagaagcccctctcaggggccagaa

SEQ ID NO: 2254 - DNA, 1139 bp, Homo sapiens
cctcccaggctcaggcatcctcccgagtagctgtgaccacaggcatacaccacacctggctaatttttgcattttttaaagacaaggtttcaccatgttgcccaggctgatcttgaactcctgggctcaagcaatcctcctccctcagcttcctaaagtgctgggattacaggcatgagccaccgtgttcaggacttgccacttctgcatgtcagttctaacctcacccctcccctgactctcccgacagggacttctggagccccgtcctggacaggagacagaggaagaaccctggagtcggaagccagaagcaaaaggccccgggccagttcctcagacatggggtccacagcaaagaaaccccggaaatgcagcctttgccaccagcctggacacacccgtcccttttgtcctcagaacagatgagctcagggtagggtagagaacgccactttctcagacctgtcccctttgtgtttagaaatgagttaaccaggaccaagtggccatttagtgtcctggaaacttagaggacagtgttggcctttggagtcgggccttcttgtgttaaggggcacaaggtccagatcactctggagcaggccagctctgctggacagtgaccctcttcccaggcctcaggagtgaccatagccactgctgaaaagtcacgcagctgctccctcggaccccccaaggatggttgctgttagcagaggattggtgcagtcccagctgaagcccactgtgtgccaaaggaagaagctcccagggctgcttccttcacctgcagaaagccccaagtgagccaccagcactcatggggcagtccctgtccaggctgcccagggcttctcatagacgtcctgagaaggacggtgtaatgcaaggaaatggctgtggtaacactgatccttcagaagaagcttcattccctcttaatctagttaagccaggacatccagaattcattgctttaataaagaacccaggccgggtgcagtggctcatgcctgtaatcccagcactttgggaggctgtggggggcggattgcctgagctcaggagttcgagaccagccagggcaacatggtgaaaccctgtctctactaaaatacaaaaaattagccaggtgt

SEQ ID NO: 2255 - DNA, 1186 bp, Homo sapiens
ggataagcagcttcccttcatgaagaagttgccatttctctggccttcatatttacctactttttgttattgttatctgtatcggttcaatctcacactgctataaagaaatgcctgagactgggtaacttataaagaaaaaaggtttaattggctcatggttccatgggctgtacaggaagtatgactggggaggtctcagggagcttttactcatggcaaaaggcaaagccagagcaggtatcttcacagggctagagcaagaggaaaagagagaggggaggtgctacacactttttatgcaaccaaatctcatgagaactctatcacgagacagcagtagggggacagtgctaaatcattcatgagaaactacctgcgtggtccagtcaccttgcaccaggccccacctcccacattggggattacaattaaacatgagatttgggtggggatacagatctaaactgtatcattactcaaaaaaaaaaaaaaaagaaaaaagaaagaaaacacaggaaaaggaactcacctcttttatcatcttagtatttagtactaatggtttagagcaggagttgacaaactgtggcctggactcatggaccaactctggcccaccacctgtttctcagaagaaaattttattggaactcagccacacttactcatttacatgttgtccttgactgcctttgtgtccagtgtcagaactgagtagctgcagcggaggttgtgcctctgggctttaatatcacaaacagagcagcttataagcaacagaaacttacttctcacagttttggaggctgggaagtccaagatcaaggtgtcaacatatttagggtctagggaaggtctgcttcttggttaatagaaagcacctttcactgtgtcttcacatggtagaaggggagagctctggtatcttcaggcccttataagggcactaatcccattcatgagcgctccaccctcacgacctaatcacctccaaaaggccccatttcataataccatcaattaagtttcattatatgactttgatggggatatagcccatagtaggttctatgtccctgaaagcctaaaatatttactgtttggctctttacagaaaatattttcttggcccctgttccagagcattcatcaagaagtcagataaagggtttaaaccagtcag

SEQ ID NO: 2256 - DNA, 1268 bp, Homo sapiens
tgaactcagccagcttccctgactcaaacgatcatcccgcttcagcctcccgagtagctgggactacagacggtgccatcacgcccagctcattgttgattcccgcccccttggtagagacgggattccgctatattgcctgggctggtgtcgaactcatagaacaaaggatcctccctcctgggcctgggcgtgggctcgcaaaacgctgggattcccggattacaggcgggcgcaccacaccaggagcaaacacttccggttttaaaaattcagtttgtgattggctgtcattcagtattatgctaattaagcatgcccggttttaaacctcttaaaacaatttttaaaattacctttccacctaaaacgttaaaatttgtcaagtgataatattcgacaagctgttattgccaaactattttcctatttgtttcctaatggcatcggaactagcgaaagtttctcgccatcagttaaaagtttgcggcagatgtagacctagcagaggtgtgcgaggaggccattaagactatactttcagggatcatttctatagtgtgttactagagaagtttctctgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccgggccgtttccgggctgttcgctcctgcttggcaatgtcgcgagaaaggttttcgcctcctgtttcagcggtgacggcttttgggttttcctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggagtgcagtggcgcgatctcggctcctagcaacatctgcctcccgggctcaagcgagtctcccgcctaagccctcccgagtagccggggcttaaaggcgcacacgccactccaggcttttttttttttttttttttttttttttggcagaaacggggtgtcagcatgttagccaggctggtctccaacgcgtgatctcaggtgat

SEQ ID NO: 2257 - DNA, 1200 bp, Homo sapiens
taactgatcagagctcactgcagctttgaactcagccagcttccctgactcaaacgatcatcccgcttcagcctcccgagtagctgggactacagacggtgccatcacgcccagctcattgttgattcccgcccccttggtagagacgggattccgctatattgcctgggctggtgtcgaactcatagaacaaaggatcctccctcctgggcctgggcgtgggctcgcaaaacgctgggattcccggattacaggcgggcgcaccacaccaggagcaaacacttccggttttaaaaattcagtttgtgattggctgtcattcagtattatgctaattaagcatgcccggttttaaacctcttaaaacaacttttaaaattacctttccacctaaaacgttaaaatttgtcaagtgataatattcgacaagctgttattgccaaactattttcctatttgtttcctaatggcatcggaactagcgaaagtttctcgccatcagttaaaagtttgcggcagatgtagacctagcagaggtgtgcgaggaggccgttaaggctatactttcagggatcatttctatagtgtgttactagagaagtttctttgaacgtgtagagcaccgaaaaccccgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccgggccgtttccgggctgttcgctcctgcttggcaatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggagtgcagtggcgcgatctcggctcctagcaacaactgcctcccgggctcaagcgagtctcccgcctaagccctcccgagtagccggggcttaaaggcgcacacgccactcc

SEQ ID NO: 2258 - DNA, 1284 bp, Homo sapiens
ctgatcagagctcactgcagctttgaactcagccagcttccctgactcaaacgatcatcccgcttcagcctcccgagtagctgggactacagacggtgccatcacgcccagctcattgttgattcccgcccccttggtagagacgggattccgctatattgcctgggctggtgtcgaactcatagaacaaaggatcctccctcctgggcctgggcgtgggctcgcaaaacgctgggattcccggattacaggcgggcgcaccacaccaggagcaaacacttccggttttaaaaattcagtttgtgattggctgtcattcagtattatgctaattaagcatgcccggttttaaacctcttaaaacaacttttaaaattacctttccacctaaaacgttaaaatttgtcaagtgataatattcgacaagctgttattgccaaactattttcctatttgtttcctaatggcatcggaactagcgaaagtttctcgccatcagttaaaagtttgcggcagatgtagacctagcagaggtgtgcaaggaggccgttaagactatactttcagggatcatttctatagtgtgttactagagaagtttctctgaacgtgtagagcaccgaaaaccacgaggaagagaggtagcgttttctcctgagcgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccggggcgtttctgggctgttcgctcctgcttggcatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggattgcagtggcgcgatctcggctcctagcaacatctgcctcccgggctcaagcgagtctcccgcctaagccctcccgagtagccggggcttaaaggcgcacacgccactccaggctttttttttttttttttttttttttttggcagaaacggggtgtcagcatgttagccaggctggtctccaacgcgtgatctcagg

SEQ ID NO: 2259 - DNA, 1210 bp, Homo sapiens
ccgcttcagcctcccgagtagctgggactacagacggtgccatcacgcccagctcattgttgattcccgcccccttggtagagacgggattccgctatattgcctgggctggtgtcgaactcatagaacaaaggatcctccctcctgggcctgggcgtgggctcgcaaaacgctgggattcccggattacaggcgggcgcaccacaccaggagcaaacacttccggttttaaaaattcagtttgtgattggctgtcattcagtattatgctaattaagcatgcccggttttaaacctcttaaaacaacttttaaaattacctttccacctaaaacgttaaaatttgtcaagtgataatattcgacaagctgttattgccaaactattttcctatttgtttcctaatggcatcggaactagcgaaagtttctcgccatcagttaaaagtttgcggcagatgtagacctagcagaggtgtgcaaggaggccgttaagactatactttcagggatcatttctatagtgtgttactagagaagtttctctgaacgtgtagagcaccgaaaaccacgaggaagagaggtagcgttttctcctgaacgtgaagccggctttctggcgttgcttggctgcaactgccgtcagccattgatgatcgttcttctctccgtattggggagtgagagggagagaacgcggtctgagtggtttttccttcttgatggctcaatgacagagactagctcgtaaactccggggcgtttctgggctgttcgctcctgcttggcatgtcgcgagaaaggttttcgcctcctgtttcagcggtgacggctcttgggttttctcggggtggctttttaattttagtcttggcgcgaggcgggggatgctgtgtggcacctcctattgtctctttttgcgttttctcccattctcgctccctcttttgtcgccgtttcccgcccgccactcccacccccagacggggtctccgggtctcttgttctgtctgccggccccggctggattgcagtggcgcgatctcggctcctagcaacatctgcctcccgggctcaagcgagtctcccgcctaagccctcccgagtagccggggcttaaaggcgcacacgccactccaggctttttttttttttttttttttttttttggcagaaacggggtgtcagcatgttagccaggctggtctcca

SEQ ID NO: 2260 - DNA, 1206 bp, Homo sapiens
atccataaagactgagagagaaggctattttttttcaaatgcgtacaactcaacaaaaaaaatatcacaagccacacaataaagcagggaaatataaccaaatcaaaggaacaaaataaatctctagaaactgcctccgaagagatggagatctataaactatcggattaataattcaaaataattgtcttaaagaaacacagtggcttcttttccgacaaaacaccaaatggcggatgacgccggtgcagcgggggggcccggaggccctggtggccctgagatggggaaccgcggtggcttccgcggaggtttcggcagtggcatccggggccagggtcgcggccgtggacggggccggggccaaggccgcggagctcgcggaggcaaggccgaggataaggagtggatgcccgtcaccaagttgggccgcttggtcaaggacatgaagatcaagtccctggaggagatctatctcttctccctgcccaattaaggaatcagagatcattgatttcttcctgggggcctctctcaaggatgaggttttgaagattatgccagtgcagaagcagacccgtgccggccagcgcaccaggttcaaggcatttgttgctatcggggactacaacggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggctgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcaccaaggccacctttgatgccatttctaagacctacagctacctaacccccgacctctggaaggagactgtatttaccaagtctccctatcaggaattcactgaccacctcgtcaagacccacaccagagtctccgtgcagcggactcaggctccagctgtggctacaacatagggtttttatacaagaaaaataaagtgaattaagcgtgaaaacaaaacaaaaaaaagaaacacagtgaccttcaagaggacacagataattaaat

SEQ ID NO: 2261 - DNA, 1197 bp, Homo sapiens
tatttatttatttatttatttatttagagacggagtcttgctctgtcatccaggctggagtgcaatggcacgatctctgctcactgcaagctccgcctcctgggttcatgccattctcctgcctcagcctcccgagtagctgggactacaggcgcccaccaacatgcccggctaatttttctgtatttttagtagagacggggtttcaccgtgtcagccgggactgtctcgatctcctgacattgtgatccgcccgcctcgccctcccaaagtgctgggattacaggcgagtcaccgcgcctggcgcaattttgtttatatgattctgatatcgtcccatttaacacatcaaaaaatgcacaaatacatactttaaaaacattctacagttctttgacttttaaaaaatatctttcaaaaatctttttaagaatgcttgacattgtatctaccctcttaacatgcagacatgcacacgcagggtcatgcacacacacactggctgggactggcagaaggggccactgtggtgtgcctgcaagcctaggggtgggcccaggtggcaccatggcaggggcagatcttggtggtagtagtaaatattcaaatgagcgttttgaaggccaaagtggagaaggattccatgtgaaaagcagttgaacatgggtcagtcggtcctgagacaggcgagcatcatcccaaaggagtaggcattggcctcaatcgctgtcagtgatagaaagggagttgggtttggattcccaaatccagagtggcggagataggaaacaccaagttgccttctccagtgctgtatcctggaggagccggcaggagcccagggagagatctctttttcttgtgaagtgcagggcgtgctagaataaattcacagttctggagacttctagtggcacttgagaatccggggaagggggtgcaaatctccgtggcccatataccagcaggtctcccaggtgaacagcctctggacaaagtaggtaagggaagtcatccagccaatcacttacttgggaataaaaatgggctctaagggctcgtcaggtactcttgactggtgaatatggtttggatgtctgtcccctccaaatcacgtgttgcagtgtgatctccagtgcttaaggtaggatctggtgggaggtttttgcgtcatgggggtagatctctcatgagtgg

SEQ ID NO: 2262 - DNA, 1101 bp, Homo sapiens
ttgtcctctcctgagggagaccttttcctggtcacccagttgactggttttcctgcttccccacccacccctccagcatagggcaaatgtcttgtcactctctttctgtcagcagcactgactgaccacagctttgttcacttcgttgattttgttatcctgccacatttaggagatttgggaaccaagaatcaggtctcaaattaattaagaagatctctcttcgtgtgtgtgtgtgtgtgtgtgtgtgtgtgtgtggtgtgtgtgtttaatgaagtagcaaatgaaaggttcggaataccagggacagaaggtagaggggttttctaatgtgcctttgttttctgctcagttcttacctgcattgttccccagccctttgttgggaggagcagcctctccttgaattgttttgtgatttgagtaaaacgggactccccctgttctagagaggatgggcagaaagaaattcattccaagtgaagctttgtggacatagcctgatccttgcttttccctttagaacatgacctgcctgcctctcccacatgtgagatgactgactcagctttttatttctcctttgggacctaggctaggtgggcttttctactctctactagagctattacaaaatagccgatatgtaaacattctcataacaaaaacccaaccagaaaagccactgtcttaaagccctgttctatcctctccctttgtaataccgtcctaagtcagttgctccatgggatgcgatggcccagtttggcaggaccatctgttcctggttaaggaaaccttgtcctatgaccaaggagccttgacctatatagccacaggtccttgtctaggaggtaaacatattgccagcacccagcacagtgactgacatgagtgagggacaggcgggaagaggccaattggtaggtattgccagatccaaattggaaatggtggtggcttgtagagggtggtagcaggggagatagtggaaagggaagggggtatttttgggatcaagcagcaggattggctgatggagtgaatgttggaggagggggtgaatgagagaggatgactcctgggattttggctggagta

SEQ ID NO: 2263 - DNA, 1148 bp, Homo sapiens
actcctgacctcaggcgatccacccacctcagcgtcccaaagtgctgggattataggcgtgagccaccgcacctggcctatgagtggtcttttaattaggaacaaatctaatggaaaggagagttgactgaagttggcccacaggattgtgagctgggcagtgccttcatgaaggcttgccaccttgggacgccccagtttactggggtgtcttgcggagtgcagaaggctttctggcagctgcctgggtttggccagaccctgcctcccctcccgccggccaacccctagtccccttcctgtctccacttgcattcaggggtggctgctgttctgagaacattagaactgggaagagagatggagtcacatggatttttggtgggcattattctaaactttcgtatccaagttagtcccccttattccactgtggcattgccgttctaagcagttacctgatgcctgctgctgaagagctgctcacaggaggcggcggcggccctggcactgccccttgcattaggtcttgtgtttgatgtgttcttgtgaatttactttgtcagaacaaaatatttacgcgttgggttcaggaatttcttttagctccccatctggctgtgaaattcaggaaacctcccgttgcctagtaatcaccccatgtaggtgtacattgtgacaaagtgcatctgaccactaaggggcccccttggtgaccccagcacattcacagcagtgttaaaatggcctgcattttggagatgctggctggcctttcagtgcctcccaggaagacacatggcctttccctcttcagatgcctgaagggagtgctttgaggcaggtgatgtgctgggagtgtgggcggcctccctctggccccggggccctctgtggaccttggctccctccgtggacctgggcttcgtggtgagcactgcagcctccctgggcattccctccagcgccagcaccactgcaacatatagacctgagtgctattgtattttggcttggtgtgtatgctcttcattgtgtaaaattgctgttcttttgacaatttaagtgattgttttgtttactgtaagtttgaaaataaaaatgaagaaaaaaattccaatgactgtgctgtggttggagactttatt

SEQ ID NO: 2264 - DNA, 1182 bp, Homo sapiens
catcaaccttttttttccatttgttttttcaagtgtctatttggcccaggttccatcccacttcattttcaacccaaggattggttactctgttctttgtctctggctcatgattggttctttcgttccgcccctctcttccagcttttgcaggcgggattaccacgcagcttcctgctcctgccaaaaaaaaaaaaataaataataaaagaagaagaagaaaagaggagagaggcgaaagaaaaatgtcacaaagatctttgctttttaattggctttaagccttgtcggtcaagccaaactctgcctttgattggtctttctatctgcccatcccggatcgggggcgggatttccccggaagacccacaccttgttgccactggccgaacagtgcgcctgtctgaagctcctggcccaggattggaggcggtggcggacaggtgggcgtggattggctagggcagccggtccgtgcaaggcgggggcggggcctcggcggctggttgcgcgtgtccgacgctggctccgctctatccggctttgctaggggaggtgagtccggccgcggcggaaccggcggctgaggaggcggcggctgaggagaaggcggccgcggcggctgaggagaaagcggccgcggggacggaagccgggtgggggggagggggggagacggagcagccttgagccctgcggggccgttgcgcgggggacccacccgctctcccccccaaccctcctcagcagaagcagccggcggcgggggcaggagtcagcccgcttccgaccgtaccccgcccgcctcccggggctcctgttctttggccccgggaccctaaccttctcccggggcggttccctccgtctgggcgtccgagcgctgcccacatctttcattcctccctgcacctccttcccttcacttttgccccggctctctttctcctctctgtcctgctgtcgcctcctctcctcactccagcctccttccctggcttattctgcccaggaaagtttggaacccccgccccccctccccaatcaggtcaacctgactaggagtagggggagatgtaggaaggcctgagagttcggggggggggaagctggaagctggtttcccagaaaatttccccccatcttctccatttagggtggtgggaattttttttaatcctg

SEQ ID NO: 2265 - DNA, 1213 bp, Homo sapiens
tagcagacggtttcaatagacattctccaaagaagatatacaagtggacaagtatatgaaaagttgctcaacaccactaatcactaaggaaatgcaagtctaaaccacaacgaaatatcttctctgcaacattccaattttaatatgtgggctgccgaagcaagcacaaaaccacaatgaaacaccacacacccactaggatggctgctgttttaaaaaagacaaaacactcttcctaagccggcgctcggcaagttctcccaggagaaagccatgttcagttcgagcgccaagattgtgaagcccaatggcgagaagccggacgagttcgagtccggcatctcccaggctcttctggagctggagatgaactcggacctcaaggctcagctcagggagctgaatattacggcagctaaggaaattgaagttggtggtggtcagaaagctatcataatctttgttcccgttcctcaactgaaatctttccagaaaatccaagtccggctagtacgcgaattggagaaaaagttcagtgggaagcatgtcgtctttatcgctcagaggagaattctgcctaagccaactcgaaaaagccgtacaaaaaataagcaaaagcgtcccaggagccgtactctgacagctgtgcacgatgccatcctcgaggacttggtcttcccaagcgaaattgtggtcaagagaatccgcgtcaaactagatggcagccggctcataaaggctcatttggacaaagcacagcagaacaatgtggaacacaaggttgaaactttttctggtgtctataagaagctcacgggcaaggatgttaattttgaattcccagagtttcaattgtaaacaaaaatgactaaataaaaagtatatattcacagtaaaaaaaaaaaataatgagtattgttgaggctgtgaggaaatcggaacccttgtgcgctgttggtggaaatgtaagatggtgcagctgctgtggcaaactgcatggcatttccttaaaaaaaaaaaaacgaaacatagagctaccagatgatccagcaatactgcttcttggtatatatccaaaagaattgaaaggaaggtctcaaagagatatttgtacacccacgttcataacagggttattcacaatagccaaaaggtgaaagcaacccaaatgtctattgacagatgaacggataaacaaaatgtggtatataca

SEQ ID NO: 2266 - DNA, 1370 bp, Homo sapiens
gggtcactttcaagctaccatctgcccacgatatggatctatattctcagcctgtttataatgtaggctggttcacttggaaggacccaaaatggcttagcagcttttctttccctactattgggtctctatatgagcaacaaagattagccaagttcttacctaagcagaggtagtaagaattcttttcttttttgagtgcactatcttgcacctgtaattgtatgtcgggaactgaattgactgccttagacaactacttttgtttcctttggcaggaaggcagcaacaactcatctccagtggattttgtaaataacaagaggacagacttatcttcagaacatttcagtcattcctcaaagtggctagaaacttgtcagcatgaatcagatgagcagcctctagatccaattccccaaattagctctactcctaaaacgtctgaggaagcagtagacccactgggcaattatatggttaaaaccatcgtccttgtaccatctccactggggcagcaacaagacatgatatttgaggcccgtttagataccatggcagagacaaacagcatatctttaaatggacctttgagaacagacgatctggtgagagaggaggtggcaccctgcatgggagacaggttttcagaagttgctgctgtatctgagaaacctatctttcaggaatctccgtcccatctcttagaggagtctccaccaaatccctgttctgaacaactacattgctccaaggaaagcctgagcagtagaactgaggctgtgcgtgaggacttagtaccttctgaaagtaacgccttcttgccttcctctgttctctggctttccccttcaactgccttggcagcagatttccgtgtcaatcatgtggacccagaggaggaaattgtagagcatggagctatggaggaaagagaaatgaggtttcccacacatcctaaggagtctgaaacagaagatcaagcacttgtctcaagtgtggaagatattctgtccacatgcctgacaccaaatctagtagaaatggaatcccaagaagctccaggcccagcagtagaagatgttggtaggattcttggctctgatacagagtcttggatgtccccactggcctggctggaaaaaggtgtaaatacctccgtcatgctggaaaatctccgccaaagcttatcccttccctcgatgcttcgggatgctgcaattggcactacccctttctctacttgctcggtggggacttggtttactccttcagcaccacaggaaaagagtacaaacacatcccagacaggcctggttggcaccaagcacagtacttctgagacagagcagctcctgtgtgggtaagcg

SEQ ID NO: 2267 - DNA, 1098 bp, Homo sapiens
gtgtggacctcttgaccaagccctcagctgaccccagcccacctttgccctggtgggacaagagccgtcttctgttccatggagactggcacatggacattgaacaggcgaacctgcaccagctggccactgaggtgaggggtgtcatgatacttttatcctatcaggatggtatggttgaggtctgtatagcacatgtgggaagagagacaggtgctgatttgggagatgaggatggttttcttacctatatctcaccaaattctcgggggtggtcataggatccatacaacacaactgaaaatatgcactgggagtggagccacctgtcttttcattggaaacctggtcagtttgtgttcaagggtgacttggatatcaacgtgagaacagcctctaagtgagtggagtgaagggagggtcctccatgggatgaggggctcaggttggagggagggggaagagccaaggggaagtgagtgaccagggcactgagggctggggttccattgtgaggcaggtatgacgactgctgcttccttcacctgcctgacctctgcatgacactggacctgcagtggctgtgccatgggaacccccatgatcaccatagtgtcactctgcgggccccagagttcctgcctgaggtgcccttgggccagcttcatgactcctaccgggcctttcgctcggagaacctcaatctctccatcaagatggatctgactcggcacagtggaagtgaggcttgggcctggggcagtggggaggaagggcttgggaggacgggcatggatgctggggactttagcttgaccctctggggaggggaggggaggggagaagggcaagggagaatctaggttaggacctttttttttgttttttggcaggggaaagggttggtgtcttagtcctttttggctgctataacagtaataccacaagtttggtagcttataaacaacaagcgtttatctctcacagttctggaggcttgaaagtcgaagatcaaaaagagctgatagattcagtgtcagtgagggcccattcctcatagatggtgcctttttgctgtgtcctaatatggtggaagga

SEQ ID NO: 2268 - DNA, 1191 bp, Homo sapiens
tcacaagatggcgccgaaagcgaagaaggaaggtgtgtgttggtgatggggccgcagctggtttaccggggattgccgcgccgcagagcgaacgaattgggaacacggctgctgggctaagccctgagggctctgctccggggctgctccctgcgtttcggacacgctgcagtatacgtgggccgcgtgggcccagcctcgtgggctgagttccggtagagggagttgggggggggcaacgcggcaggcatcatccgccagggagggccagacattcggttctgggaagctacatgcatccactggttggagctccatgtccccgggcctgtaaggaattagtgccctcagctttaaccattttccttctggttcatgttcaaccgggctacattacccgcccctctctccgcagcgtggttttgcgatggggtatgtgtaaaattcgtaggacattttctggaaagtatcaagcgttcattcagtgctactttgtttcatagtcgtatccctggagttacttagagttggtcgctttcgcctctggtatcgtgcatatgatggaaaagttttaatctcctgacacttgtgatgtcttcaaaggaaccactgatgcacctgtggccagggtggcccactgcagttcttggggccggaagtgaccgatttctaaatcccgcacccacgttttctttccttttctcccagctcctgcccctcctaaagctgaagccaaagcgaaggctttaaaggccaagaaggcagtgttgaaaggtgtccacagccacaaaaagaagaagatccgcacgtcacccaccttccggcggccgaagacactgcgactccggagacagcccaaatatcctcggaagagcgctcccaggagaaacaagtcagtactgccccctgtacccatgaaaagatttgggtattctccattggtaatttggaaattcactcactctgcgtgatggtttctcaaacgcaaattgtgtccagtgtgcttctctaattggaagtatgaggagattgtttctgctgcatttacaaaactggcaggatcagcccagaggccgggcgcggtggctcacgtctgtaatcccagcactttgggaggccgagggggggcggatcacttgaggtcaggggttcgagaccagcctgagtgacatggagaaaccccgcgtctat

SEQ ID NO: 2269 - DNA, 1191 bp, Homo sapiens; identical to SEQ ID NO: 2268

SEQ ID NO: 2270 - DNA, 2198 bp, Homo sapiens
gtggctaacacggtgaaaccccgtctctactaaaaatacaaaaaaaattagccgggcgtggtggcaggcgccgctagtcccactactgagtcccaggctgaagcaggagaatggtgtgaacccaggaggcggagcttgcagcgagccgagatcctgtcactgcactccagcctgggcgaagcgagactctgtctcaaaaaaaaaaaaaaaaaaggaatttgcccctggcccgattctcctgcctcagcctcttgagtagctcggactacaggcgtgcaccaccatgaccagctaatttttgtatttttagttgagagggagtttcaccatgttggccaggatggtcacgatctcttgacctcgtgatcagcctgcctcagcctcccaaagtgctgggaatacagccatgagccagcacacctggcccagagatgattctttaatcacttgaggttgtaagagcccttcaagagaaagaaaatgcacaacgttctgcccctgggattggggcttcaggcccttagatttcagggtgcagatgatgacactgtaaagcgaccaaagtctgaacaaagtgattggtacctcgttgtctgatgcacctaggctctcctggctctgggctccaaaagaatgggcccaggccaggtgaccccattttgcctctcccaggcttgaccactatgctatcatcaagtttccgctgaccactgagtctgccatgaagaagatagaagacaacaacacacttgtgttcattgtggatgttaaagccaacaagcaccagattaaacaggctgtgaagaagctgtatgacattgatgtggccaaggtcaacaccctgattcggtgagttgggcctcaagggatggggagcaggctggaccagcagtctggagccaaaaaaacctgcattccatgaagctttttgatgtttaggtagtcctggtaatgcaggactacacgtgtagtccgagctatgcaggaggatctcttgaggccaggaatcacccatgattgccccattgtactccagcctgagcaaccaagcaaggccctttttaaaaaaaaaaaaaaaaaaaatcccctggacctttcagcaggggaaaaaggttccttgacttaaacttggtgtaggtttagcagtgtgtgtgagccttgaggcaggaattacaggctgctttagttacagacctttgtgtggacctgaggctttctaggacttgattgggggttggtcctcattttctgggtccctacttctattgggaaaggcaactagagtgcgacacgtggcagattaccttggtttaagtcttaatgtggcctgtggtgtttcccataagagaattggctttgtggcttcatggtgtcctctgggctaatgatggaaaaatcattattggaaaagaatgacatgaacaaaggaaccactgaagtgccggaggactggaggaggaagggggagggtgtgggggcagtgagggtggcagggactaaggcttccttctctaccctaggcctgatggagagaagaaggcatatgttcgactggctcctgattacgatgctttggatgttgccaacaaagtaagtttccttcctacaaaccccttaatgctcaccccttgggtgcaaatgatgcatatgttagcgaccaaagcctgatctttgctgattagtcataattaactgactgcacccctatccttgacaaaccttatcctcacattcctcattttgctttctaaaaataacattccagcttaatcttcatatttcaactccagtaacgaggctcccttttgtttttcagattgggatcatctaaactgagtccagctgcctaattctgaatatatatatatatatatcttttcaccatatacatgcctgtctgtcaatttctggttgggctgggaggccacacacacacactgacatgacagggcttgggcaagactcctgttctacttatccttttgaaatacctcaccctgccactccaccatgtatgatcattccagagatctttgtgactagagttagtgtcctaggaaaaccagaactcagaacttgcctccatggttgagtaacaagctgtacaagaaccccttttatccctggaagaggctgtgtatgaaaccaatgcccagggtttgaagggtgttagcatccatttcaggggagtgtggatt

SEQ ID NO: 2271 - DNA, 2198 bp, Homo sapiens; identical to SEQ ID NO: 2270

SEQ ID NO: 2272 - DNA, 2198 bp, Homo sapiens; identical to SEQ ID NO: 2270

SEQ ID NO: 2273 - DNA, 2198 bp, Homo sapiens; identical to SEQ ID NO: 2270

SEQ ID NO: 2274 - DNA, 1211 bp, Homo sapiens
gagctgcaggagcttcggcgagagctggaggagctatcagtgggcagtgatggcgtgctcatctggaagattggcagctatggacggcggctacaggaggccaaggccaagcccaaccttgagtgcttcagcccagccttctacacacataagtatggttacaagctgcaggtgtctgcattcctcaatggcaatggcagtggtgagggcacacacctctcactgtacattcgtgtgctgcctggtgcctttgacaatctccttgagtggccctttgcccgccgtgtcaccttctccctgctggatcagagcgaccctgggctggctaaaccacagcacgtcactgagaccttccaccccgacccaaactggaagaatttccagaagccaggcacgtggcggggctccctggatgagagttctctgggctttggttatcccaagttcatctcccaccaggacattcgaaagcgaaactatgtgcgggatgatgcagtcttcatccgtgctgctgttgaactgccccggaagatcctcagctgagtgcaggtggggttcgaggggaaaggacgatggggcatgacctcagtcaggcactggctgaacttggagagggggccggacccccgtcagctgcttctgctgcctaggttctgttaccccatcctccctcccccagccaccaccctcaggtgcctccaattggtgcttcagccctggcccctgtggggaacaggtcttggggtcatgaagggctggaaacaagtgaccccagggcctgtctcccttcttgggtagggcagacatgccttggtgccggtcacactctacacggactgaggtgcctgctcaggtgctatgtcccaagagccataagggggtgggaattggggagggagaaagggtagttcaaagagtctgtcttgagatctgattttttccccctttacctagctgtgccccctctggttatttatttccttagtgccaggagggcacagcaggggagccctgatttttaataaatccggaattgtatttattaatttgcttccagcctgacttacctgggttggttaggtccctgggaggctcaaccaaactgaaggcaaagaaaggaccagtcagagaagggccgctgcctgggtctggccccaggatccagcttacctgctggctcgccctctgatggacgccgggaaaactgcatc

SEQ ID NO: 2275 - DNA, 1266 bp, Homo sapiens
cctcccccagggtttgactcttggaagctgaatcttttgaggaagttgtttgctatgagtctgaatcctgaaagtagaggacttgatggagtctgtaatctgtttaccactcagatgaggatgtagaatttattgttggtgagttactgaactcttcctaaagaatggttgcttaggcaaattttctctcaatcagtttaacccttagtagtttacagtctgttctcagtgaaggccagagctgtctttctaatgatactgtcctttaagaatccttgttggatatgcatgtgtgttgttcagtggctcaaaataaaggactggaatgatgtatggttctctcttcatccaggacaatttagcttttggtaacctgggctggcattgttattaatttctctcctagatcaaatggttggtggggttgctttccaacgttaagacaccactgtgtttgattattttggttttgtaactaatagggcaatgagtaatgcattcattttggaaacaggccagtggtaacacagctcttgggcctgctggacgtgtggaaaaataggacagagtaaacaattgagggcataaataatgaatcttccaactgagccctgggagagtgagggagattatcctcagagctgttcagtctggcagtaaaagggaaagagtccactgaattaattacccagactgtatttgatactgcaggaggtatgagattgtcaaaaccattcaaaacaaagttacctttccgatacaaacttttaatccatctttttgtttgttttaaaccagacatttgaattgttcatttattttttagagtccaggcctttgtatcttctttaaactttgttctatatgttagcattctgtgaacacttgatggtccttttgtttagtcagatcttagaagtttacttcattagagatttcatgatctgtaaatacataaaacgtctcacaaaaggttaagacaagagtttgggccagatgtggtgactcatgcttgtaatcccaacacttcaggaggctgaggcggacggatcacttgaggccaggagttcaagaccagcctgaccaacatggtgaaacctcatctctactaaaaatatgaaaattagctgggcatggtggcacaggcctgtaattccagctactcaggaggctgaggcaggagaattgcttgaacccaggaagtgggggttgcagtgagctgagatcgttggactgcactccagcctgggtgacagagtgagactc

SEQ ID NO: 2276 - DNA, 1174 bp, Homo sapiens
caggctgctttggggttggagtgagttaaggaagggagggagagatgctggaccgggctgagaacagagtcagcgccaaccaggctgtcctcccactcttacctcctagattgctgccaaaatcgctgccccacttaccaaggtcgatgagattgtggtcctcagtggagacaacagtaaggtcacatcagaagtgaaccgactgctggccgagctgcctgcctctgtgcatgccctcacaggcgtggacctgtctaaggtatgtgcctgcctagctgcggtggggttgcccaggtagcccgtcggactggcccaggcaaagtggtcctgggctctggagccaaggtctcatggcatctcccatccttgcagatacccctgatcaagaaggccactggtgtgcaggtgtgaggctcctgcaggcccactctcttcagcagccacccggccctccctccagcacccgttttaatcccacagaacaacgggaacgttactgactctggtgccttatctcgaagggaccagaagtgctgcgtgttcaggccatctctggctgtcttcctgtctctcctgtctgtccacctcctcctcttcctctcctttaccccactttcactgccactttcatcaggtttgtgtctcatctccctgcgtgtcttttcctttgtctgtctttttctttcccccatgcacatcatgtagattaagctgaagatgtttattacaatcactctctgtggggggtggccctgctgctcctcagaatcctggtgccttgaagttctctgtgcatctgtccatcctccctatggccctggccagagctcagcatgggcaggggttctgggtaggacggtcactgtcctctctcctggactggtcttcccagccctaaaccctgccccaggaagcccacagcctcacctgctgctgcccctctaggtctgggcagccatgacctgcagggcccagagacactgtccttcccctcatccacccaaggccccagccagcgctcataccctgtcctttctccctgaccccaagggcacagaggcaaggcctcctgtctacagcagcttcctcagtttcctactgccttaggaggcccctgcttgtgctcagggaaggcctcttcatgggcatgttcctgctggggcggtgcggtttg

SEQ ID NO: 2277 - DNA, 1183 bp, Homo sapiens
actttatagatgttgtatgtcatacaatgagttaatgttaatgatatatattttgtatagttattcctaacttaccatgctttttggtgattctctgatgcaacagttttgtcagctttagttcagttagagttgtgtcaactttaacagaccagtgttccaagtgaccaggtagatgagtctgtgatatgtgaaggccttttacagttttgattagtggtctaccaggactttgtagcacccatctctttgtttcatggtacttttcatgatgggcccacctgttcatttgcacagaaacgagagcagaaaaaggagctgggtcatgtcaatggactggtggacaaatctggcaaacggactacatcccccagcagtgacactgacttgttggacagatcggccagcaaaactgaactaaaggccattgcccatgcccggatcctggaaaggagagccagcaggcctggcacacccacatccagcgccagcacagagactcccacctctgagcagaatgatgtcgacgaagacatcattgacgtggatgaggaaccagtagcagcggagccagactatgtgcagccccagctgaggcggccctttgagctgctgattgctgccgccatggagcggaaccccacccaatttcagttgcccaatgaactgacttgtaccactgcactaccaggtcagccaaaccatcatcatatcccttcccaaccccagtttccccaaaggaccagcacaagagcagtgctgcctgtggagtcactgttcatgtagctactgtcttgggttcctgttcctagttctgcttggagagatctttgaaggtcttagccattacagagcttactcagttttccattttctcagtttctgaacttctttccttcccctcccccagaattatctttttccttttttttttttttttttttttgtgagtctcactttgtcactcaggctagagtgcagtggcacgatctcggctcattgcaacctccgcctcccaggttcaggcgattctcgtgcttcagccttccaagtagctgggactacaggcgcatgctaccatgcctggctaatttttgtattttcagtagagacaggattttaccatgttgttcaggctggtcttgaactcctgacctcaggtgatctgcccacctcggcctcc

SEQ ID NO: 2278 - DNA, 1198 bp, Homo sapiens
ctgcccggccctggtccactccccacctgcaaggcagatttgtctctggaggacctgttccccacaccctgagaatccccgcgccccctctaggagtctggtccccaacttcgtcggtcttgggtagagggaagcttggccatggtgtgagcggcaagggagtgttggggagaggataggggttccgtgcctcggggaagagtcttgtctggacctgccgtcctggctcaaacaagctctcatggaagctactggcacccacgtccttctcccgctgcagtaggctggtagggtcggcagaaccgcacttggagttgagacctgccatcccttgccatatggtttgaagggcctgatgtgaagtgtgagggtgggagtttctaacctccctgctcgatctttccaggccgctgccgaggtcaaggcagcgcggccagggacaggctgggcccccggacggcagttttcttcatccaggaagaaaaactgtggccccggagacgcagaagcctttttctgagcctctagctccacttgcacacagcccagtgtcctcaccccgctaccgggctgcccatgctggatcctccggcagcgcccagaacttgaaaccgtgtgctcacgttctggggagaggggaagagtcctgcaagacccaccccagggatgaagaccgggaaggagaagtgtgaatccctgcctagctgcctggggatgtccctaggaattccgaacctatcttgggtcctgatgggtcctggcgctggacagctcccctggggcgcagggcctgtgtctgtcccctggcagttagtcaaggccttgtgtgtgagtttgtgggtctgaatgtgagagtaatcagggccctgcatgactagaggagccagtcccagtgtgtctgcacttcaagtggtccgaatcttgggtgaggggtcagcagtgaatgggtgtgaggactgtgtgaggccactagtgtgtgggtgcagcctcagccagagagctccctgcagggctagagtgagactgtgggaatccaggaggaaggctggtgtggccaggagtcccaccagccctgatggggatgtgggtgtgagtgttaggaggaatctgctcactctgtggcctcaagtctgtgtgtccctgggcagtgtcccttcctgactatcaggatctccagtgcccatggaggcacctgcca

SEQ ID NO: 2279 - DNA, 1134 bp, Homo sapiens
gcataaatagctgctttaggtttgccagaggcacatagcttaacattagttcttaatatcgatgttatttttactaatgtaattaatcaacagagcaccaagattctttcatggtgaaaagggtgggcttctgttttggtatcttaaaatgtttcttttaaaatatacatcacctgtgtgagaaccaggaccacctgggagagtgatgaatcattggctccactcaaaagcattgctttactgagttttaaatttcacactgttttgccgctcaagaaaggtcttaaagtagttaaaggatgccagcaatagtgcgaatagaattttcggttgtctgcataataaaaacacccattgcagcatgattggtatgttgctcttgcattattgggaatggtaaatcagttatgggctagaaactatggaatggccgtcctcatatgtgatgggattgctgattcagacttccctattttccatacaattttgttatgtgcagagttctaaagccattttataatactgcagtatcccccccccccccacctttttttttttgagacggactgtctgttgcccaggctggagtacagtggcgcaatcttggctcactgcaacctccacctccctggttcaagcaattcccctgcctcagcctcccatgtagctgggattacgggcgcacaccaccacacctggctaatttgtattcttagtagagacggggtttcaccatgttgaccagactggtctcgaactcctgacctcaggcaatctgcccgcctcagcctcccaaagtgctggaattacaggtgtgagccaccgtgcccggccaagtatctcttttctacagccttattaaactaactacaaacatttattttccaatttagttttactttcagtgcatatcaaagttgttgtactcttcagaccaacaaattaacttgagggcaaattacatagctttccatgtacccttttttcctcaggtgctaatcaaaggctctgaaaatggatactgctttagtgatgtctgctttattcttaaaatgcttatttcttttgctagatgtaaagatttggtgttaacaaaagtggttttaatatgtaaatatgaatgaatgcctttag

SEQ ID NO: 2280 - DNA, 1405 bp, Homo sapiens
ggggataggggagggcattgaagttctacaattctggaatagttagttgatggtacatagttaacttggcttcggttacatattggactttaacaactgaagaatctatgcgtgtcatttaaagaaaagttgcagaacaagcaattggcttagatatacaatctggaaaaatattcctgtgcccatattttaatgtaattgtataactgggagcaaaaatatattctgcttttcaactgtaggtgctccagacttgctctccgtcactaacactaaatgtgctgttttccttgtttttcatcaaacatttaagacaaacttagacctttctgtaaattatcttttaatttctcagcaaaatctaaaaggggaagaaaaaagtccatgaaaactaaaacttttcatgtttttagccagtgagaagataataaaccctgactgtagaaggtgtgttttcatgcaaactatacttctgagcttgttagcttctaattatatcttaataaatatattttattactagagcaagatgggtttttaaggaaaataatgtgaaattctggaaattttctttggggcagagaagagcattagccctgtcttatcattacattgccatcctgttgcactgcagcttgtgtatagcatgctaaaataaatttttgtgtgtgtgtgcagaaattaagggtccaattgagattgggtgatgttagtaacataataacaagttgtctggcctgacacagcatcacatcacacacacagaaattagtatatccatgtatgtcaaatacaggttaaaatatcagggcatttatataaagagttgtagtcttctgataaaagtagactggatcccctggggtatttggggagaaagtaactactttggctctacccctagaaatgtccagttttgagtgactgtagtatggatgggttttcttgttttgttgattatttgaggcttttaaaacaagtagttcatgaaagaagctgttggactcaacatagagtagagtaactatctttttagtctggatttctgccctgcttagattttaaaagtataagcatggattgccaattccacttgatgtaaacaaaacttttttttatacataatatatatatatatatataaaataacttattgtatcagtccaggttcagaaacttgtggtaggccagttccagatagtttcatttcacctgtaaactgtatcactttgactgatattgtaattttcaaatgtataatatgtttacagatgtgccctgcatttagtctgccttgttcctattttgatttttgttgagtctcctgcctgcttgccaaaagctaggatgcttcaggcccatgtacaattgaaagcagaggcatccttgagctttaaagcattga

SEQ ID NO: 2281 - DNA, 1211 bp, Homo sapiens
tgcaaatgctgtttgattcattttccctttctgatcctaaccttgtttgagtttcagggaaacttttaaattttgatcaagtaaatgaagttgctagtagtcaaagaagtaattaatattaagtaacaggaagggaaattgcattcacttcttagttcagcatttctgataatgctgatttctttctttacttttctttttttttttttgagacggagtcttgctctttcgcccaggctggggtgcagtggcacgatctcggctcactgcaacctccgtctacggggttcaagtgattctcctgccttagcctgctcagtagctgggattacaggcgtgcaccaccatgcgttactaatttttgtatttttagtagagacggggtttcaccatgttggccaggctggtatcgaactccttacctcgtgatccacctgcctcggcctcccaaagtgctgagattacagatgtgagcccctccgcaccaggaatatgctgatttatttctttgctagaagcttggcttgcttcatagctagttttataggtacatcatacatccctatttccccctcagaagtcatgatcaaactcactactctagagctcacatttaagggtaataacattttatcataaatcatttttaaatgtatagtatttgagtaaaaccttaagctgcagtaaagaagtatcttcaacttgggtgtttgcaaatagttgttttgccttctttattctaaaatatgtatgtttgctttgtttttaaagtagtgttgttactgtgactctgaagtgtattctcaaaaaaaggggaaagtgcagggataggttgagtttccagtggggaagaaaaaaggaaatgttacttataggtggttaacatgaaaagttggattaactttttcttttctttcttttttcttatttattttttaataatagacacagggtctccctatgtttcccaggctggtccctcaagtgatcctcctgctttggcctcccaaagtactgggattacaggcgtgagccactatacctggccaattttttttttcagcgtatgactaaatatagatttatctttgcagtagacaaaatgaatatcaagttattactatatacataattcttcaggaatttatttgctacaaaatatgaaatttctgtgctttaaaataaaaaatattggttgtattggatcaatt

(The sequence listing continues in the following parts.)

What is claimed is:

1. A method of reducing expression of a target Methyl-CpG-binding protein 2 (MECP2) gene in a cell, the method comprising delivering to the cell a single stranded oligonucleotide of 15 to 40 nucleotides in length having a region of complementarity that is complementary with at least 15 contiguous nucleotides of a MECP2 RNA, wherein the oligonucleotide binds to or within 500 nt of SEQ ID NOs: 5876, 5877, 17392, or 17393 wherein PRC1 binding to the MECP2 RNA is disrupted.

2. The method of claim 1, wherein the cell is in vitro.

3. The method of claim 1, wherein the cell is in vivo.

4. The method of claim 1, wherein the oligonucleotide has complementarity to the MECP2 RNA in a region of the MECP2 RNA that forms a stem-loop structure.

5. The method of claim 1, wherein at least one nucleotide of the oligonucleotide is a ribonucleic acid analogue comprising a ribose ring having a bridge between its 2'-oxygen and 4'-carbon.

6. The method of claim 5, wherein the ribonucleic acid analogue comprises a methylene bridge between the 2'-oxygen and the 4'-carbon.

7. The method of claim 1, wherein at least one nucleotide of the oligonucleotide comprises a modified sugar moiety selected from a 2'-O-methoxyethyl modified sugar moiety, a 2'-methoxy modified sugar moiety, a 2'-O-alkyl modified sugar moiety, and a bicyclic sugar moiety.

8. The method of claim 1, wherein the oligonucleotide comprises at least one modified internucleoside linkage selected from phosphorothioate, phosphorodithioate, alkylphosphonothioate, phosphoramidate, carbamate, carbonate, phosphate triester, acetamidate, carboxymethyl ester, and combinations thereof.

9. The method of claim 1, wherein the oligonucleotide is configured such that hybridization of the single stranded oligonucleotide to the MECP2 RNA does not activate an RNAse H pathway in the cell; does not induce substantial cleavage or degradation of the MECP2 RNA in the cell; or interferes with interaction of the RNA with PRC1 in the cell.

10. The method of claim 1, wherein the cell is a cell of a male subject.

11. The method of claim 1, wherein the oligonucleotide binds to or within 100 nt of SEQ ID NOs:5876, 5877, 17392, or 17393.

12. The method of claim 1, wherein the oligonucleotide binds to or within SEQ ID NOs:5876, 5877, 17392, or 17393.

* * * * *